United States Patent 7,892,730 (COMPOSITIONS AND METHODS FOR CANCER) - sequence listing, part 17

SEQ ID NO: 1829 - DNA, 1794 bp, Homo sapiens
ctgcgacgcgctccggcccaggtggcggccggccgcccagcctccccgcctgctggcgggagaaaccatctcctctggcgggggtaggggcggagctggcgtccgcccacaccggaagaggaagtctaagcgccggaagtggtgggcattctgggtaacgagctatttacttcctgcgggtgcacaggctgtggtcgtctatctccctgttgttcttcccatcggcgaagatggccctggagacggtgccgaaggacctgcggcatctgcgggcctgtttgctgtgttcgctggtcaaggtactatagaccagtttgaatatgatggttgtgacaattgtgatgcatatctacaaatgaagggtaaccgagagatggtatatgactgcactagctcttcctttgatggggaatgttaggctaaggatgtttgtgagctgagtgagataatcttttggggatggaaactgacctgtggctggccggccaaggacataagaatgaagaacttttgtcagtcctagctttgagtcagcctcatcccaacatcagaaggcagttttgccagctttccagtggagactcgaatcattgcgatgatgagtccagaggacagctgggtctccaagtggcagcgagtcagtaactttaagccaggtgtatatgcggtgtcagtcactggtcgcctgccccaaggaatcgtgcgggagctgaaaagtcgaggagtggcctacaaatccagagacacagctataaagacctagcaagatgcaaggctgccagcatctttgctctccacctcctgcctctgcttatttcttgttctggaactaaatgaacagaacttcaaatacttcctaccctccaattcagactcagctgactgttgagagagcagcacatcattttatcattttatcttctttggactacaggtggggtgggagggatttgggttggtggattaacagatggaattgaggagagagtaggatgctgattttcctacccgtggcccaggtctgtgccttccccatgccaaggactctaggtcaaatgtcaataaatatgaacctcgagaaagttctgaaggccatgacacctgccttgcctccctcttccattctcttaggcacagtaatagcttatttgccctataagaaccttcccagagcagcagaggcccttctactccctcttgactgtctcagcctctgggattgcagcctttgtagtgtgcttccttgcttcctatcagagggtgctgatccagaggctcagtaaccccatcaacttggtggccctggtgtctcacacttgtatccttctgccctcgagacctggcacagcagtatcccttgaagaaatcctgaggctttgtagagtgctccttgaccatgtttaataattcttccctcccctgcttgtctattttcttctcttcacggctcttcctataccttaggccagtctcaagcactcactggagacccttgggccttgggcgaccattgagtcctagtctcccttgtttgtgcccctgtaggaggtaggtccttttctcctccggcctagtaggggaccttgggtaacatcccatttttcggccaaggtgagttgttttaggataaaaaaatttaccacaaattctcatttaaatttccacagaaatcctgttcgtatccccattttgatttccctaagttccttgttctccctctaaaaagagaatgattgcaccctgcctgtttacctcaggattgttgtgattgtagaaacgaagctatgtgaaaat

SEQ ID NO: 1830 - protein, 61 aa, Homo sapiens
METDLWLAGQGHKNEELLSVLALSQPHPNIRRQFCQLSSGDSNHCDDESRGQLGLQVAASQ

SEQ ID NO: 1831 - DNA, 126413 bp, Mus musculus
  misc_feature (1)...(126413): n = A,T,C or G
ccccgatttgttgtatttttaatcatgtgtaattgtagatgtctgtgttggtgtgtacacacgtgagtgcagatgccctcagaggtcagaagaggacactagtcctccagagctgaaatgacagggcttgtgagctgagctgcccaacatgggtgctagggaccaaatgctaaccctttgaaagaacattacagccttaattactgagccagctttctagcccctctggatttttttttttttttttttttaaagatgggctctgggctggagagatggcttagaggtcaagagcactggctgctcttccagaggtcttaagttccattcccagcaaccacatggtggctcacaactatctgtaatgaactctagtgccctcttctggtatgcaggcatatgcaggagactgctgtatacataatgaataaataaattttttttttttaaaggatgggttcttgctctgttgcctggagtctcctgggtgtcgtgattggtgcatgccaccctgccaggttatcagcatatctagtatcttctcttgggggtgtgataactgatgtccattgtcattttggcaggacagaatcatctaggacacacactgaaagaagagtttctagactgggttaattgagggggaagacccactctacatgtgagtggtaccattccatgggcgtggggttcccgactgagtaaaaaggcaaaagagagtggaggaagctctttgtgtgtgtgtgtgtgtgtgtgtgtgtgtgtgtgtgatcagctgcttcgtgcccctgctgcctgctgccctgctgctttgatggaccatgcccttgaactgtgaaccaaacgaacttccttccttatgtggcttttgtcatatgttctgttgcagaaagtcctacaggatataggacagctgtggtttcttcccgtgccattacctacatgctcaacctaacatgcttttacgtgctcaacctagcatgcctttagtaattaggtttgggatagcatgcaatctatggagatcaaaatggacaagatgttgttttgctcttgttgaaagtgaaccttaatcatagttacgacatggtcagggaaaatgacaagaaagaattgaactgaggtggcagggttcagagtagagtggctttaagagagtggactccaggaatgcaggagcataatgaaatttgtgttttgtatcagcaaggctaggatggtttgtcacacagcaacagacttaaaaatgggggaggaggtatctggggctggttggaggatgagggacctcgctactgtggtggccactgtgtgtgtgtgtgtccttccctctgtccactgacttcagaagccatcagatggtagctacttctctctagcatgctattctgaggagaaccccagaacctgcacaaacctgaaagtcacacacaagtgaaggtctgggatcttccctgagactgttcaagacacaatgagagagttgggcggtactcagtggcattttcagggttcctggtgttgaaaaggctgaggggtagtgtgctccttgggcacatttcacatgtcaccctccgccagtgctactcaggacttcactggaagctaccagaagggttgttgttcccactttctggtggctgaccacacatggatgatagggcaggactttggactacacccatgactcagaatcttacatccttagctctagggaggatccctaagggggatctgtgctacttttcttgttgctgtgagaaagtactcaaggggtgggggaggcaactcaagaatgggctcacagttagaaggtatagggtatagtccatccagcaggagtgtggtgcagctgggtacattgtgcccagcctcaggaagggggggggaggggaagggggagggggaggaagagagaaatatgaggtgaatcctggttctctgttcacagagagccctctaaactgcacagatctgaaaggtcacacgcaaaggtctgggatcttcccggaggctgtcccagatattgcagcaatggtcagagaagagcagccctcactagccagtttctcctcaccgatttttttttttaattcctggaccccagcccgtggaccattgctgtgcacatctagggctggtctcactaaagctctggaaacacaatctagaaattcctataggcatacccagaggtttatctcctgattgtaaatccagtcacattgacagtgttagctgtcacagtgacttagggctggaggctctaggtggccatccttaaaatgtctctggtcttgaatggagaccattgaacttcagttttgtttccagccaccaacgctaccactgatattttctccttctgataatttgcaaaaggaagggagaatcaactcccaagtccttcattaagacaggcttaatggtgatacacggactacactcaagaatggtgccagggttggcgtggtaataggcaaatatgggcagtcttcaagctgggccgggaatgagtggggcacatgagagcttcctacccttgtgtgagcgaggtccccagagaatctgatcagtcagggtgtgcgtgggtggggacgaagggcagagaaattctgttttctggcaattgtgctgggttgtgaagtgcgttgatcattagcttactcaagttgattcgttccaggtggcacagcatgtgagagacagggcgggaagggacgagcatccaagtcctcacctcggggcggtcccgcgggggttccagcagggggcgccccgagctccgggccgagtgtccgggcgcgcctccagccggcgcctgggacggggctggccgctccgccccctctgctcctcggcggctctgcgggcggacgccgggcgcagggagcagagcagagcggagcgccgcgcaccccgccgcgccccggtgcacgtccagctctccgcacatgcagcgcagcctttctccgtgagtagcgcccgggccgcgggattcgacggcagcagtggctggggtggtcgggcattgcctgtctaggatatagccgttctgtggtttgtgcgctgggacggcacccggaggccagtctgcaggctactactacctcggggtgcctcctaagcttgacactctggtcccagagacgggatggggattgacggacagaggcctgacatctgggcaggagaatggaaacaaccatgcatcaagtttggccccctcaaaagtccccagtaggagagaaacaagcccagcctctgtgggctcacacctcctcctccccgcctcagcccgggaggttgcttcctgtgaaatgaacctccagtgtggcctaacagctgcgggcaggtggagggacactccctggttccctgtcatctaaaggtagctgggggcagctcttttggtttctgacactagttcccaactaactggcttggcatcctaggggaattttgttgactaaaagtggctggtaccttgactgcttcagagttgggttcaaagccctccctgtctccacctgcccgccggttaagtttttggcatctaaagtcatggtattgatagaccagtagctgtctttggaggcttgactgaagtgtcaggaatgggtgggtatctgttgccccgggacaacaaactacctgctggagggaataaaccagccaaccctgacagcttctctagagccttctattctgttagatgtggggggcaaacagtccggctgcccaaagaagctgaaccttttattaaaagactgagtttttctcatgtcaactcagggaggtggctgaccttctgagccccaacatccttatcagggatcgtccaaaggggttctgtgatgctagagtctcctcccttctgctggcactgctggcagtttccccagacctgagtctgaggattcttcatgtgtgtgtgtatgtgcgcacgtgttccaaaccactgcctgtccctgccaaacttgggcaccttctccttggaactgttctcccagaagccactggctttccagtcctgagccatccatggaggagttgtgtgggtatcaagagaagccctgggaagtttgatggcctagctgtgccatggtggaaaggtccctttccctctctggacctcagatttctccttttgtctaacaagtgacttagacccgatcccagtgggttcagacttttgtttcaatgttaagtttttaccccaaaccccagtccacagcaaggataccgtgggatgggagtgctctgtatcacttcctcagcctgctgacttctgaggaagagagtaaactggaaaggtaactgggaggtccctttctgtggggtcccaggaggtctatgttacctcctagagtgttgcttgccattaaggccatgggtaggaaggagaattcccagggcccccttgggaggattgttcacgtccagatgggtgtcatctttgcaaggtagcctgagtctcgggtcaaaaggcatagtcatgtgccttgcctctgatatgtggttttcagcttctcaaaattggtggttataactctaccttcgagttactgcacttgactctgagaatttatcaattgaaatgagaattgctcttgtggaggtgtgatgggagggtgatgagctgccacgggtgtttcatttcgtatggagtatctgagctgtagccatgagcaagaagcctgggccctaactggaaattaccatcttatattaccttatagtacctgcttatgttagctactccctaggggacagaggtgagaatattacaccctttgccttagtgaggctccaaaagcatttcacatatgtcatcttacttataagaaagatctttcttagggtgttggagagatgacccagtggttaagagcactggctgctcttccagaggacctgggttcagtgttcagcaccaacatggtggctcatgatcatctgtaacttcagttcagaggatctgatgccctcttctggcctctttgggcaccgcagacatgtggtgcatagacaaacatgcaggcaaaacaaccatacacctacagagaaataattctacaaaaacagtctaaaaaagaaagtagatattagtttactccatgcctctcaccccaggatctcatatatccaaggctggccttgcactcattatgtagacgagggtgactttgaacttctggtccccctgcctctacctctggagtgctgagattatagctgtgagccaccattcctggtttatggagtgctgaggatcgaagccaaggctgctttgtgtctgttaggcaagcattctacagactgagctgaatccccaacactgttaattctccatttcgttttcttcttggagatatggtcttaccctatggcccacactggcctgaaactcaaggcacaccttgagtgctgggattacaggtgtgtgccaaccatacccagtgcatttggcactggggatggaaactcgggctttctataaaagtaactgatagctgagatctctcctccaccctgtggataagtcttctccaaattgaaccaaacagcataagatctttttgtgggacctggtttcttttgttcttcgtgcttcatgctccaccctattgtgtagtgactcccttgttctattgatgggcatttggttggtttcaatttttagttgttgctaggagtttagttgatgctacatggaccattcttgctgcatgtgtctctcacagtacgttcacagagatggttctacagtattcagagtgatgtttcgaggtgtgcactgcctggcagtgtctaggtgttctggttgctctacacacttaccccgcagtatggttactagggctgttttccatggatgttagtttgaagcccagaaaaactatcttgtcctcagttaagggcaatgtggtcgtaagtaacggaaccgggatttgaatccaaacctgtgtggctggatctctctctttcttcaaaatttatttttattatctgtgtatgagtgttttgcctgtatgtatgtctgccacatttgtgcccgatgcttgtggaggccagaagaggatgccagttcccctgaaatggcaatttcagatggttgtgaaccatcatgtggatgctgggaatcaaacccaggtcctttgcaagagcagtcagcgtccttaaccacagagccgtctctccagtctctttctttttgagtcaggcacagattatgaaccagaatgagaaaattctaacctaatcctaataagagactttttctagagtttaaagaggggaagaacagggtcgtggagttttacagagaaagtggcactggggcgcctagaccctaagagcatggggcagctgtccactgggctcccatggaaagagccctccccgaggcgagacatggcgggatgaaccaagtgaacaggaatggtccgctgtgactgtagtgtatgatatgtggaatagggactctatgactgtaatgtatgatatgtggaatggggagttgatctgtgactgagtcctcatgccctccacgctacccctggccatgtctgggggaaactgggggcttctctgaattcatctcagccccgattggcaaacggagctggcctctcaccaaagggaagctcatagctctcctgggaccatgcttcgtgttcctgccaacaaaatttggggtggggtggggtgggtctttctgcttttctctctctctgtggggattggtgcccttccctgagagttgatgaatggtttgtttggaatgagtttcaggaggctggcgggggatattgaaagtgaagacaggttcagcttctgatcctggttgagtcaaccttgctaaggggatgctgaaacctgttcccgagaagtgagtgtggatgtctccatggccatgggaagcagagacacagtggcctgggctaggacagtaaaaccatcctcctccttacttgtacagtaccttacatctccccctgctccagtggctcccatgctggtgtgtgaagtagatgctagggattataggggtgtctccatttacagacgaggatgagaaagagtgccagcctgctgtgggttacagggataatccacatcaacctagtcttgtgtctaggcttgctcatgttagtatctgtgcacactcaggccctccctgagtacacagcgggcatgaagaaggaggatacatgaagggtcatgggtgcccacaggcaggtgaccctgaaagtgagatccgggagctaggccagctctgtctaagggtctcaagggtctgtgtgctttggcagaagaattgaaggagtggacattttggtaatggggctctggtttgtgagaaggagaaatgtatatatccattgacatctgcaagagccccagtctcttgatgttggtgaaacctatcctaggtgacggtccctctaaacctagagaggagagtttttcagggtcacggactgagtgtggttggcatttgattgacaggcagaagagaggctgcccatgctagccaaaataggctaaggagacctttgctaaggatccttgagtgacccatgcatcagctggccttatctctataatggggccctgcctgcagggtgctgtcctttggaaaggagatcacagggggagttacaagccccagggtgaggattccctgtggcacaaactgtcccctgtcttctgctgagttgccccgcacaggcagagatagccgtgttccacagatgaagaaacagggttcctttgccaagggatgaggtcaccgagctagatgtgggtagcgctggaaccagcacccgaggctcctgactcctggtgctcttttaatttgtcacaccatccccacccatattccctaggaggtgatgagtgaacattaccaatccgttcagactcgccatcgggtggcactgcccccaaggaagctgaggtcatgataatcccttgtctttcctcagcacctaatcactcacaaaacagtttgatggctttgaaattggattttttacagtattggccccattttacagatgggaaagcacagtgtctggtaacttaaatggtttacccaaacaaaactgggctttccgtgttgggcaaatagtctacccctgaattgtatcaccatatattggctgtaggaatattattttatatgtagaggtgttttgcttgcatgggtgtctgcatatcacaggtgcacagtgctaggtgaagccagaagagggcatcagatcccctggaactagagttatatgtgattgtggcccactatgtaggtgctgggaatggaacctgagtcctctggaagagcagcaagtgctcataaccactgagccttcgccccagcccagctcttgattttttgagacaggggttcactgttttgtccagactggccttgaatccttgatcccccccacctctcagttatggggtcatagattcccagctgcagacagacgcctcttgtccgagtaaagctgaatttagtaagaataaatagctgaagttcctgtggttctgtttctccgtgaacttcttcagacagatctgaacaagcaggaagggctctttttctatttcagaaataggagacaggtgtggtggtacatgcttgtgatgtcagcactggagatgctgaggcaggagaattactacaaatttgaggccagccaatgaactgtagaccaacagaggctcatagcaagaccccgtgtccaaaaataaaataaaataaaaatcaaataatagctttggagagatggcttagttattaagagctctctcccttccagaagacctgagttgagttcccagaacacatatgaagtggttcacaactggctgtaactccagcttatgggcatctgacatcctcttttggcctgcacttgtgtgctcataaaccaaaacatacatatagatattaataaaataaaacttaagagaggaataaaacctatatgtcttagagttactattgttgtgataaaacaccatgaccaaagaaacttggaaaggaaagggtttagccggcttacacttccacatctgttcatcattgaaggaagttaagacaagactcaaacagggcaggatcctgaagacagcagctgatgcagaggctatggaggggagctacttattggcttgctcagcctgctttcttttctttttttttttttgtaaagatttatttattatatgtaagtacactgtagctgtcttcagacactccagaagagggagtcagcatctcattacggatggttgtgagccaccatgtggttgctgggatttgaactctggaccttcggaagagcagtcgggtgctcttacccactgagccatctcaccagccctcagcctgctttcttgtagaacccaggatcaccagcccagggatgccaccacctgcaatgggctcgaccctccaccatcaatcacgaactagaaaaatgccttaaagccagatcttatggaggcattttctcaattgaggttccttcttatgaaggcattttctcaattgaggttccctcttttctgatgtcttgcgctcctgtgaagttgcaaactagccaggacgttatacatcagtggttctcaaccttcccaatgctaccaccctttaatacagttcctcatgttatggtgactcccaaccataaaattatttcattgttcatttatttttgctactgttatgaatcataatgtaaatgtgtagtatgtagtatatctgatatgtgacaccccccgcccaaggggtcaggacccacaggtgagaacccctggtatgcggcctcagcacaggtgagaagctcacacggacctgttcctaaggaatcaagctgtgggcaactgaaaccgtcttgccctttgcagttggttgctttccaaactcagactcttaggcttgtgctcggccatcctaagcttcggtttctttccatttcaggattgtatggtccaggcctcgatgaggagcccaaatatgggagacgttcaaacagcagaaggtggaggacttttatgacatcggagaggagctgggcaggtaagaggtttcgtgagaggaggaggggtgtgcatggacagacacacttctctgggtcggttgctgttgtaaagctggacttgtcacagggctgtcgggaggcttgcaaaacaggcccgaggtttattcatcctcatgggtgactctgcagatcatgtgtctcatgacagcagaggtgtgcagcttgaggctgcgatttctatatactctaactgcccactcaggggagtcttcatgtatccatcattacccccacccaaaagcccctctccaggctgcctggacatctgacccatcggttttgttctccgtgtcccattgggattccnnnnnnnnnnnnnnnnnnnntgtcccattgggattccccatggtttcccaggattttcttttgaaagctggagtctgaatgggaggtgaagtaatccttccgaaaagggatttgtattgagtaacagccacaccagcctcgtcagggagtttctgggatctgagttgtgtttcctcagagtagggctgtactaaccctctcatcacctcaaagtcactactttgtacagggagagactggattttctgaggcttccctctggacttccatttttaagaatggctgactttttagatggtattttcgcggttacaaaacaccagtcctgaagttctgatctcaaaagcatgtgggggatggaagtgactttcactctggtctcacgggtgggagacggcagggtagggcttaagggagtttctcaaagttgctgagggcagcaagccacaaagccaagattccaacctgtcaggtcggtccctgcacacctgtcctgcgttctcgtgtgagcaaggttcttgcacgctcacatgtttctcggggcaacaccatctcagcccttcgcactcagaacagagcaaaaccacgggctgtttagggtgcctatcaaactggacaggtaaagcaggaagcttcttgctttctttagaactgttgactgttgaattagcactaattcttatatcctttgttttaaaggcaaacaaagtagggccagagagccttattccaagatgagaggcaacaggggcatgggttagggagtaacccctccccaggccggttgggtggggagcgaatatctgcagacttcaaggctcctcagccttctgttgctaatcttgggcctagaaaaggggtgtgagagggatagaaggtggaggctttggggtgctcttctggagcctgcctctgaatgaaaaatcagggtgactttgctgcaggcctttctgccccgccccccgccccccccccccccagcacaggaaactggcctctcttggcaaggaactgcccagggtgtctgagttggtgttcttgccgttgcctgtgttctgtgctaggggtacaatgatgtgcaagggactatgcatatgtcccccctggaactccagcctgagagctggactgatgtctgaggggcagagaaactgagaagttggctggtcaagggccctggagaaggatccagaattcctggggaattcttgtgtcaccttctccttgccttgcctctccaccactttggacatgagctattagatctgggagacaatcgagtttgcaggctgcaggggctgggtctctccatctccaaaggttgatggagtcgacagagactgggacttgtggagtggtcagacatgctaggacttggctacaggtctgtgagccattaagaatccttccttccaggatccttatttgacagatgtaactgaggttcaagtagagaagggtcctgcagggggctatagaatggactggaattagagctactttgaggataccacacagtgttttggtagggtaggaggtgctggggggcccagcgcaggattctgatgtgtgctgtgcgactgagtgctctagccactgagtgaagctcttagcctacaaccaaatcaacttgcaaaaagtgatccgtttcattttacatattgaggacctactgtgtgccagacatgactgaaagcagtactaagtaaaacatgtgtcctgtcttcttgtagtctttggtttattgatgcagagaggcaccaaaaagaggatttacagaggatgagtcatggtcaggtcagatacgaagggagagcacagggtgctttgaaggagaagaacgggagatacatttaaaatgggctggtgagtgagactgctctgaactctggcctccgtgccgagtgtggctgtacacacttctgctccagcctgctcatgatgctggaggttgtctgctgtttctagagtgtttagagagatgctggtttggccttcctaactcccagtggggaagaacagggaaaactgactggagccaggctcataaagagaatcccatttaacccattgtcttgtatgaagctcagactggtggcttatccaaggtcacaaagtatgtgagggtaggggctggtgatcaagtttggggtcctatccttgaaggaacataaaaacccacagacacaaaaccatttactttattcgaatgcgtctggggagtgggagagaatgtaaggtaggggagttggttccttccccctcttctgtttggctttgagagtaggtgtttggggtcaaagctagcaacataataagacctctgtgtctcaaaacaagcagccaggtgtatgacatacaacctaatctccatgcttgggaagaagcagaagggggtctctgtgtgttagaaatcaactgtcactcacctggtaagaccctgtctcaaaaacagacaaacaaacaaacagaaacaaaacaaacaaacaaaaaaaaccccacaacaacagcaacaaaaccatgttaaattatcagctagttttattgttctatctttcctctaactggccaagggtgtttctcactcttgtacacacccctcctcctttgtgtctacttgtgcatggagttcacattcctcagagagctaaggaggcccagacagcagagatgggcaggcggctcagggagagactaggcatgagattaggcctgccttgaagttgtttgtgctgggctctttgatgtcaggcaatatctagtttcctatctcaggcatcagaccacactgaaactaaggccagacatccacccaacttctgtgacttgtttctgcccttgctgtccccctctgctcttaaaaattatcattttaggggactggagagatggctcagagactaagaacactgactgctcttccaaaaggcacgagttcaattcccagcacaacaaggcagctcactactgtcagtcgtgtcagtttcagggaatctgatatcttcttctggcctccatggcactaggcatgcgtatgttgcacagacatacatgtatgtaaaacacccacacatatgaaaaaaaatcatacttttttattgagatataaattagttgctatctccccaatagcttactatgggggggattccattccatactcttcctaaagagttaatcagcttttattctagacccccacatctatgacattaaaccattttacacactaaagtgtttccccattgggttggacgtcctccacctggcacccggccttctgggtacttcagcctttaacctgtggatctccaaggcccctgtagtgttcatccctgtccttttacacttggtaggtcctcagaacccactggcacctataattaaacacagagctatctggaagctgcttagagttaaatgtgaagtagttgacctctgtcacgcccaactctcataagccctagactccagatagagtggaaaacagaaccagggagcacctccctccctccacggaggactcaccaccaattcttcattaaaaaagatgtacctatttgtttgtgtgtgtgtgtgtgtgtgagatgtggtatgtgtacatgtgtgcagatgccatggagaccagaagcatcaggtcccctagagctggagttacaagagtctgtaagccagtcagaactgggtactgaactcaggtcttctgcaacagcagtatacagttccaacctgaagccatctctccagtcctactgcatttccttcctttaattatgtaattacatttttttttctggttatgtctgtgtatgcatacatacgaggacaacctgtgggggttgattctctccttcatcacgtggggcctggagattgaactcaggtcgtcaagtgagggagcaggcagctttctccactgagccatcttggtggccctgtatttacatctcacaccaccatgtgatgcagagactattctagtcctgcagatgaagaagctcggcccctgaagccttgtgtaactacctcaaggaacagacctgtgaagtcaagagacacaacaaacctcagaggaagtccaggctgaaaaccaggggctttctctaggcagagccctgtccctcgccctgatctgggacttttgtgctggtatttatttcctgtctctgagaatgtgaagtgactggttcatgtcaagactcagtacaaggggactcagtgttcccatttgacagttgaggcaaacaagagaagtgaagacatatatttatggtcacgctgtctgacgaggacaccaggactcagttctaggcctgtcactttggaaaggtcatgggctttttagattaatttattttacttttggtgtatgagtgtacacatgagttcacgggctcagtgcagacatgcttggtgttggcctcaaggaagccttctaggctgtagctgtaccctagactataagccagcggcttctataaggtgtgtgtgtgtgtagatgtatgttcccatctgtgccttagactacatctcaggtatctattgtctattggacattgtcacagcacaggagagttgggatcagtccttgtcccataagctgaaggctcaacttgggcccaggaatactctgaaaagcatatgaaatcaacgcatggactagatcatgtgctaacagagggactctgaaaacatggaccaggagttcagatgaggacgctaccgctttgggaggggcaccttttcatgattgagtcccagagctggtggtaagggatccttaaagtgaggattgtgtcaggactcaggagtggtgggcctgggcttgggtaaaagagcagaaaagcgtgaaaaaccccagctgcgtgcagagagccctggatgacagacatcctggatggggggctggagggggggggtgttcatcacccattgtaaggaaaacaaagcacaaagccactcaaacaaagtggctgcagggagcctgcttcagtcagtgggaaactcagcatccatgcaaattgttctgctggatgggtccccgcagagcccagtcctatgagatcctgagggctgtgaggctctcctgagggctcactgaagtcaccgctccccaggatttgtggatgtcctttatttgctattcattcgtttcttgtcagcatgtagatgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccagggcattaggaaatccggttgcctgacctagcccttccaaggcctcccagggagtgctttctcctccgcagccaggctctcagagctgggggaacaccttcttgtagacaaggctactctttctctgtgacctatcccagcagggacaaagggcccagtctgtatctgcccttcatctctgagaggactgcagggtcaactgagtttcataccatgatcagaggtgctgagagaaaattctgcatagagaagatggtggcttccagtggggtgacagacagacatctctgatcatgtgacttgtgtactctgccatgctgcctttggcatttcttgtacttatcacccaagagagatggtccatccttccacagttggacagttggactctgttgttatagcctctccctgggtggaaattgcatcttttcctttgttttgttttttgtttctggtttgtcttttatttttgagtcaaggtttcatggtatagtctagactgaccttaaattcatgattctcctgcttctgtttcccacatactgagattacaggcatgtgccaccacacccagtgacttcttttgtagattcaaaagtatgttgaaatttttctccaagacaaagccagttctgaggctggaaagatagctgtcagtaaagtgcttgtcatgcaaggtggatggcccctgaggagcatgactcagtattagtgtctgatctggaagcacacacactcatgcacgtatgcacacacacacacacacacacacacacacacacacacacacacacacacacactctggcacacatctttaccaccactactgtcaccacggcaatagtagcaaccctaacagaacagacagtaggaagccattgtgcccatcttacagataagaaagcaaaggtacaaaggtccagtctctgccctggagaacagagaagacagatgagtggagataaggcatcaactcagctctgagcagcacccttgaaacaattcctgagaggatgatgtttaaaagcccatcttgagctggagagctggctcagcagctaagagcacttcctgttattacagtgaacagacctgagtttgattcctagtactcacctggtggccaacaactgtctgtaactccagtttcaggatctgatgacctcttttggatgccaaagtcactatgcaggtggtatacacacacacacacacacacacacacacacatatacacacatagggaaaatgctcattcacataaaataaaaataaatacatctttaaaagccatcttaaagcaggatacctacagtagttgttgagtttggagtcatgactaacatctcgtgtgaaccctgattggtttctcctggagtctgtgcatgctcctataagacttcctgctggttaggaagctcttcaggttgtaggttagaggcactaggtctaccaccctcttccacagttcctagtgtcccttctctcctggaattttatatgttaggctgtatctgtggggcagctaaactaccatctctagcatgtggccaagaattggtcctttaaggtcaagggtcaaacttgggtgtgcattactgctggtggcctgtgtgagtctgggcaagttgcttcgattctcagacccttgtttttcatcatgtgtgaatgagaaaggcatatatgcactgtgtactttatcaggtcaagatttgaacgcagccctctcctgaggactgactgaggctatggttgaaaggtgacgcatgatgactgtcatctgtggccacacatctgaaccatggatttcaaacaaacatgcatgcaagagtttagatttagaagtctgggatagtgcttgcttctgtgtagaatatacaattgtacaaagtcagttcttcagatggtccttgagacacacagtaggctctctgggatgttggcttattcttttctttccttcattaaagaagtttctttgttatctgtcttggctatgttaatttacttacaatggatgcctctggactctgttctttcccactgtgtgtgtgtatttatgtgcatgtacacatgagtgtatgtatgtatatgtatgtactcatgagtatatgtatgtgcatgtatgtgtatatgtgtatgtatgtaaatatgtgtgtatgtgtatatgtatgtgaatgagcatgtgcatagaactgtgcatgtatgtgtatatgtgcatgcgtgtgcatgcatacacggtggaggtcagaggacaacctttaacgttcttaccctttacctcttttgagaggtgatggtgtttgccgatgtgcctgtgtgccacagtctagctggagggtgcatgagcctctggacaccctcctgtttccaccccctatctagctataggcatgctagggttggagacatgtcctactatgtgggttctggtgatataggcatgctagggttggagacatgtcctactgtgtgggttctggtgatataggcatgctagagttggagacatgtcctgctgtgtggcttctggtgatctgagctcaggtctcaccttggctagctagtacttttacccagtgagccatttccctggcctaacctaattctttgagggaaatagccattgactggaggaagaatgttgactgtaattgtccacaatgcagggctgttcctctattgtctctttaagattgcctaatgcccagcaccatcaagacttgctgacccatgttgattttgactagctggttactagttatccttgtaaaactgccttacatgtctctaatgtgtttacttccttcagttgccaccttagtttgccctttgcagagcagggatctcagccatgccttcctgcacagcatctgaaagagtgttgggagaaagtggcttctacaccaaaggagatgactcagctagcccaccctctcacccactcactgtctaatagttctcagctagcccaccctctcacccactcactagctaatagttctcactacagagactctgcccaagacttttagcgaatcgttctttttctgccaatcctctgctcttatcactcctcttgtcttcttcctaacatctctcagccctcgtactttataaatgctttctttccctctgagacaaccacatggcggcttcttcccagccccatccaattcagagccccctagagtttgtttcatagatccctgtcttaagcaacatgttttctagggtgcaggctgcgttccaagctagactgtgaaccctttgaagatggggccaagtgttagacttagtgtccttggtacttctagtaggtagctggatctatttacattaggtgttccatacacacaggccagcacagtcacaggctgtgtccagcctttgctgaactcctgagggctatgaatctgtctgtaccatggagaaggtagagatgcatcctgggtggcatttcaccaaggccttgttccatggcctttattgttttcttatccaggtaagacagagccaaggggcaagcatgtggaactgtttgacatcctctggctatttagaatatttacttgtgcactttgtagtgtcccagggtcatcctgcattgcaacatctttttttgcactggtgtgggcctggtgacccttgtcctgacttgtttctttagccccaagtggagtcaggttctttggacccagctagatgccccttctcccaggaaggtatggttctgggggatggggggtggaggctccctttgtaggcagggcctgctcccatccgagcaggaagaagaggaagaatcctgttgctatggaaacttcagatcagggttgaggctatcatagggctttccaaggattagaagaatagaaagactcagctgtgctctctggaccattagccatagacttggaatgaagaacttggttcagataccaaccaatatgttgtgtgtccttggtgtggtactctccctttgggtcctatgtcattttggtggcagaagcaggatgtgagcacaagtctcctcactcgaggttccttactgtctccacttcttcatagaaatattttgcatatttggtatcacaaaaaagtcacctttcctattaacttgttccttttgcttcccaaagtgcccttgagtaaagcaccttattccagtgccctgttgttggaggatgccccgaaaccatgaccctcctgcttttcctttctgtcggtattttcctttaggtcttagactttagattgtccaatggatgtatttcttgacagtctcccaggagagatgagcagaccggtgttgccttggggaggcatctttgcatccttggtgcataatacaaatatgagtgaggggttggctagatgtcactttggataaaggcacttaacattgagcctgaagtcctgagtttgggctggagagatggctcagcggttaagagcactgactgctcttttggaggtcctaagttcaaatcccagcaaccacatggtagctcacaaccatccataatgagaaacaaataaagaacctatgggctggagcaaacagggcaggggtgagtagggcagttgcaagagggagaaagggaaaggggggattaaaaaataccacagtcagcttccagcttcctctgtcaagatttaaaggaaaaaacaaaacaaaacaaacaaacaaaaaaaaaaaaaacaaagaaaccatgccatctgtcttgggaaaaaaaaaaaaaaaaaaagacctgagacctgagatcaatcctcaggacccatgtggtggaaggagaaccaacgcacgaaagttatcctctgacttcaacatgtatgctgtgacatgtgtaagactatacacaataaataaatgacaaacattaaaaaaaagaaaaaactaaaagattattatttaatgtcagctggagaacctagggtgtcatggtatcagttaaccattatttcaagagactgggccactctgggatgacccttgtgggaaatggaccctctcaaacacttggcctaagttttagctccagtgagttgtattctgttgtcttctcagctctctctccatgttgatggactccatgagacaagacaacagagagtgttaacctaggagcaaaagagtcctggctttggttctggaccgcatgtgccctttccctccgagcaagcaggcctctcccctgacccctatcacaatatgcagaccagagtggccttgaactcacaccagtccaccttccccctacctcttgagtacaccatcagaatcagttagtccctctatctttgaagtgctctctagcacgcctatcctatcatgcgtatgtgaggcatccttgctggccaggagccacctgctcagagagactaggtccattcccctggtgctgtagcctgtggaacagtaaagcctgtgggtgccaccgagactgctgggctgctgtgattagacaaggtgacttggcaccgtgtctgtgaccagtgcctattttagcaacgtggtaaatattgactctgtggtgtgaacgtggacaggagagatgactgcattaactcattcagaggggagaagttcacccacccctgataacatgagatggagttatgcaattggaagtttcccctccccaacaaatatgttatgttgtttaggagtggagagaatggaaaagaacaagagagccttccatgcacagtcagtggccggctgggtctctgattcgtttgttagttttaaaatgaatgtcacacagagaaatgatatataagcatagagagaaatcatatgcttttcccgtttgcttttttaaaattacacttatttatttgcacacatatacttgccacagtgcacgtggaggtcagaggacagcttacaggagtcagctctctccttccaccatgtccgtccttgggatagaactcgcgccctcaggtcaggcttgcccatcagcacccttgctggcagagctgctggccagccattttccaggcttttatgctgtctacaatgatcacagcatttgccacttttatttgtttttatttattttttattttttgagacagggtatcctggaactcactctatagaccaggttggcctcgaactcacagagtgagcctgcctctgcctcccgagtgttgttggaattaaaggcatgtaccaccatacctggtttatgtaatatcttctcttcttcctcctcctcctcttcttcctcctcctcctcttcctccttttaaatttatatgggtacactgtagctgtcttcagacacaccagaagagggcatctgatcccattacagatggttgtgagccatcatgtgtttgctgggaattgaactcaggacctctggaagagcagtcagtgctcttaactgctgagccatctctccatcccataatatcttttataattgaaaatgaaattgtatttttcttccaaagagtctgaaggatctttcagaatcacccaggtatctttgcatcttgcactgtgggaccacagctgtcaaaaacaaattctgtgtaacagaacccaatttcagtgtgtttacctcatcatctgtaaccataaaagtggaatgtggtaagaagaattccagtcttgtcagatttcaggattgctttctatgtcaatagtcattcagttgctttgagtacttcctggttgccaggcctgtcctccatcagggtgcagagctggggatagggcccactgagcagtggttacttgagagctagagtgggaggagccagagatggaggagggcctaggccatggaaactggagaactgaggtgagggttaggctgggagtagcattagaataattaccactgattgtgtgttagctttgttccaggggccccctgggctgttactaaccccacaggaaattggtaggataggctccagctaccttctagggaagagggtacctgggccagggcagtcagttctctaaggccatagagccagtcagcgactacatagcctttgccccttctctcaagccaggctgcctctctcatggttctcagtcttgcactagagaatctaccaaatgagtatgtacagtccctatctgggttgagttcctcctgcagagggagaggcagtcccaactgtaagacatgggtgggctaaagatatgtggcagctgaacccaggtctgggtgtgtcaaccctcagcggtgggacaaccctagtcggacagttggcttagaccgtggggctttaagaaccatgggacaaatggcctcttttggccagcatggaggtccttcatttgctgactgtttgtattggggaaggacctttgtctgggagtagggggctggagtgtgtgtgtgtggtcctgtatcaaagctctggggcgtgaggagaagttggtttgttggccttccttgtacctggtcgactaaaccaccaaaggggtcttaagctttttagttgtatcagtagagcttgtatctgagcccgaggaagtcattgactctggttccacagaacctgcctcagaggaggggactgaccctgagaaatctcctgtctgcacactgtaagtggaaagtgcttatccccagataagggcccgtcttcccagagtgcctcagagtctgttcttatcacgtaaagtcagtttccacttagttcattttcttgggaggaaggatttgtgttttggggggaggggtggcatgtttgttgtttgttttaacctaagtggctgagttgattaggacccacgagcactcataaagacggcccattccacggtcaggctattctgagctgtggttggaatgtttttggttttctggcaaagccacgtagaagtttgtaatttgatgttgggaaggtttttaagttgcaaaaggagaaaggagctgtgttgcttgcattctctctgaggctgcagcctgggtttttacctggcagtggtggttggcaggaggagcctgcctttggatagagccatagcacggatagagtttgtgcacaagcactgtctcagtcagatctttcttctgcatttcgagaagggctcagagaggctaaggtgacagtcaaacacctatagaagagcagtgtcacagtccaggcaggctttctgtcttgatcagaagtaaagcaggaagctttgcgttcattttaaggtgttggcttgctcaggtagtgggatgtgagccctctgcacacaggcaggggtgataactgggccgggctcagcaggactgacagtttggggccagggtggtgctttgccctctaagacctttatgtgccgcccgctgctgctgctgctgctgctgctgtttgttgctgcttggttttcatttgctccatgaagtggtgaggtggagagaggagtactataggtccattttacagaggaggaagatggtgtctcagaatgactcattatgtacgtgttattcataaaacaaatatgtattgtacacctgttggaggcactggggactgaggtcacagctagtgactggagcagaagggacctgaaggcaaacaagagtgaacacagtaggtacacatgctggttcagagtgaacacagcaggcacacatgctggttcgttttcttattgtcaacttgacacagcctagagccacctaggagagggagcctggtttgaggaactgctaaatcagattggcccgtggccctgtctgtaaaagactgtcttggtgatggatgtgggagattccagtccactgcgggcagcactgtttctaggcaggcagatctcagttgtatgagaaaactagaggagtgtgagccagtgagcagcctcccaccatggtttctgctttgggttctggccttgaattcctgccccgacttctctcgatgaaggactgtgatctggaaatgtaagatgaaataaaccctttcctctcccaagttggtattagtcatggtgtttatcccagcaagagaaagtaaactagaacagggtttagtgtctgctgagtgagggtcctggagatgagccatgctatgtaacttcaccgttgcatcaagactaagaagactatggccattactgcagggtgcttttgttatgatgtaaaccatgacaataataattgccagcacttattatgggtctactgtgtagacccacacgctggatattttacatgtgctatatctaataacataaccctgtgaggcagccgttgttggccttagttggcagaagagatgcaactcatgttctaagtcaccctatggttatagttggagtactattgactacaaatccagaacagtttttgctgaaccatatcacctctctttgatgatgagctttgagtaaccccatagagaacgatggatgattctagcatcttctggaagcttctagtgaaaacgggtcaggtatgacagggctcaggtatgtggattagaccatggctctggcagagaaactgagaggtttttataccctgccagttggcagcagatacctgagagagagagagagaggagggtgtgtgggggtggggtggggggagggtccatccggttatgacctttgtatctagttggtctgatatcattggcagccagattccctgggcaattgtgaaccctgaagaatccctgagcctctttccttttgctgtcttagattctcagggctgctataacaaatgatcaactgagtggcttaaatctccagaaatctatcccctcatagttatagaggtcagaactctggagtcaaggtgttgccctggctggttctccctcggtgggagcccatttccatgccttcctgactcccagagcctgacgatagtctttaatgtcccttacaccacattctccctgcgagtctgagaattctgccttctcctacctccccctgcttcactgacattgggtttaggacttacctactgctgctctgcccctgcatcctcccaggcctgatagtcacataggtcttggctccctgcggctcaccaatgggtaggccttgtagaaagcccccccacccccacccccagagccctgggattagctgctcttgcacttcaaggtggtgattcctaccttgagcacgctgcctttctcctgtgtggtactggcaggcaagtgagtatggttggcccggcagagctccaggtcagccggacggtttgtcctgccagactgacactggcacagatctctgaccacaagttggtcacctccagctccaatcctactgctttgcctatgtgtcactctgcaaaagtctgttctgttaggaccctgatcctatcctcttagggatgagacttattgtgtgcctcttgatcacctgctctatgtgcctggtaatttacctctcttccctgaactgggtcatatgttatttttatttaacggtattagcttacctaagagcccagttcctgtttctctgctgagatgtaagcttccctgcgacatcttggatgtagcttttgagaaatagctgttgccttctagggtgctaatctggcataggaaagtatttatctgtttattagtatttttattagcatatgttagccaactataacaacaggctttattatgtgaatatataatgtatttgtaaaatattcgtccttcatcaccctctcctgttccccctcacatcttctgatccccttcctgtttccacctagtccttcttctactttaaaacatgtgtgtacatatgtgtgtatgcgtgtacatatgtatgtacatttgtgtgtatgtatgtatgtatgcatgtatgtatatatgtgagacaaggtctcaatatgtaactctgtccgacttagactggctctgtagatcaggttgaccttgaactcacagaggtctgcttgcctttgcctcccaaatgcaagaattgaaggtcaacacacctggtttatttacttgcctaaggaagatattttatttccttgcatttctgttcttacattttcaggtgactttgactttctcacctgtttacttagtttctatttctttctttggaaagccagaacattgctggtaagatgctcttgaagacctccttttagcctgatcattttgtgattattctaacagccttaggatgtccgaaggctcaaggcctcaaccaacgtgaatgttttccccatgaccacaggagggtcactgatagtggctccccaactctggtcttgtgttcactggtttcatgtcaactcaaaagaagctatagttatctgacaggaggggtcctcggttgagaaaatgccttcgaaaaaccaaaagagagagagagagagagagagagagagagagagagagagagaatatgcctttataatatcaagctgtaagcaagcctgtagggcctttcttaattagtgatagtgtaggagggcccagcccgttctaggtggtgccatccttgggctggtggtcctgggatctataaaaaagcaggctgagcaagccatgagtagcaagctagtaagcagcccgtttcatgggctgtctgcatcagctcctgcctccaagtttcagttctgtttgagttcctgccttaactgcttttgatgctgaactcctatatagaagtgtcagtgaaataaaccgtttcctctctaagttgcttttagtcatggtttttatcacagcaatagaaaccctaaccaaaacaaaacaaaacaaaacaaaacaaaaaaacaacagcaacaaaacaaaaaaacaaaacaaaacaaaacaaaaccctaacaaagaccagccttaaaagtaataattcctctataagtagtattcctaaaaagcaaactgcaggaaggttttctgttagagcagttttcatgccagcctcacctccatggaccaggctctctggggcacattaaggccatcttagaggctggttagaaaaaagacaagttaaaacaaacaaaccaatcaattgaattggtgtaacctccacaggaactacgtgcacagccatgcctgctagacctggcccctcagccacacccgaagaaggtcgggccttcctcatttgctcagtgaaccaactaatttgtgctgaagcagaggatgtcaatctgctgacaatgccttcatgacttattcagcgagactggaccactttgaaggattgggcccttgttgcctgtggctcccatgtaatatgcagccagctgtgctttcccggaatccataatttcttaaattcagcttgctttcccagtgaccaggaaacctataactctgctcacttaatagcacccttttttcttcggtttgtggtccttttagaagaaatatatccttatctgggcctccgtgctttttctggcagtgtgagagttgggctagatgctgtctcaggattttctagcccttagcttcttttagtctttgtcaatacattttattgtgtgtgtttgtcttgaagaagtgggcgggcatatttggtgttggggattaaacccagccaagggacaagcgcatgctctaacattagctataccctcccccagacccatggtctttacttatttttaaaattaaaatatagttatatcattctcctttcctcttcctccctccagccccttccatgttcccgctactccatttcaaattggtggcctcttgggtgtgtgtgtgtgtatgtgtgtgtgtgtgtgtctgtgtgatatttcagagctgactactttgtgttggagaacccattagtggacttatccctgagcgagactgattctccctctcttagcagtcattagctgcagtagttgttttcctagggttgggaccccagtagattcccccttccatggtagcatgtgtgtcagtattgtcattgttccggtcttgtttaggtaaccacattgttgaggaatcatgggtgagacctccttgccatttctaggagacatagtctcacagcagactctgtggtcctctggctcttagaatctttccattccctctacttggatgtttcctgagcctaggcacaggagttatgatgtagatgtatccatcagggctgggcaccccacggtcagttgatctctgtattatgacttgtggtttctgggatggtcttcatttactgcaaagatagaaagcttttatacagagtgagaactgcatttacctgtggatagagggataagttttagaatgtagtggagaaactgcattggtgcagtggtggtgcacgcctttaatcccagcacttgggaggcagaggcaggtggatttatgagctcaaagccagcctggtctacagagtgagttccaggacagccagaggaacacagagaaaccctgtctcagaaaacaaaaacaacaacaaaaaagaatgcagtgggaattaggctcggctagtaaggtggcagtagtaggtcatactctaagtctgtggactcgatagcgatagctccaggtttctagtaccaatcttgactgagcaggccttccatagggttctttactttcttacattcccctagctgccccctcgccctttactttattgcaatactgagtgttgaacctaggtccttatgaatgctagataagttcttcaccactgagctatatttccaggcctcttcacacctttactcattattatttatgtgtgcatatgacatgtgagtatgtacatagtcttgtgtgtgtgtgcacacacatacccaagtatgtacatgtgtatagagactacaagtcaaagtcaggcgtcttcctctatcactttatttttaagagagatttcttcttattttatatgaatgtatgttttgcttgcatgtatgtgtaccctgtgcctgcagaggccagtagagggcatcaggtctactgggactagagttacagaaagctgtgagttgctgggaaccaaacccaaactcttctgcaagagcagtaagttctcttagccactgcgacgtttctccaaacccttcgttttagttttttagacaaggcgccttactgaacctgaagcttgctgttttggcttgactgggtagtcaataaactcctgggtctgcctgtctctagtcccctaacccccacgctagtgttacagatgtatggtgctatgcctgggtcttttgtgggtcctggggattcaaacctggtcattatgcttgcatgacaagcgctttatccactagtggctcctcacccctgttttcttattcggaggcatttacagttacttagatttagccctcctgtctttgcggcttttgcttccataggatggcacagatggaatcagaaacatctcagctgcttggaagcctttgggctggtttcacttttctgcccagctactaaatcttaaaggcgccttgggtagcttaagtggctagctcttgggctctttagataacccagattcccttaatgccttatgactctcagtctcccagccttaaatatcagcaacaaaaagcaaagtcttagccctgctgtaaatgtattggcagatcccctccccccatcccagcaggaagagagagttagagccagctctctttgcaggacatttgaaatgttattgtgactgctgttgcgccctggctgcagagtgaatctgctttttttttttttttttttttttttttttttttttttttttttgtgaatcctctcttaatgacttggttgccaccttgtggattgtctggggcccaggtgtggtagggatctcagcctccttgtggggaccacactgacagggacagtttgtgttctctctctctctctctctttctctgttgtctgtttctctgggtatgttatgtgtatgtatgtgtagtttgcatgtgttgatatgtgtggaggtgcttatgcctatgtgtgcatgttcaaagacatgaggttgacattagattatcttttttttttttttgagacagggtctctcgttggacccagagcttaccagttgcccagactggctggctagtgagcccctgggacattcctgtctttgcctcctagtgctggggttacagaaggggccagcatgagtggctttttttgtggctgctggggatttgaaccaagatcctcatgctcagactgcaagtgccttagctgcagagccacgcccctcatgtctaactctgttcctgtagtttcttatgttagacactgtgatcacagtgacggtagacttgatatccattcttcccagttagagtataagtgttttccctgtcatttcctctataaaaattatttaatgttatgcaatgctatagagagaatttttaaacatcgtcatctttaactcttttttctgacacagggtctcattctgtagctcagattggtgtcaaactcacaccgagcctcctgcttctgcttccatgcctagctttgcttaacttttatagttaaaaactagttaatgaaacaatagtacatctaaaagttctgcctcatgtcccctgaacctctcgagtacctttcctcagaaatcatcatggtttcttcggtagcctacacaaatcatctatgcttaagcgaccatacatatgcatgttctgtatttcagaaaacacagatggggctatggggccagattatatatatatgtatatatatatatatatatattttttttttttgagagagggtttctctgtatagctctggctatcactctgtagaccaggctggcctcgaacttagaaacccatctgcctctgcctcccaagtgctgggattaaaggcatgcaccaccactgcctggccttgtttcacaattttattttatttttaaaaaagtttattcattggccaggtatgacggcacatgcttttaatcctagcacttggtagtcagaagtaggtagatttctgcatttgaggccagccaggtcaatgtagcaagttccaggctactagctaaagcgatacataatgagaccctgcctttaaataaaagattgatttgtttttactccatgtgtatatgtgtttgcttgtatgtttgtattgtgtaccacgtgtatacctgttgtccatggaggctagatgagggtgcaggatctcctggagcaggagttataaatggttgtaaccatgatgtgaattctggaactgaacctgggtcctctgtaagagtgtcaagtgctcttcactgcagagccatctcttcagcctcaacaaccatctatccatctatcatctagctgtctgtctttctatctatctatctatctatctatctatctatctannnnnnnnnnnnnnnnnnnntttctttctttctttctttctttctttctttctttctttctttctttctttctttctttctttctttcagacagattcttactatttagttctgactgtcctggaactcactctgtataccaggatgacctcatactcagaagatccacctgtctgattccctagtgctggattaaagtatgcaccactatgcccagctttgattttttttttttaataatacactcttcagtgtcagaatgcatttgtgtgtgtgtgtgtgtatgtgatttttttaaaacagctgcgtagggcatctgttgaaagacttttagattgttacagaaatgaacaattttgtatatatgccgtgtacctcacctattatctaccaagtatggttccagatggtaacttaagagtaagcaagacagccaagtggtggtggcggcgcacgcctttaatcccagcactcgggaggcagaggcaggtggatttctgagttcgaggccagcctggtctacagagtgagttccaggacggccagggctatacagagaaaccctgtctcaaaaaacaaaacaaaacaaaacaaacaaacaaaaaagagtaagcaagacaaaccctgtgttaccttcttatcagtgcacttgttgcatacatcctggaaagtgacattttagccagttcatgtgtctcacttatttagtgatgagacacaaaaaaagacctacagtatttccctgagtgtgtgtacggttaatgagtggatctttggagttttctctcctgttgaccctggttacagtatgattatcctctccccaactgtccagtggtgaacgtgtacagaggttttccacggcatccgcccagtgctggaattatagtgctgatagctcccacagtgctgtgtgtttgcaagtgcttatgaagttccttacaggacagctttgcagtttgtccacgtggctatgtgaagaaatgagaaaggttggtttgcagtttataaggggaactggatcatcaagaggtcaaagtcattgtggctagagagaacagactgtacatatgtagtgcctcacatatgtagtggatggaagagctaggccaagaactcaacaagaaaggctctccttcgcgggacttattccaaaagccctcagcatgtgtgccgtttagatgaaagcatctcctgatggaacgggagttcatttatctctgtcacttgctgtaggaacagagagttcttcaagacttcttattagtagctcatgaattcatttagaattatactgtgaagtgtgctaggcaagactgcttatggagatttacagttaatagcagaatgattaaaataattgaaaggtaggttagttcttggttcatgctagctacacttcaagtgtgcagtagacttggtgactggttattgccgccttgggcagagtccccatccacaactgcagtgtctgcagggctatagaattttttttctttcacaaacactccgatgtatatgttttaacattttgttttgttttcttttgctttttgaagcagggtcttgctatgtagcccaggcagacctcaaacccatggcatccgcccagtgctgggattataggcatgtgccaccatgcccagcttagcaggccatctttactctgtaatttttggggaggtgaggctcacaggcagggtgggtgacattaagcatctaggagtgcaaagccccagttaaaaccagtcctctgcctgtgttttcttcacggccatctgcctcgcttaccctgagaatgcttttatgcatggtggtatcagttaccttactctgcccactgcctcatatagagggtattagactcagtgcccactgcaagcaggcccttctatcagtagctttaggctttcataacccaagaccaagagacatagtgtgagttgtccatatgaggctactgggccccacagattctccccagggactgcagtccttgctctgaacccatctctcatgcagtcaggacatgtatcaacaatctacctgtgagattgtgggaagctgagctgtcactctgcatgcgacccaccccttcttgcaggtcctgaggaatgaaatgctggcagactggccctgtgttttcacaaggggaggtaggtagataaatcagagatagaagcttactgtgaagactcagcacttaaatgtgaactctgagagcagagagcagattcactgctcaagatggcctttgggggccagcgggtgatgagtaccatttgggactgagacaaacagggagccccaccacactgagagggctgaggaagtgtgtgcttggttagcctcatggccctgaaatctcattaggaaaattgtcggagcactgggtcgtcagtaacttgtaattattaccgtttccttgtctttgggaattgtggaaagcagaaagaaaagagttagaaatcgcacccacaggcagtctgcagagttgaagaaactcctccgtccactttcaaaagagagtcctactgactggttctcaaactagcatggacaacaggaaccacccaagcttctgatttagtgggtcagtgctttttatttctaacatatgctggtgctgatggccctggactgggcaccacactttgagagccactggtttctaccatctggtaccagggagaactcatttcaggtcccagtgacataagtgtgatgctctgtgcccctttccaaaccttgctacttatgttcccatgtgttggctgtctctgctcctgagaagacactttaggcatagctttgtaagatttatttttaatttttaattgtgtgtgtgtaagggtatgtataaaatgtatttctgtgtgtatgtatgtacacatgaatgcatgtacccttggagtccagaagaaggtgtcaggtcctctaggggaagtatttcaggcatctggcacgggtgctagggactgaagtctggtcctttgcaagagcagtgtatgttcttaaccactgagccatctctccagtcctgacttctgccatttctcatcataactgtttcaaatagttttcagtcctaactgttactaagtcttgagttttgcaagatgccttcttaaatcgggtgtggtagatcacagatgaggtgttagacattgcccttcccttaagtagattaatctagtttgggggtgagggacagataaccagcaaagtacacaaaaaaggaaagggtgtgaaaagatgattaggagctgaaacttgaacttaagcaggaggagggcttgggtaagcagaagttctcctaggatagggaatcaggactagagaagccctgaggtggaaatgagtgtgtcgtgctgtgccttgtgggaagccacagtgctattgggcaagtggattggggccaggtgatgagaggcgctggggcccagccaaggagctcaggcctgatgggaaggggagagtggtattgagaagaactgatggtgccagtgttgtagggaagtgggctgggaatgtaggagagggctgggcctgggctgggggtgggggataggagtgctgatccaggaggttgtgccaagtgcattggtttacacgtaatgctccaggaggagaccagagacgaagagagtctagcatagttccatcagtaacatcactgaggatggagaggtagctcagtggtttagagcacttactgctcttgcagaggacccgagttgagttcccagcaactgtatcaggcagtttataactgcacgaatctccagttccaggcatcctatggcctcttctggactctatgagaacctgcatgtaaactcactcacacatacacacacacacacacacactaatacacacactcacatacacacacacattcacatacatatacacacactcacacacacatacacatactaatacactcacacacatacacatactaatacactcacacacatacacatactaatacactcacacacacatacacacactactcacacatgcacatgcacatacatgcactcacacacacatgcacacacatacacacacactcacacatatacacttatacccacacaccacatacacacacatgcacacacacacacacactcattaattaagaattaactagttaattaaatgtaaaaaaatacaaactacaaacctaatatgcaccaaatactgttaggagccaggagtacaaggaaagagagagagagagagagagagagagagagagagagagagagagagagagagagaaagagaggctctttccaagatgctctaagtcaaggaagccgaggaatgctgtatggcaccagggcaccagagaacttgagtaaataaatcacaccatggtggcgtccatgggagataagcacagaaggggaacccatgtcagaaacacaaaagatattttgaggggcagctcagtggtgactgaacaatgctgcccaacttcctgtagacgaagaagaggtttgtatactggaagtggggggctgacgctttccttctctgtccacagcaaggcccctggtgactctgaagcacagaaccaattaatataagtcatttataagtgattattattctcttataaacatgtgccctttacatttattttagatttttttttatgtgtatgagtgttttgcttgccagtatgtatgctgtatgtctagacacctgtgtgtctggtgccctcagagcttggaattgggaatcagatccttggaactggagttaccgatggttgagtagccatgtgagtcctgggaaacaaacccaggtcctctacaagagcaaccagtatgcttatccactgagccatctctctatccctaacatgtccttcttaaaaaacatactacattgctgagagtggtggtacatgcctttaatcccagcacttaggaggcagaggcagttggactatttctgtgagactgaggccagactgatttacagagtgagttctaggacagtcaaggctacacaaagagaccctgtctcgaataaaacaacaaaaaaattacatttgtgtgtgtgtgtgtgtatgtatgcatgtatgtatgtgtgtgtgtgtgtgtgtgtgtatgtgtgtgtgcatatgctggcacatgtggatgtcagaggacaacttgtgggagtcatctctcttttttcttgccaggtcctagggaccaaactcaggtcatcgggtttggtaggaagcctttagccatccagccatctcactagcacagacatgccctccttggtgttcatcatttgtatatctatataatcatccattgcatccagaccgtctaattgtctggttcttactaagagatgcctgacttatttctagctctccattttctatggagctgggtcctgctgaattctctccagaggctaaattcctgaagaacagtgcacttagataacctgattttaattccagatgtgacaaactgtctcagacaacacaagtctttaagcctcaggtttttagtctgtgcaacactggtgacaccagctatgcagttagaaatcgaaaactgtacactatctaccttccagtcatctagatggaagccagcaaaggtctggtggtcccagcatgacggagtaagaatgggcctctctgttgtagctgtttttgcccatgtagttggtaggtttttttttttttttttttttttttttgagtgagatttgggccctctttctattcatttggtttcctggaactgggctacctgtgggtgggagggaagaataatctccacttccctcttggctacctgctttcaatgatgtaatgtgtacttggccttctcctcttgtagctgccagcccttccccaagtaggcgccaagtcagagttgtatgaaacatgaagccgggtgggaaaggagagtgaactaggctgtctgacaggggtggggggtggggtgggaggctgcctttggtcctagatctgccgctgcctgggcaagaggcaagttcttcactttacccacacctcagtttccccagctgtgaatggagggtgatgttgaaaaattccctttattcctgtggtttacaaaccttgtgtcgtgggggattttaggtgacaactcttggttggctctgccgtgctctgtagacatgaggcaggctgattacttttctagaggcatttagttttcatgtgcattggtgtttagcctccgtgtatgtctgtatgaaagtgttgaatcccttggatctggagttacagacacttgtgggctgttgtgtggatgctggggattatttagtgtggaatctgggtcctcagaagagtagctagtgctcttaaccggtcatttctccagcccttctgtggggatcttaataaagatactgaggctgtcttccccagctagagacggatgttagctcttcttggctgagacaaatgccagagagaaacaacatgaagggggagagattttgagcatggcatcatggtgccaggggcatgtggcagaggagctgcccactttgtagcatccaggaaggcagggaaaggctggtgcaagattccatcctcaggaacatatcttcagcagcctatttgtaacagcaaggccttgtttccagaaactactatcaccttcagtcatgccaccaaattatgaatccttcagtggatggacgctttgattaggtcagagccaccgtgatccagtcacttctaaatgactggatccaccacacagggaccaagctgccaatcacaagtctggtggcattcaaactaggtatggctcattcagactatgacttgccaagagctgacatacaccatatagaccaggtcatgatagaaggaggaagaggccatgttggcttctggtttctaactggtctgtttggaagcctgcaaggcccaatgtttggtgcggattctttggttcctgacttaaaaagaaattgtatttatgcctatgtatatgagtgtatgtaggcatgtgtgcaggttcccatagaagccagagagggggtttgatctcttgtacctggggttacaggtggttgtggactgcctaatgtggatgctgggaatcaaactccaggccactggaagagcagcaagtgtgcgattttttttgttttgtttttcgagacagggtttctctgtgtagccctggctgtcctggaactcactttgtagaccaggctggcctcgaactcagaaatccacttgcctctgcctcccgagtgctggaattaaaagtgtgtgccaccatgcccagccctgcaagtgtgctcttaagagacgaaccatctcccttgcctcctttttaataaactgacaaaagttacatgtggcagacctggcacgggtacatagtggtaggtgctgctgtgatggcctgaagtcaagctggcctggggagactgtacattagagtgacaggctggtacctaaagtcttgggggtaataggagttggctcaggaagagccatagcagctggctggttctacccaggccttagagggtatttttgttttgctttgttatgttttgtttttttgagacaaagccccaggatatatctgtggatagcccagaactggctgtgtagaccaggatggtcttgaactcacagagatcagcctgcctctgccttgcagtattgggactaaaggtgtattccaccatatctggctgtctcaatagttttgttgtggaaattggtcccactcctggatcaaatgctaatgattcatttctcttcccctgtgggccagagagtgtctcagtttttcccttcctacctccagccatctgtctcgcagtttgctattggcctcaggtagaagagactctgggcagacagcctcattcctgtctcagaaggtcacatagccatcctctttccttctgagttgctgtaggcatcccttcccactccttctccagtagctgtactagttagcattccttctaggctccactcacccaggtagacctggcttgctataaaaggggctgtttggcccctcctccctctctttgtcccttctctctctgactttcttgtctccttgatccctttcttcctctccttcctccttccnnnnnnnnnnnnnnnnnnnntctctactcccctctcattttcttccctgccctcagtaaactccattttacactctacccatgtgtggctggtacctcagcgggaagggattcctcagtatgggccgccaaggcatctctctcaccttaccatacctggctctatcaaacacatcctggttctttttataagacacaacagtactttttcctgagctagtatggagttcctgggctagcctgtgggatttccgtcaaagaagggtaagtgcctgctctgctttctactggctgtttacttccctgtctgaagcatgtggctttacacactgagcctgaaatcagataggatggtttgccatgaaaggatggtgtgtccttcctgaggtgagcttggctttcctgagaccacactgcagaagacccccatagggtggattgggggttccatggcagcatgccattgtcctgtcagaaacatggtcttgtcctcctaaggtcaggtcttaggccgcagtgacggatgcagcacgaagcacagctgcagcctggggatccatttccctgtttgggaatgagggcttctctcccagccaccttccttactcggtgtaagagagctctgaaagcttctgaaaagtctcacctcgaaggcgacctggcagtaggaagagttaatgttttaaagagaagacaggcgggcacacattgcttttggcactgaagccaagatctgaggtcaaagaacaaaccctggctgctgaaagggagagcgaggcttagagttactagatccttggcctgtgtcctgagtgctgcatgcaggtctgcacgtgcccgctgtgcttgtgtgtgttcttcagagtctgtgcaaaagcccggctccaatacaaagggcccagaacgtagatgtgatgaaagagtcccttccctcagccagccatcagagtctgtggagactagcaaagaaccccacttccacctgttgaaaatatggggagggggtggggtgggaggaatctttggaagcctgaattccattaggagcctaaactctcagaactcagtactctgcccatcagatgttagttgctgtcttattttttgagacaaggtctctcattgagcctggaacttgctgactcggctagatcgaatggccatcaaaccccagtgatcttccagtttaggattacggcatccactgctgtgcctgctccttacaggtgttagggatccaaactcaggccctcgtgcatatgcacttcactgactgagccatctctcaagccctcgtcacccttaaactaaggcctgggggatatggtcggttggctcttgccttctcagcaggctaaacccaggttctagactccattctctattagcatagaagcagtaggtttgtgatctggaaacgtcagacacttcataggacgtttgcttatcttgcagtctccaaaggcctctgccaaggctgcaccgtggctatgatggagctcattgcttataaaccttcctgtggatggagattagtttcacaccctttggagtgttgctggctttgctcagtcactggagagagagtccaagatattctccagacctgagttgccctttaggagtaaaaaaagcagggcctttaccttctcacctggcaacctctcttccagggctggctcctccctacttcttatcatgtctccccttccttgcccagcctccagatcccataattcctgttgtggggagttaatgaagaactcgtttatgattcagctccattcataattctctctctttctctctctcctagtttcatccattaggtaattctgtcaaaaaaaaaatcaagactgtaaggaatggcatttgaattttttaaaaaataattttcgttgatttcaaggcagggtctcataagcccaggttagtatcaaactcaccatgaagctgagggaaatcttatatttctgagcctcttgcttttaccttctgagtaatgggtgtatgagtatgtactacacccagcagaaaggacacttactttcttacttatttctttgttcactaactttatttatttgtttgtttgtctattatttatttattttttgagacagggactcatatataggcctggctggcctggaactccctatgtagaccagactgggcttgaactcacagaggtctgcctgcctctgcctcctgagtgctggcactaaagctgggatgacactttagagattaaatgatgggcatgggttcatttgagggacagaggtttgtcacatgtagaagtaagaggacaatttgttgaagtctgttctctccttataccatttgggtcctggagactgaattcaggtcaccaggcttggctgcaagcctcctctttacccactgagccatcttgctggcactcttccagttagctatatgtctatgcatgctgttctgcatcaggtcttttattaaaatgatctcttttttgttatcatgttggcttcacatcagactcacataggcaggcatcatataaaagtggaaactgaggctggaagtttaggatatgctctgatcacctttcccattagtcatttatctgttcatctattaattcattaatttaaaacatttactgatcatggtgtgcaaattgctgtggaaaacccttcaaaacctgccgccttcagaagcatttagtcacagcacatgtacaaggcattactcccttgagaaagctgactcctatttccaagaaagtccaatcaagggcgtagctgatgaactttgccactagaagacgttaagcacttcctatcctttcctgtaaacagcagctagcccccgttgagctgtgatatttccactctgtgacatgaaattaccatgtcgaggctggtactcgaaggctcacgaccttggctcccctggaacaggactcagcagccccatcctcagcagccttccagggcttctgggtgtgcagctagagagcttaggtgaagccactgaatggtggtttcagtttttctcacccacaggagtcattcaacagctacatattaatttgtttgctcatgatactggctttaccagggcaggagagcagagttttcagcaagagggtccaaactgaaggggttaggagtgaatctgagggtacccaggttttcactaggcagtgggttcaggcctccctgtttgtcaaaactgcttctcatgatttaatgtgcacacagaccacagaagtccgtgcagattctaactcagcaggggtgggcaaggcctcaggctctgtgcctttctgagaagctcccaggtgaacactgtgttacatgaccaaggtgaacagtgctctcagggtgccagtgtgcggagctgggggaggagaggaaatgcagcgcagggccaagcacagtactgacctatttgagccctaacacgaggttttctgtaaggtccaggcccgcatccacatctggtgggaagaggatgctgtcttcccagcctgggcctttgctctgaattttaatgaggctgaagcacactatgagtgtttgagccccatctggggttgggaggaggaaggaaggaacttgcaccatcaatatggtgactgtcctcttgagaggcatgccgcatttccccatggcccctcagtgatctagagataacagaacaggtcagttcctcctgttagtatctgttcgtgcggggcagcagagtgcaggcagactggatggttttggggtttgggtacatttttgtttgctgttttcagagggtggaagtgaggcgtgttgacttataacttttgaagaagaagatgcactatcttcttcaaagagaatgtaagctcagccccttcctgctatcatcttcttcttcttcttcttcttcttcttcttcttcttcttcttcttcttcttcttcttcttcttcttcttcttcttcttcttcttcttcttcttcttcttcttctttttgagacagggtttctctgtatagccttggctgtcctggaattcactttgtagaccaggctggcctcgaactcagaaatccacttgcctctgcctcccgagtgctgggattaaaggtgtgtgccaccacgcccggctcctgctatgttcttccaacatgttttgtctcacttatgcccagcttgctggtttctggatacccacgtgctgctctctagcacctaaggacccacatggagcatggatagttacagtgaatttgaacccatcctgggctacatagtgagactgtatttgggtaataacagtaatgaaaagtgaggcatggcggtgaatgtctgtcatcctggacctcagagcctaaagcagcttatataaaggaagtcaaagatgccttggctgaaagggagagtcacacagcacccatattcccacccctgtgaggctttcagattcttttctctcccctgtaccatatactcccctgccaccaacagtagtcttcctttctcccacataaaagttcctttaacaagctaggtgtggtggcacatgcctttagtgtcactgaacacggaggcaggtggtcactatgagattgagaccagcctggtctatatagcaagttccaggctagccacttacacagtgggaaccacccccccaaacacacacacacacagacacacacacagacaccacacacacacacacacacacacacacacacacacacacacacactgcacacacagagacacactcctttagtttactagcttagctgagttctaccttttggtaggaatggatgcaattaattgatattaatggatacataactactaacccaaatgttagttatttgtggttttaggagttttaacactggatcttcctctcctttggtccctccagttcagaacctgccacttagggaacctctgagcctttctagaactctctctttgtagatgatgcccccagaaggtgtagggaaacctctggggtcagtgctaggtaggtcctcctgcagtcgatgtgtctgtctggggatggggaagagattccttgctgtctatcacaggtgtccactgaacacaggaggctatggtagaagggaggcccaccgtagtactgtagttttcatactgccctgtggtatagacttaggggctattccgtatatatggctgtgtgcatgtgtgcatgtgtggatgcatgcatatgcacatagtggtcaagtgactatgtttttccctttcaaccaaagcatctttactttgatctattttgtatattctgctttgaactccaagttttgggatgctaggcatgcaccaccatgcctggctatctatctatctatctatctatctatctatctatctatctatctatctatagataggatctcactatgtaactcaagatggattcaaattcatagtaatcatctatgttccacatggaacagacccttatttgcttgtttgtttgtttgtttgcttgcttgcttccttgcaagggtctcatagaccacaggctggctttgaactcaccatgtagacaaagtttggttttaacttctgatattcctacatttccctcctaagttctgggattatatgcatgtgccaccatgcccagcctgcagcacgcattgttacaatgtgcccataatggctttctttcagaaattatgactatgccatgataacctgcttagaaaagctggcacccttccttctcttaactccctttgttgtcttggtggcttagatcttgggtctgtttccttccacactggtgttcctgaggttctcctaaggaatgtgttaatattcaggtgtccaggccttatcactgtttgccaaatcaaaatccttagagggtttatagttttttaaacaaaataagtgtaggggctcattatgtagcccaggcttgcctagaacctaaaatgatcctgcctcagcctcccgagtggtaggaatgcaggtgcacgccatcatccctggcttctgctttcaatctttatttttctgttccagtttgaatttgactgtgtgcttcctgttatgtttgctctgtatcctgagcacacatgaccaggaggaactttaaggacgacttacactgctatcgacatggggtccactagctcaggaagcaagcatggggagagacagtgactgtgcacatggctaaagtcagccccggaggcactgtaaggcaaggtcactgaaacaggggctaggggtgtagcttagctggtagaacacttgccttgcatgaacgaagccctgaattagatagctactactgaataaactgggtacggtgacacatgcctgtgaccccagcatttgggaggtgggagcaggaagatgagaagtgccaggccattctacagtccatagcaagttggaggctagcctggtctacatgagatctcatctcttagaatgacaacatgattcaatcaattacagtaatcccaatggccgtgctgactgactgcagagtggaggatgtttcccacaggaattcaatggacccagctcacttcttctcccaagccattcctcaaccccacccttacatggattggattgggtagatccacacccagacaccccatgcccataagcctagagggcaaggtggaggtagaaggacctggccccagtcctctcagaagcctgcagatttctctccacactcccttcccacacagccctgattgcccagattgccagcagcagccagagcctctgccaggcaggcagctcaaagcggctgtgccatctcctctgtcatcaccatggccaattagcggctctcgggcgcctctggggctgccactcccgcctggctcctctaagtgtgctcggagtcggtctgagctttggcactgccttcaagcctaactgtccgggcacgggatgggtacatgtcacacccaataatattttccctctctacctaaactgagacctaagtgagccctgacctttaatgttgccttttgtctcttgctgagcctcaccccctatcccaccccaacctcctctttgccacagttgctttcaggtggctgaggtaacccatgttggtatcacaaagtttaataagccgtcctcccagggtatggagtgctcagatgtggaatggactctgaggaaaactgcacaatgattctgtttttttagctggtattagcgtgctggatgaatatcttggtcctttggtagggatggcaaccccctcaaaagttgtcatgaagattaaatgtgttgatctccgtgagtgccctgggcagcacctgacacaaggaaatgttaagaatcataaacgcctccagcttcagtttctcttcctatgtaatgaaaagaacacatttaccttgtagaacagaggaggaaatttaatactagaattgcatgaatgtaaagtggggcacagcagctcatgcctgtaaccccagcacttgggagctagagagaggagcgtcaggagagcactgttatcctcagatacatgagtaagtttgaggctaacctgggctatgtgagaccctatctcaattaaaaaaaaatcctaaatctttagatggattacgtaagtaaatagatatataagagtagtgcatgccagtcctggggtctagaagacctatggtgcttggggaatggtttccgattgataaagataaatttcatggctcagagtagacatttctatcatgattacaggctgccctttcctacccgtcagtatgccaggaaaattccccctaccctcagtgagaaagactcaagcacagtcagttcctggctgtcacacaagcccaggctggccagacaggcacattccagccttatctcgagcattagcaggtctaggcttccctcaggagcagagggaggagccaggtttcgtctcaacatgtctggacccaggacagccaaaggacatactgtctcccttgggccatctgctacgatcttttctccaattcagactttctgccagaggctaggcccgcctgtcattgctctgggtgatggacctgcctcagtggagacccagggacatttcttggaagcccatccagaagtagccaagattactgtgaccacgaggacaacgggtggtttctctgtcagctctgcatcctccacacagcagctcttgctgttcaggaacattctgaggaccagcatgctcctgctatagctgtcaaatcccgaatgaccaatgtggctatcgttcatcattgtactttagcatctataatgcctactgaatatcagctcaatggatggtcttgagcgtgggtactgggatgcaatgatgaacaaaggcctatcccttatccacagggaaccattaaatactggaagagagactttccctgctccttccctcagaaggcctccctttgctgaacttactgtcctttgtcctcgaggacagggttgctgtcttcctaccttaggcacacaatgggtactccatacgtacaaagctagctcaggagcatggtcccaacgctttgccagacacctacctcatcactctcaggctattgtctgctttggaaggaattttcccatggacctcagataccagaaagaatcaaagcacttcagtcaaaatcccctttctctctgcagcccagggattctctgagcaagatggagctgaggttaggtcttgccatgggctagatgtcagaccaagcctttccaggcacaaatggagggctagcaattctgcaaccatgttaaaaccttttttttttttttttttttttttttgtgcttaggaaacatcccctctcccacttcaaataaatgtttcaagtcaggtgtggtggaacacacctgtaaaaccagcagaggtttaggcagaaagattgccatggctttgagactagcctgggctacatggcatgaccctgtttttgtttttgttttttgttttttggttttttttaagtagaaccagtacaaacaaaccaacaacccgaaaggacattgtacaatctgatatataagtcagggatggaggtgctttatatccaaaaagggagtcaggttggtcgtaggccattgggctttgctggaagacctgtgcagatgccagttctgccttcatttggccttcacaatgccaggagcagtggctttgaggaaaggactccgtgtgagtgcccaaagacctagtgcccccttaaagacggaagcctggaacgattctgccatcagaaagtaagggaatatttgagcacatttgataggtctagtatcagtagcatgtaaagagctttttacaaataataagaaaaacacaaggagcccaatagaacaattagagaaatgttcaccgtctattgttaatagacaataaggctgagcatgatggcacatactagaatctcagccgaccttggctgagtagccagttcctattgccaacaacagcagcaacacacacacacacacacacacacacacacacacacacacacacacacacacacacacaagagtaaaaaaaaaagatgtgatgttgtatatatagcatcatcttccttctaacacgagctggcttagtggggcaggtctgcagttctgacttctcaggaggggatcgaatgcctgactgatgagtttatgagaccatctcaagataaaaagagggaaaagggctggctggggacatagctcagcgaagggcttccctagcatatgtgaaaccttaacttcaacccccagtatcaagaaaaagggagacggaagaggaagaagagatagaggaggaggacgatgacgatgaagacgatgactagagggtattcattaaaaacagaaattctaagagagcagatccccaaatgatagcacctcacctcaggaagataagatgaagggaaatatttagcttcctcctcctcttcctcctcctcctctgctccctcttcccctccccctcatcctctcccctttcctcttcttcctcctcctctctgtcctccttctcttcatctcccccctccttctctcccttctgctctccatatttctcttctacttcatctccctcctcctcctcttttaaaataatgaacatgtggaccagcaagcaggctcagcagacagagagtcacttggtaccaagcttggtgccttaaatttgattcctggagcccacaaggagaagtgactgctgccaactggcctctgacttccacatacacagagacacactaatgagtataattctattttaaagataataaacttttatgaatttgaaaaatcatgaacattttttaaaagacttatttatttattatatgtaagtacactgtagctgtcctcagacactccagaagagggagtcagatctccttacggatggttgtgagccatcatgtggttgctgggatttgaactccagaccttcggaagagcagtcggatgctcttacccactgagccatctcacattttctttttttaaggaaatctgatagtgaagtgccatgtaacatcatgggctgtcttcggggagcaaggctgccaaccacacttcctgcctctttagtgtatagtaggcatttttctactagctggctacatagccttcttgtaccctgtgctgggatgaaccctatgaaatggcagtccttactctcttggcttctcagagcttcttgagagttgagagctaggatgaatgtccaggtcatttgctatcacagtatttctgttgttagattgctccatgtttgcctggactcatcttcatagatggcacatggacatctcagagtgtctgagatctgctctgctgacctgaagctctggtcatctgcctcttgaaattgagttggcttacatgatcagactcagcattctatgcgccatgattgaaacttagaagcagcttgtgcatctttggattgtgtttcttactgatctatacatgtgatgtagtgacttgaatcagagcatcctaacaggataaaatgggatgaggatagggacccaaacgagatatttggtccagcatgttattttccgatgacagatctaaagccccaagagagcttggaattttgtgtttgagccaagatgcctaaccctgtctttgttcacatgtgaccttcacagtacttggttttgagaagaggtgactgccaaataatgggcatggatgagaagaggtgactgccaaataatgggtgtggaagcaaactgaatagaaagttcacagaaattctgggaaatagcacctgcccttaggttgctaacagttgagtttcaaccagaattccttagccattaacccggcacacgagggcagtggagaggagagaatggtaagctgcaggtagcctgtgctacaggacaagaatgtcttgggcattagcattcagggtacaggactgggatataggtggatgtgcttgcaccagtgataaaaactaaaaccaaccaaacaaccaaaatctccagaagaaagtgggttgtgatctgagcacaccgacacacacaggcacatctacccagggtgagttttgggagtgtagaaccatttgtctctaagtagtttctttacttgcccaatgtttgcctaagcttgttactaattttttttttaagtcattaaaatgtgaacatgttactcagagaagggattaggttaactctttggagtctcctgtcaaattatatgaagtgtggaagaattgaagggttttccagagagcctgcctgcatgagaggggagggtgtgcaggttgggagggaggtattcaagaagataaactgagtgtgttagcatttaaggagggatccacagcaacaggcaaagtatcctggattttccatcttttctttgaagtcttttgctttctttaaatctgttgctgttgttgtttatggggtgggctatagccatagcacacacgtgggtgtcagcagacaactgtgcagcagttggttctcctccttccaacgaggagattctggggttcaaactcaggtcaccatgtacactgagtcagcccatcggacctctgtcctttccatcctggacagcccgagctcacatttaaagatctattctgtatggactagtctgtaaactctaagggaactttgagtgagggctgagctaagttttcaatgaaaatatctccctatatagtcaagtctaatgtgaactgggcctattttattttaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgtgctttaggaattttttttttctaacaggtaaaaaaaaaaaaaaaaaaaaaaaaaaaagacagaggaaggaaatttgtctgtagggccagagaattaaatgagctaacccatgaaagcagctgccacagacctgcacacaacagcatctgtgactggggactggggactagggactggggacattttgtaggtcatgcttaagttccctggagatttcaaattcctgatccttgtcttgcacatatttcttattccttaaaaaaaaaaaaaaaaaagatttagccgggcagtggtggcacatgcctttaatcccagcacttaggaggcaggcaggtagatttctgagtttgaagacagcctggtctacagagtgagttacaggactggtagggtttcacagagaaaccctgtctcgaaaaataaaataaaataaaatatttattttagtatttatttatttatgtgtatgtatgagtgaacgtaggtacccatagaggccagaagagagcatcagacctccccaccccccgtggagctcaagttacaggtagctgtgagctgcccattgtggatggtaggaaccaaacatgagtccactggaagagcagtattccttttaactgctaagccaagccatctctcccgccccatgtttctttctcttggccctgagtttgccttgatgagcatgcttcttaaaaggctagatgatttgggcgagcctcagtgtattctacttcctttctgttgtcatttgcatctggaaactcccttgggatcatctacactcatgctcctgtgtttacttctcaaactgggttcccaggagctttggggttccacagagcctctaaagaggaggcttcataggtgtgggggtggtagatgagtgggctcagagtgttccccccaacaaagaaacatggtgtcttatctgttttacctattgtactctgtgaagtatttgcctgagagaggcatctccacacccaaataaatgtgaaagccattgtcaagggcctagaactgtctaagccatgtggcccaggacaaggaaaacattcctcagacagaagaaaagccctgtttgaatggctgtgggccctcttccatttacaagttccctcttggctgctgtttctgttttccctgatatcccacctgctgtaggtgggtactgcaccctccctgtctccctcctgactcacccacctggctttgggcaaagctctgctccctcctttatcactcacctgcttccttctctgacttctgacaatattgtgtttctttactctactctggcttcttgactatatggtttcctgcctgccttgacttagataccagtgtcctaaagtattctctgtctttctgggtgtcctgtcccaccagaggaaccttgcttttcaatggccttccagcaccgtttactttgaagctgaggttggggttcatcagggttaagtcaagttcctgaacccaccgtgattgggaaatggagctgtggcaatccagtggctacaggggaaatggggatttacacccacggaagcttgccttaccaggaactttcagactcctttcattcacattacaatgtggtaaaactgcaacattcctgtctgtgttaggtacgaagaaactgagggggagacttacacgattggctaaactcagcaaaactggaaatagaccctgggtctttggactctaaattctgaatttgagtggttgtagtttatagacttacacatataagattagaaataggttagtggctacagtagtgtggggacacacatacacacacacacacacacacacacacacacacacacacacacacaattttttcagtactggccattgaaccctgaacatggggcatgctagacaagtactctaccactgacccatagcctcagccaagagagttcatgggagtagcctggctggagggcggttatgggagataaggaaagggcctcagaggcccagcgttggaacctagccaggtagagtgcagagaggcctcagaaacgtcatctccagagtgtctgtgcaccccttataatttggctgatccagttcctggggactgtaagttgacctgctcctgtctccgagactgcactggctgaaggtcctattccctctcttgggctgcacctggtgtcccttgagtggaagtttcaaagcactgcctttgccctatggccctgaatgactgctgggtaattccagaggaactgtggcccattgttctgcagggtgagaaaaggaactgcagtgctggctgaggggaagcaggagggggaaccctctgtcggggtgatgttcttaagattcagtcatctctctctgcccctgctccacctgataaactggtggctttggggcactcacttcatggatgcctgagagctggttgagaaggggaatgagttagacccactgttcataggatgcacaaaacttcagcacctgggccctgggagttgatagaacaggtctggctgatcgtggcttaggcgagaggagggagtgtgtgggcagtgggagcacttacccttgctgcaggcgtggcttaagggttgagttgtcttttgagaatttaacatcaacaataaaatttagttaaaaaaaaataatcaccctgccttttatcatctctgcatgctggcagtgttagacaaatcaggtcagagactagctcagcagtagggtgcttgcttagcatgagtgaggccctggatttgatcctcagtactgcaaaccaaaccttccctctgtggtgggccctctccccactgcttggcaccccttagcaggcttagttaccttgagaaccctgaagctggagtcgagagacaaggacttgtgtttataccgctttacccaactgccaagttgcttaccttttttaatccttagtattctttaggacatacatttagttattgatatactgtgtgtgtgtgtgtgtgtgtgtgtgtgtgtgtgtgtgtgtgtgtgtgtgtgctactgcacaacacatgtggagagacaacctgcaggaattggttctttctttccattatttggatctcagggatcaagtgtagccaatgaggcttggtgacaagtgagggacaaataaggacatggcctctctaggatatagctgagaaggtttattgtagctatgagggagagcacagccagaggcgtcttggaggtcccaggctgaacccagtcatgagaggtggggcagggagagggagaaaagagaggagggggaacaagcagagctcctgggaaccaggagactcagagagtgcataaccagaatggctggtaatataggggtcagaggctggaggaagggagccagagccagcccttgggagggagaggcttaggatgggagaaagatgaggggtgatgggagaagccacaggtactgagtgagatgtgtatgtgtgtgtagtgtctgtgtgtgtggtgtgtgtgtctgtgtgtgtgtctttgagaactaacagccagcacctttactcattgagccacctcttcgaccccccccccgtttttatttattcttactgtgtgtatatgagaagtgtgatggacatgtgtgtcagaggacacactgttgagtcagttctcttcttccacatatctttgggttctaaggttccagggatctaattacaaatcctaaagtctgcatgggcagtattttattctttgtaccatctttccggctcccccaatattctggtctagaaaatggaaccaagattgtgtcttcaagtattttttaaaaaaaagaataatattcaataagataataataaataagtaataattaaattatacttatatattttaagtatacttatatacctataattataaaagcctacaatagaaattagcctttatagagaacagctgcacatgtaacagtacccacataactttatgaatctatctcatggtatgatatttgggtcatctgggattattctctcttggcagtgcagagtctgagagggttgagtcaggctttttcatgtggtgttgggtattgggttgggacattaccaaaccttgagatgccatctaaaaatatactccttttaatggggctcctaggcagataacagggagcccttgtgaggtgcaaccaggcccagccaagttctatagctaggcctatctgttggtgacctgccctgccctaacaggtgtggagtgtttggggagctgagccctctgcctgagaagagggtaggctgagcaaggatggcagcttctatgtcttgtgaatttactgtcccttgctaaaccctgctacatggctggtaccagcttcaggcactaagttcccacctgccaacaccttgttccttctcatctggacagtcaagtcctgttacagatattatgacttcccaaataatcctccaagttgggtgaagcagctttctctctctctctctctctctctctctctctctctcacgcactcttgcgcgcacgcggacaccgccttgaaaagggaggaaaccgaggacaagggggttaaataggatacttgaggctctgactttgggagctgagccttctgcctgggaagaggtgttcctgacacagttgtgtgagagtgtgttggcaggacacggacaacagtttgtaactgatcactcagccctgttgatcagggctcccaacaccagctcggagacaggactttggagaatgaaggggaagctttcgattatgttcactgttgactcaggctctttggagtcttctgacagagtgttagcaggtctctgagctggtgtggctggctccctctagcacaatccaagattagataggctctactctctccctgcattttacactgagtggctctgtcctaacttagaggagcccttgctatttgcccttcacccccatatcctaacttggtctctttcttttttaaaaagatgtatttatttatttatttatttatttattatttatgtgtacactgtagatgtcttcagacactccagaagagggcatcagatttcgttacgggtggttgtgagccaccatgtggttgctaggatttgaactcaggacctttggaagagcagttggtgctcttaaccactgagccatctcactagccccctaacttggtttcgtgtgtactgtgaggacctcagcttctggctgtagagccttcgtggggcaaagacctgtagctgttttcacctactcttgagtttacaggtgccctctgatgggtatagtaagattatctctgattctgcttttatgcatgtgcagtgaccatggaatagcccactatgcatgtgaactgccaaagcctagagtgatttcctctcctgtctcttctatacacacacacacacacacacacacacacacacccacaaacacagggttgtgggttttttttgtttgtttgtttgtttgtttgttttttaagaatttcaatggctaggggatgtagctcagtggcagagtgcatactttgcatgtatgagttacctggatgaaaactccagtatctccactctttacccaggtgggggtggcctatgccttttttccccagcactggggagacaaaggcaggtggatctctgagtttgagtccaacctggtctacagagtgagatctaggacagccaggactattacaccaagaaacccgccatgtctcaaaaaaagggaaaaaaaaatcactgaagtatttacatcatttctcacctctctaactcctcccattcccctcccccacactgttcatcaatatgttgaccacagtttgcataaagccagaaaatatgagccaggtgtggtgatgtatgagaggcagatggctctttttgagtttgaggccagcctggtctacagagtgagatccaggacagccagagctacacagagaaaccctgtctcaacaaaccaagccaaaaccaaaacaaaacaaaacaaggccagcagcttgactgctgatacctataaaggcagtagaagcaggctctttcacaggggatcctaaaaaacctatgcctctgttttgatagtaggttactatcacagcagttaaaggagagctgttctaagtcatggttcccagcccagctatctgagagagccaccaaggggctgagcacaggggtgcctgtattcgggaagctagggtacagggatcatgagtttacaacctgcctgagccatctagtcaggctctatatcaaaaaacaaaaccagaataagataaaaaagttaagtatcttcatctccaggtcatagaccagacctaactcagattctctggacttgaaatctagacctccttcattttaaaattccccaggggcctctagaatgctgccaaggttgagccccactgctcttcaattgaaagagtcaactaattgtttagagtattcccacatctgggtgtacactggcatcagggggaagggcgcttttaaaattacactgattccctggccctgcattccagaccatctgaagcagtgacttccagccccaggtatctcttagtcagccctcatctatgccagctgttcctacggacggtgagccaagggtacaaatgtttcctttacaactgtctaccagtgaatcatgactcgcatttcataggtcaggaaaaggatgttcagagcaggtagtggcctgacccgcatgaccaggcaaagaagtccctgaaacaggtctgtctaaccttgaaacctttcccagttttccagaccccagtcattgcatcctgggctgagtggaaagttttctctgctcttcccccaaacagctaaaggcaaggaaggggaaggtagcctgagactgcggctcgccttccggctgctcccagagcctgagctgaggccccttcaggagagacgaaaggccccaagatgaccacggttgcctggtgtttggcttggtcctagtctgctacttttgaaatgcttatttttggagggagagagagtaagcctgccttactcacttctcatttgcaccctcttctcctggagaaaccaagaggcaaaagcaaacactcactttttgagaacttaagggatttttcagccacgtggcagaaaaatgtctccattcccctcataagaccaaggagatgtgatgtcaaggtgaccggatacttttagctttgctttgtgactttgtgttcccaggtctttgtatagtgtgacttgaacctgggcactgggggatttgggtgtcaaacctgctcctgtgccaccaccttcatgtatacaacgtaaaggccttgaggtttcactttctccatctatctacttattgaggattgtggggggacagtttgtggaacccagaaatgccaggcctgccagcagcccttgaggtaccagaaggaaaggaatatttggccctgatgctaagactcaggccacctgggaccaaaagctttgtcaagtgtttgctggcacctgttcagggaccttatgtccccaacacttagagtggctccaagtggccatctgtgttagagatcgcattgaatgtgctcactctggccttcctccacctgtgtcagcccccagtgtgtggacagctcagagccaatacttagagcccggatagctgaaactttagagttagtggtaatataaatttgaccccaagcctagctcctagggacctccccccttgggggtgggagctccctctgcacctgttgcctctgcctttgtcccctgttatttaccagccagcacagggtacatgctcggacggtgttgagtgaaggacaaaggtggagggatgaatgactttgtttttggcgacatctctcaagtgcctgctatgacaggctgtttagctgtcagctatctgcttgcttgctcgctcggcttcatttcgtttgtgtcagccagttcatttagaagatcgtctctttaaagaacgttctaaaaataggatgctttaaatgcaatgccattttccaaggttgggacaaatgcccagagtttctcacaagtgtaacttttacaccagatccactaagaaagtgcatcagggctcttgatccaccgggccccttattaagccattatcagattaataaatctttctgagctactcgggcatttgggggatggtggaacaatatgggacaaaatggaggctgagagggaggacctcagagttaagtaaggaggggacactagcagtcactagggatttatgtctgtcccagctcacagcctgagttgagatggagaggtataggctgcactcagcacacttagggaagctggctcagggctgcttggatcaccatttcatggcccttgtctcaaagagcttgagccgggtcatgtctccggtaacaacctgagaaactgtgtgggcagctggctttgatgtccagttctgttgttaattcaagttatgagtcacttcacctctctttatgccctagtttgcaaattttacaactccctgttcacactatgatgataatgataattaaccttgccaagtggcctttaccccaccccacccccacccccatcccaatcaggagcctcaccagatcagcctgtttttatggatgttgtgactttaactggtactatagacctgggttctagatgagtcttcacaaggacaaggccatgtcaacctaccaagttaacacttcccagggctttgtatgctgggaacaacaacattaacatccttcttagtaaaatgtgaagatcccttaggagtagaagggaattcagtccctgctctacctgaggcactcactgttagcccggcagggccactggccggtgggtgacacacctttctgtcttggtaaagtaacctgctgattgtcttggtagctggacacgagggccacttttccagtgtctacaccttacttctctgtgtctgcgtccccgcagtggccagtttgccatcgtgaagaagtgccgggagaagagcacggggctggagtatgcagccaagttcattaagaagaggcagagccgggccagccgtcggggcgtgtgccgggaggaaatcgagcgggaggtgagcatcctgcggcaggtgctgcaccccaacatcatcacgctgcacgacgtctatgagaaccgcaccgacgtggtgctcatccttgagctgtgagtggggtgccgggacccatgacgtgggggaaaggggtgtagggcaccgggacccatgacgtggggaagcggggtgtagggcgccaggactcatgacacggggaagcggggtgtagggtcctgggatccatgaagtcgggaagcagggtgggcaaccagaccgaagctcagcccagagaagatgcagtcagctatatatggtttccttttgcctcccttatcctcagcctttgtctgaaatgaagccgatggagggcgtgagcgtgctaagtagcaagggtaacaaataatgacctaactcttgctttcattagattttggagatcaaagagaagaaaccactggaccatctcaccggtccatttaaagagcctagctatactcctgcatttgcaaggtgccatgtttgtcatcttgctctgccctgcttaaaacagtctcactaactcagagaggtatctatgttcactctgttcaccttacttcaccctcataaggatatagtcatggagactcttagcatacccattttagagatgagaacaccaagaaggtcaacatcccatagctgggaaatacaaaggctaaggtgcagccttgggatggctgagaaggacttcacagtggctggtggaatttagtgacaccaagactccagatgtccctgagctagtgaagcctggtcggtagtagggtctgatcaggctgtggcacaagtcaccatagcctcatccagcctgctaatcagcaagagcccaggacaagagtgctctgagcctcatagcatctagtaaacacctgccaatccacagaggagtggggtgtttgtctcaatatttcttgattttgtgactgtgagcaagtcacctgagaaccaggaagtgtcctttacctgcctccagattgaatggacaacctgatgtttgagacttacctataccttggaagatgtaactagttaattgagagaatttacatcctcttgaatttgattctagcattatcaacctctgtgtttaactgcatagaattgccaataatcacctcttctctagggcccgatgtcctctcgtttcatctatggacccctttgcaaaatgaactagctactgcctgtgtctccctgaccaagacaggagtctgatgaaggccttcctcttcttccccagagatgataagtcatgtgtacactccacatggcatgctctaaggctagggatcactggttagcatcctgattcccagcagacagtgacaagtccatcttcctgggaagtccagagtcacttctttaaatgtctattatcatcccccgccccccaccaaaaaaaaaaaaaaaaaccataaaaacaaacgcaaacaaaaaaccaaaaccccacaggaattaggaaaggcatctgtaaccctccagcccaaatagttacttgtgattctctgtggttcctctcaatccttatcactttgtatataattttacaatttcctgttccagtttttttctccaactaacaaaattccatatatagctgcttttccatttaaataactatatcatgtttcattaaattacacatcagtgcttctctattgctggacatttgcttacaattttccagcttttatcctttccaaactttactgatagaactctttcttcccaatggtctgcctcttttcttttgaattagttatttcagctgactctcccaggagtggaggattaagttaaaggtgggcagttttaggttcttggtgactttacttccaaaggatgctgggacaggacagtgtttctatttgacttcagccttggcatccgtggaacatctgttttaaaacacatgtcttgctgggcagtggtggtgcacacctttgatcccagcacttgggaggcagaggcaggcggatttctgagttcgaggccagcctggtctacagagtgagttccaggacagccagggctacacagagaaaccnnnnnnnnnnnnnnnnnnnnnnnnnnnnnnnnnnnnnnnnnnnnnnnnnnnnnnnnnngtttctctgtgtagccctggctgtcctggtaactcactctgtagaccaggctggcctcgaactcagaaatctgcctgcctctgcctgctaattggtgtttctttaacttctgggaaaatgatccattcccacatgtttgtgggaacccagcgtttggggaacgatgtgcttctgctctgtctccagctctcccagtagggctcatgaccagcctgaacttacatactgtcatatattatatgacattatatactgtgagtgcaggtgcaccgtgggtaatagcagtccccacacaggtgttcccaggacttgctatgtttagctgtccacagtttctgtctcctttacttccaggttgccaaattgtgcttggcatgtctggcagaggaacactaagggtttatgaaattagaaaagagccacgcttttggtttgtaaagaccacgctcagaccatgcttgctgggctctaaggaggactttccagaggaggaggacttcccagaggaggaggacttccaataggagaaggacctcctggggaggggttcctaagggagcaattcagaagttttttcttggacttggtgactcttgttgggctcatcagaagttcttagcatttgagttctctctggacagcaggttagcccagtggtcagacataagtgttagtgtccactcattcatttgcagaatttacctatctatttgttggtatttttctcagacagcatctcaccgtagtccaggctgctctagaccacgtgacactcccagctcagcctattcagtgctgagatgacagatgtgtgggtttatagatgtgtgtgaccacatgtatataatgtgtgcatgcatatgtatattcagtatacacacacgtgtgtgtgtggaggcctgaggaagaaatcagtgtcctgcaatacttattccttgagatagggtctctccttgaatctggagctgggccagcagccagcagaccccactgattctcccgttcctgcctcccacagtgttaggcttactggtgtgcttggcaacacacagcttttcacatgggtgctgaggatttgaactcggttcctggtgtttacagaacaattgctcttatccactgagccatctccccagcccctcacttgcagttttgatgggtgaattgactctggtcccagggcactctctagcagctgttgtctggtttgatgcttccattagtttctactgaagaggccagtagcagaagacatgccctgtcgaactcctgttcctttcagctgtctttatcccatctctgccttcttagaatcacctgtttctggtcataatgattaaagggggggggattaggaaagattttgctgtctgtataacttgatttccatgtagtcctaagactatattaaaaatctcaatagctggactcatgccatatgtggagaatgcccctttgtagcctcctggactctaggattgcagtgagtggtgccctggcaggggctcctaggtgatgctgatacttccaagctcaacagctgtgacaacattattgctccatcattgcctgtgcaggtcatttatatacatgataccagaagaactctggaaagcatttcaccaggcgtaccaacctgcaagggagaaggggttggccctcagaacactattacagaagagaagagacccgactcttacttagcctttgcgggaggggtttgatttgcactgtgagctgagggaatcctggaaggagatggaaaatggcccaggttttagaactgagaggctctcagtaaaagctgtttccaggcttgtagagacagcatggcaagcttctacctttgaattctattctctttatgtgtgtgggggtaaatctaccatgtgcatgcagtgcccacagaggctggaagaaggcttccgatctctgggaactggaggcataggcagttgcaagctgccatatgagaccagggaaacaagctcatgtcctttcgaagaacagcctgtttttttttgtttgttttgttttgtttgtttgtttgttttaactgctgagctatctctctagcccgcatcaatgttttaatttattttccattttaaaatgtttttgtttgatttgttttgttttgagacagggtgtcttgtagccttggcagctcttaaactctccatgtagacaaggttggccatgatctaccgatcttcctgtctctacctcccgagtcctggaattacaaatgtgtgccatcacattgagtttatgaaacaggatcaaacctatgctccctgtatgctaggcaagattcgtattaattgagtcaccaaacttctactgagtggcttctactgaggtgtttcagaagcaaactagtctatgtggagagagatctagtggagcctgatgagacggaggctgtcagctcaggggcccagtctgggtggctttgatggagacacttgggctacatgatgtggagagagcaggaagaaaggagctcgtggagggcttgcagtcaggggatgtggctttaaaacctggttctatcactcattagctgtgttaatggggagccacttgctctctttagctctcagtttcattctaaatggagagaggaaacctgcattcctccaggtagatgtgagggtcaagtgagaaaatattctggaaggcatagtgtaggaatggtgaactttaaataaaactttatttgagacctgctccagcaccgcacctctgcagggacactgtacctaggacttatcaaggacttgtcaaggcctcccagcgcccagtcagcccaaaggcagccaagaagtttctctcttgtttcaagaagaaaagctgacacctgggaacttgcagacaaccctttttgaggttaaggtcgtggaaggactggacttccaccctaacccttcctgggacagacttaaggtgtcccttgtagcaactgtgaggttccagcacctgccccaagacagggtgaggacaggatgctggatgatgtcaccctgagtcctagaaaatgctgtgctaagctgatctctagcacccattcagccctacaggccacgcccagctcactcagagcaagggaggacctgtagcaggagcagtgaatggacaaaagaaataaaaaggaaaggagcggacatgactgctcctgggtatggtggaggagaacctttattctgggtatgcaggagaacagagccagaggcagacacgtcctaaatggtcacatccctgaaccttgtgaggagaggggaaccaagtataacagccagcaggacaaaggtacaaaaggatacaaaagaggacaggtaaccaaaatgtctggattatatgggggagagcctctgggggaagggcagcccagcccttgggctggaaagttcagggcagaggtgtggtgtgccagccacaccctgtaacaggtagggactgaggcacgctgggagaacctggaggcagggccttttcagtatgttaaataagcacccaagctgtttgtcccagctttgaaatttaacagacagcaggtttgctccaatgtgcacccttgtcctccttcccccaacctaaaataagcaccagccctgttgctgagattaaaaatgtccccacaaagacaactggagagaggagggggttactttgactctcgctgtgagggtgcagtccttcacagcaggaaagggtgccagtcacatggcagccacagccacaaaccagaggtgacgactgctaatgtacagctcacggaatctctctttttttttctttttttttttttttttccgtttttggtttttcgagacagggtttctctgtgtagccctggctgtcctggaactcactttgtagaccaggctggcctcaaactccgaaatccacctgcctctgcctcccgagtgctgggattaaaggtgtgcgacaccacgcccggcacgaaatctctttttattcagtccaatagaattgaatactgaccaaatgcaattctaaattttttagtagccacactgaataggtaaaaagaaataggtgacctgatgttaaagataattttagtgactccaacatatactgactttaatatgtaggcagtatgaggttattgattatatatatatatgtgtgtgtgtgtatatgtatatatgtatgtatatatatatatatatatatatatagtatatataagctaatgtggatttgacatttgacactcagagcacatatctgcttataggtattgccctggttaaagtaaacagcagttctatttaaacagtaaacttgtgtctaatgaagaaattttatacttcatcagtttttatattaaaattagattaaatttaaaaattgagttccttagtcacatcggccatatttcaagtgctcagtaaccacacacatttagtggctaagtattttgtttgtttgttttttgttttgttttgttttgagacagggtttctttgtgtagccctggctgtcctggaactcactctgtagaccaggctgatctcgaactcagaaatccacctgcctctgcctcccgagtgctgggattaaaggggtgcgccaccactgcccggcttaaatattgttaaacagtctagacagagaggacttaagcaaacagaggtgcttgtacacaggccaggacactcatgtgcaccattatggaggtgcagaaaatgttggaaagggcaaatcctgtagttttctagagattactttatgaggatttatgtgtaagctaggggccatgtgtagattatcctgagtccatgaagaggccatatttcataaaaccaaggaggggaagctctaggggccatcttgcccaatctgttctttttcaggtgggaaaaccacggctttcctagagcaggagaatgagtcaccaggtcacagccagtcaggtctagcatttgttcctctttgttgtctgtctcagtccattcagactgtggctcctcactctcctctcccaaaagtccatgtcatctactcatgtacaatagatctgttgtaccctaagagtcttacatgatttcggcatcagaatttaaacattgatggcaagccatgcctggtggcacacacctttaatcccagtgcttgggagggtgagacaggcagatctctgtgagtttgaaaccggcctggtctacagagcaagttctagaccagccagagctacaaacgaagaccctgtctttaaaaaaaaacaaaatacacaaacagaagccaccgtcttaggggagcacatctcggtcaattatgggtgagagtcaagagggtccatcctgagcaaactacacttcagctgaaatgggagcaaccaacaagcgctgtggttttaaagtcctgtgtgtggtaggagtggtgtggactgttccattccaaaggagcaaactggggaagaagaaatgagtgacgggtcttgagtcagtcaaagaccactttggactcaatattttgcccttcagtctcaccagggtgctcacatcctgcataacagttttgggtaaccttgccctcttgtctttgctctgagtagcctataccacaaccctcacaggttggagttgcctggctgtggctcctccagacaagaatggtcctctacacccgtgggtgcactggtctagagtctccaggtgccagattccctgatgcactaggtactctctgcattggcctccacccccacacagttctccttccaggggccaccaagctctgaggcatcctttgaaatccaggtggaagtagccacacccacacagctttgcttggcacagagcaatcattttaggaaccagtggagccacacctggggtgactgataagcatggagctggagttctggaagcaaaggcctcaacatgaaccagggctgggcagtggggggctcttcctttggtagggtcctgtccttcaggccctctctgtggccctgtgacagaagtggagctccttccctatatgaagtctgagatgacttgaaaccattatctcattgtcttggacaataggctctttatacagttgactaatcgccattgttttgatgaataacacctggccttccttgggctgggctaactgatccttgtaaatctccttatcaggcaaacctcagctccacctgggttctctccaccacagtttctcatgggtttcttcccaataggaataggctgaaaaaacttaaaacttttacatgttccttatttttttaaaaacaaatattttattttaaaatatttctctttgggccagtgaagttgctcagtgagtaaggtacctgtcaccaagcccgatgacctgagtttgattccctgggatccatatggtgtgaggagagaattgactcctgcaagctgtctatacatacacactcacacaaacacacacacatacacacacagagaggggggggggaagagaagacaaggaaagaatcagagacagacacagagaaagacacacacacacatttacatttcactgtgttgagaggggcagactccttcatcagcgttgtgcttagacattttcttagctagatatccagtctcatcactcacaagtttggcctcccgtaagacactagcacatgaacaaaattcagtgacattttatgctgctattttattacaagaatggtaataaagtacttccactgactgatgccacattactcggttctgtctgcaaccctcaccagaatggcgggtcgccacctgtatttctacttgagttctatccagaaccacttagatactttcagggtgctgagactcccctccccagaaccgttttctgtggctcacttatgacattgaagactaatcccagcatgcatttcacagctcatctgcctcagcctcttacctacttccgaagccactcccatggtttttgcttttggtttgttggggttttttggtgacagcatcacctcattcagtacaaacatcctatgttgggttcttcaagcaactatgtaacaaaataccacaaactggtatttatttcttatacttctcaaggctgagaaattcaaaatcaaggcactaggagacttgtctggggaggaacttgcttcgtagatagtggtcttcctgtgtaactgaaaagtttctgtttggggttcaccagcacatggagacagatcgtctttttgggtaagagacttattagaagaattattaatgccatagatatacataaaagtaggcattgcaagggttttaaagagaatttagacccacgagggctaagtaatctcttttgtaggttttagagaagatagagtggtcccatgctatgtgattgacaagtagcccatagtacattctcggaatctggccgtctctgattccccggtggtaggggaaggggaaagatttggtcctttagttaatatgtgtgtctatcatatgggatgggctgcctgaagtcccaggttacttagggtggttataaagcttccctatgatttatgtatggtatataggatccatatatataggtatatagggtagctctggctgccctggaactcaccaaggtctatgtgtccccatctaatatctgcgattaaaagcatgtaccaccaagcctggataaactgtaggactttaaaagataatgcagactgatgcctggactgtgggcatggatcagttggtaaagtgctcgctgcataagcacaaagacctaggtccaagtccctaagctctcacattgaagccacgcatctctgatttctgcactagggaaaaggagacaggaagagcttgcaggcatccagtttagcagaatccagagttctaggttcagtgagtgatcttgtctcaaaatataaggcagagagcacttgagacagacatttgacatggatctcttgtttctacgtgcatgtgtgcacaaatgaacacacatgcagagtgagggttggtacaaatggagaatacttcatgcgatctgacattgggtccagatagcttctgagtgggcagtaccaggagcagggaaaatcactcttagttgagtccaggacagtttggaatttgtcacctggtgatctacaagacaagcacatattggagggggcccatgacagtgatggactggtgtgcctcactgtagtctgtggcttctcctttcatgagtcgtgtgttagggagttgttgttattcattggtctggtgactgcaatgaattctcaggagattattttttttattaatgcaaataattcacttatcgttctctaccttctggatgtgccttcgggacagatggtagttgttcatatgtacaaacaagataccaagtcagggactggaaagctgagttcaatccctgaaacaaacatgtttggaaggagagaattgactccagcaagtagacctctgacttctgcctgtgtgtcatgggcatgtgtgccccttcatcaccaactaactaactagctagatgccaggtcactgtaccttacattcatactgctgctctatctgaaatgtgattcacaatggggcacagcctgctctttacagaaaaaaaaaaaaagagtaatattcagggtaatgagggacctgggcctagagcacagacagaggcctttctgggatcagcctcgtagtgattctttatttggagcttcaacagaaagaacacagaagtgaagccagtacaatagaatgtgagacaatgtgagagtcagctataggacctgcacccatgagctaggcctcaggacaaacaaaactaactgggcctggccctccccaccggtgtcttccagagtgtccggaggagaactgtttgatttcctggcccagaaggagtcgttaagtgaggaggaagccaccagcttcattaagcagatcctggatggggtgaattaccttcacacaaagaaaattgctcactttgatctcaaggtcagtacaggggataaagggcaagccgtgttgaggaggaagggaccctgtgcccttgccattgataggaagggtctagtgcccacaggcccactctgcacacctccaacccctatcctgacctcgggccaaggaatggcctgttgcatgtgtccacctcagtttcacttcttctatcaggtcttcctcacgtggggctgactgcaagaagctctttgaacacttttatctcttccagggagtaggtggtgaggcataaaaacaaaaaacaaaaaacaaaaaaaaaaaaagaaaagaaagaaaaaagaaacttgaaacagaactcatttcacaagaggaacgttactggcaagggagagccaaatcatgagggggcagaactagcaggatttgcagaattgctgagcttggctgatactccagacctagcacagcgtggccttctgtgtctcctcagtggagatgacagatcttggaacccaaggaccattggctgcctgctcctccctcaccccaaactggagccacaagactgcttccagggcccactgatcatttgtggtaactggggttcagggttgagaaagttcatcgtggccatgtttaactgcgtgtatgctgaggtcaaggcagaaggactggcttcctcagtaactgagctcaggcacagagactgaggggcctttgcagagctgactcactgaagtcccttcaccttgtgaagagatccctgtttgtagtaggagtcccacacactattggctactattgcttctttattttgcttttgagtcacactcttatgtacctcgggctgacctcaaacttgttggccttgaattcttgattctcctgcctctgcttcccacatgccaggcttacaggtgtgcaccaccacacctgcctgtctgtctgtctgtctgtctgcccagtcttctctgcagaaatccctgtcctgttttgtgcaccatgctaagcattttttttttctgggcttaactcttttctttctttctctctctctctctctctctttcttttcgtttctgtttttggagacagggtttttttttttttttaaagatttatttattattgtatgtaagtacactgtagctgtcttcagacacaccagaagagggagtcagatcttgttatggatggttgtgagccaccatgtggttgcgttcaaatctggacctttggaagagcagtcgggtgttcttatccactgagccatctcaccagcccaagacagggtttctttatgcaactctgaatgtcctggaactccctctgtagactaggctgaccccaaattcagagagagatagatacctgtctctgcctccaaagtgctgggaattaaaagtgtgctctaccacccacctggctagtttttcttcagagatttgtgcaggagacagaaaagaaagatcagccattctaagagttgtgatagagggaagcactgggaggtcgggggttggggtggggatggtggggttggtgaggagctggtgagtccaaaggacagacctttaactcatcctgaagttatgagagagagagtgtgtgtgtgttagttgcttggaaaagctgcatttgatttttctaaaaaatcaacagggatttgcagagggagaggactatctgaggaagatttatatactgtgtatatgatctcagtaacaacacaagccatcaatgaagtacagagaaagaatgtgtgtgcataactggagaagaggctgggaagagggtaggaagcagttgagagccacaaaggctgagtcaaggaggccttttaccctgagagatactggggacagagtagcacacatatatttcagcttgatccctctggctgggaagatggatgcaaaggggacagccaggcagctggaagcctagcccaaagacttacgcagtaatctagataagggatggtaagggacagaggtcaagctctaattgcttaggtgcttaatttcatgtgaaggtaaggaggaggtagcatccacaaggactccatattttagtttgagggactgatccagagagaacatgaagtgagtgcctccagtctcacagcacccacacaagaatccctgtcctagctcttatcccagcacgagccccttcctgatgccagttttttcaggcttttaaaatgatttctatggaagatggcttacagagtcctctcaggggtcccagtggagggtgggtttggacaaacttttgggcagttagatagtgatacaccaggcaggtaatggtctaactggattgcatctgtgtttccttcctaataattctacaggcagttaacttattttcttggaccttcactggctcctggagactacttccctttgtcttttctctagtggctgatacagatggaagggtttgctctggtgaagggggcctgcatcggagtcagctgtgttgggctttatgcttgattctgccagacacctgaagacacctgaaccttggtttttcagccctgttgtagctaccaccacttacctggcagagttgacataagaggggagcagtgctcagaggcgcatgcagagtacgtgttgtgcgctgttattgttacctcccttcccagaagagtggaaaagaaaacagaactcttattacaatgttttgggctctgctagactaggaaaacaaactctggtaatgcagagagctgagacttgctgtgtggtggggcgactgatggggctatttctagccctcagactgagtctggacgttttccatgacctaaagacagtctgagtttactctggtacatgtaggttaaagatgctgctaagcccgtccatcctccagtatatagactctgaacgttctgattctctcttctcaagggtttcttggcctaggcccagataggcaattttgggaaatgatgagcagcaaggccacaaatggattttcctcatgcctaggagacacttcctatacccagagtgtagctttgagtactgttatactggaagctttcactagcattgggggatacagtcagctggtagcctagaagaggtttcttggttccatgttgctttctaccatccgacatccactgttcttgttagttttcctcgtctctgatgagcttctgtttcccgctacttgcttgtgttctgttactcctccacaagaaagcctggtttccctaatacacagatgctatgccatctccaagcccatctattacctcttctcctggtcctctttcctgcttgaaggagctatggcttagaagggttagctgtttgttctgcccttgtgatatgaatggcttcttgggaagctgtcttagttaccatgaccaaggcaactcaagggagaaagggtttatatctcagctcacagttcaagggaacagtccatcatggagtcacatggcagcaggagcgtgaagatggtgggcattgcatatagtcaagaaagagagaggggaaaatgcatgtttgcacttagctgactctccattgtatagagttctgttcagggaagggtcccactcacaataaatataggtctctccacatccataaacatgaggataatcctccacatgcatgcccagaggcccatcttccaggtaattctaaagaccaagggtgcgtgttgcaacccctctagtcttccctttcccttcccagggccttcctgctcattctctaagacccagcaaaactgtcctttcctctggaaagcttctgctgtcagccagaagtataactaagaattaaccaaggcctttgtgtctgttaccctctgtacaaacttctgttcaaagtgtttttctttaggacttactttctgctgcacaatacctggcataggatgagtcactctgagtggatgagtgagcacatgaatgcacaccttagtgacaaccaaacagacccttagatgccatggaattcagcatcttttcatgggttataaggcagggtgcagctagctcaggagtgtacacatttatagaagatctactataatccaggagaagcacttaaataatgtgatatagtccctgccttgcaggagcctagtgtcttcagggagagggacatagtgaggcttagtgaggaggccatatgaaataaagcctattaggaactctctaaccatgcccacctccaaggagtgagctcctagcctcaggcaaagtgaccttccatgtgttatagaactggacacagatttgagtaggttagggtagaagaataagggttgttacccttttggaagggacacggactgaccgcctgttggtatcaggaaccatcaggcaagatgcccatagggaaataggcctcagaaccattcagaaacctcacttttgtgcatcatctcagtacaaatagaggccttgtagagggtgtttgtatatggtcttgtatactcagtttattttagagagtttctcctctgagttgggatgtatcctttcctctctgcaccaaccaaatctagcctgagaactctgaaatagaaggtagtctccaggactgatggtatattaaagcaaaaataataaattataaggaatgattaaattgatatctaatccagaagttcaagactctgaggaggcttttagtttttatgaacacgactaagagggtaaatttcagagccaggaatcccaccaaaacccaagcttttaagctcctttatgcccagagccatcctcagtgctgccctacactcatggtgtgatagagactgctgggcaagctttcataagggtggtcacggcaacactttgagggcatagtactctctagaatctagcatgcttatgcctttttcctcatttgatcctcatggcagcagaaggtgatgtcatatttttacaaaccaaatacttgggattcaaagagattaagtaaccattcaaaatcacacaagtatcagatgacaactcagcacttgttattcatacagctaatccaaggtccgggctgggctatacattttgttttggttttctgagacaagggctcatgtaggctaggctggcttcaaacttgccatatagccaaagatgactgtggacacctgatcctcctgcttatgcctcctgagtgacaagcttgtgcctggtttctagtcttttcttttcttttcttttcttttcttttcttttcttttctttcctctctcttctttcctctttctttctttctttctccctttccctttctttctttctttctttctttctttctttctttctttctttcttccttccttccttccttccttccttccttccttccttctttccttccttcctttctttctttctttccttccttctttgggccaacatgttccccatttttcagttgagcaaactaaaccaaaaatgctgtcctgtagccgtggctactttgtgggttcttctttcttccacatttcttcaccccttttctcttacattttcaacctcctaacaccggataggagagaaaataggatggaggggaaaggagtcaacattatcattaactacttcctgctaattagaagccccaaataccttaggacaagtttgtcaggatatctaattatttctttttctccctctccctctctctccccctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtggtccctctgctggtgactaggtggaggctgtggtttgacaaatctaagggcagctgagttccacccttccctaagccacagctgtggcttttctaggaaaagcagggagctggggcggcatactgactgaggcacagagccatggtgaaatgcctattgtgccagcaagctgggtgatcctaaggccatggctgcatcaattagatgaagagaggcatctaaggagtaggaggcacataggctcagctcatgctctgctgttgttggctgagacgcctttgagaactcctgacctcttgccttggtttcttcatctgtgtggcctgaatcctgacaggactggcctcatgcagtggatatcaaaagagatgaggaccttataaactattaagtgctacaggtttttctatacattctacatgacttgctagctagatgctgtgaggaacgttggaaagggatactagtttggttgtttttttattaatgcagtggggaaagcaagactcatttccagaaatccaagcatggtggctcatccctgtcattcggagtgctcagcaggctgaggcaggatcaccacgtgttttaggctaacctgtgctacagagtgagagcctatctaaaaaacaaacaaacaaacaaaccaaaaccaaataacaacaacagaagacttatccccagaatgcttgggcacaatagccccatatcctccaagatgctccgggaggagaaaggctgggctgcaggttcagctgatagctcctgggaaagacaggagtttggtgttgcctgaaaggatggcagatgaccaggtcctcattctgagagggaaagactcaatgggagagtcacactgatgcctatggcccactttgtacatcatgtttgaccctcctagtaagtgttttgagcagtggttctcaattgagggggggttgaatgacaagatcatgggggtcacctaagaccatcagaaagcacagatatttacattacaattcataatggtagcaacactgcacttatgaattagcaacaaaaacaattttatggttggaggtcaccacaacacaaggagctgtttaatacaaccctttaatagggttgcagcattaggaagcttggggaccactgctctagagatagcttttattattaacccctatttgtaggcgagagacgttaggtagcttgcccagtgtcagactgctattcatgacaacgtggaagatgagcccagactccaaggcctgtgctgttagccattatccatgccaggttcttccctgaaaacaggacatgtgagaagtatacgtgggactgcgttggtttgctcatttgcttgtaaccagtaactgaacagctagtacaaggctggccgatcttggatgcttagagataacagtaagaggcaaggaccctgacttcctcctggggcaatgtgggcaggacacgtaaggaagtgattatcacgctggtggtgttctgccagaggctgtgtagtgatgacagaggccctgaggtgggaaccgttagtgtgttggagggatgggtcacagacattcctgtgtgggtgtggagtctgtgcagtgaggcgggaggggaactattaggatggggttatctagcagaataaactgctggtttgggtggtgttggtggaggtagtggaggtgaggtgggtgctgagctggcagtaggggccatgggaccaggaagtctttgaatggccgacataatgggggctgggcacttgtgatactgaaggcttgtgggtcagggttgtttatgatggaccagttttgctttctcaggttgcccagaggtgtctaaccaatctgggtctggacttggattgcccatgaagttttcttgtttgaataacacaagctcagccgggcctcagcttcacctagcagcaagcaggccaaacaaggcacttgtggctcagtgcacttgagctctgcctcttctgcagcaactcgacttctttgggcttctccacaacatgactgactgactgacctctgagatcccttgtgacccagcattgtgaggctggagcataaaacagggtggggaagggaaatgggaggtgggagtgtgggaaagatgatttgtgagagcccatgtccttcctggactctcgtgattgaacagagtgtcaagtaccactcccagagaggactctcagctactgtgggcagcttagccagtatgctacagccccttcacgcataaacctctctctgaagccacagaacaatgctatgacctatgaagcgtgtttatgtgagtacactgtagctgtctccagactcaccagaagaaggcatcagatctcattccagatggttgtgagccaccatgtggttgctgggaattgaactcaggacctctggaagagcagtcagtgctcttaaccactgagccatttcttcagcccccaattcatattttcagtggcaaagccgagaagcgaattcagagctgcctgacgccaagcccttgtcttttgcccttgactgcatggtccccaaggttgcctccatcctgttccaaccatagggtatgctgtgctggtcccatggaaccagcttccagttggtatcacagcaggcacctctaacagacatgttggctttccccagagtgcctgcctgactggcaggccaagccaggcatgtttgttttgacaggtggggcagtcccaccccaccacatccccctgtggcagctctctgggctctgggctggcagcagcacctaaagaatgcagtgcctcctccagccatgctttgcaggtgatgtcagctgcgtgggctaagtacctggttgaataccattggccgaggatgactggggcaaggaggatggacaggattgtgctacccacggggcagtctggctgggggcccagcttcctgtggctaccgtggcctactcttctttcctgacctgaggcagaggcacaggatccttttcatggctagccttggggctcagagcagcagacgtttgcccagctagcttggaattatgtgtcacatcaaaactgctaaaggaacttaggatgacatctgtggagtagggaactggacccaaagagaggaaatggcctgtttattaagcactctacttttgctcctggacctgaaactgtttcccagccccaggcttgggctccttttctattcggggaggtggaataagagaccacaacctggggaactgccagtttgctggatctcaggctgcctttcggaccatattttagccctattaacagctagccaggagggctctctggcactcctagtggtggcttatacaaccagacagaggaggaaaccctggctggaattcttttactgcatttacatgaatatgaatgtgcagaatgtaagatagcagaggcaacaccaggaacctttaatgggattgaatttacctaggggagatttacttgccacccactagacaagtagcactgcatccagaggcgatctgaggtgtctgagatggtggtgctcaccctgtgggatgagagcaggtctagatgtgagatctaccagaaggctggaaaggtaactggggttgtggctggggctggttcagagatctgattgcctcagttctcaaaaggagcttttgatggtcactgggaccactgggatatttaacaagcctggttgatggggtaagattaggagcaggacttccagagaaactctcctgccatcatgctgatgggccttgggcaagtcttttagttccctgggcctcagtttcctacatctgtaaaatggtaatggtagtagcatctacttctcggggtggggaggggctgccaggatcctatggaaaacccaaatgagtctctggtccctggaactggttgggctgttactggaggctgggacggcaaaagaaagaattataaaaactgcagataagggggcccgtgtttgctggctagcctagaatcccttaatggcctggaggtagcaatatcatttggtggcagggagccaatggcctgtctgcgcccagtctgagtatacagggccaactaatagttcaagtagcccgttgagtggctggtgaggtcccagtcctctcacttagcagagtattcctgcagccccaaggccatctccctggttgaacaccttaggctgtgcttctttgtgtatacctaacttgggatctctcctcctagaactcctcattttctatttttatttatatatatccctgtgtatataatggcacatatatccaagcatcgttggaagctagagaagggcgtcgggtctgttggagctagagtcacaggttattgtgaccagtttgacatgggcactgagatttcaactctggtcctctggaagcttaaggctctccaaacatccctccctgatattcagtcttcttgtctgagatgagagcagctagcgtaggagctcttgaaggcctgaaagccaggctagggacagggtttggaggatgctcatttgcatgaaagcatccacagaagaaaggccatcctgtgggggaaggtggatgcctgctccagacactagtctgcatgggttccccagctcaagcagggaaagggatcatttagtctagagggtgggagaaagagctttgggtacgacagatagatgcttaaatctctgtgtcccttggcttctttttcagcaagaaaggaaagatagcaccctctgctccaggcagttgagcgaggtgtaaactataccgtgtgattggttggtgccaggccctgcatatttaaccggcctgataaaaggtacttgatttctctcagggaacacgtactgagtgcttggtggctgtcaggctctctcttaagctctggggagatgctagaacaactcacttaggaaggttgatgcccattggagggcggtagacaagtaaccagagagctctagctttggacctaagaaagtgttataatgaggaagtgcagggtgtttgggagcgggaagggagagggctgtcaggaagaccttttggaggagactgactgtcttaactgaaatgtgaatgggcagcaccagcttaggggcagggcagggcagggaaagtgctctaaactgctggaaacagatgggtctctggtaagaagatgtagtctgccatctgtccaagccagtggacaggccatttccactgtagccacagatgtaagtagatccaaggctgcctgttttctgaggatggcaatgccctagagatgtcagcctcagttctttgatgcttcgtctctgctgctctgtagtcctgaacctctaggctctggggagtccatctctgtggctcgtggattccgttgcattcattgtgctgagatgggttctgagctgaggtggtcaggatagtgtagggcctggtctcagggcctcatccctagagaagttcctgacaaggtggccaatgatgtgggtagacgagaaatgacgcttcctggcagggaagtagtggagagtggggaggatgtagctcagtgcaggaacagcagcagtgttcctgaggcagccagcagagtgctgggccaggaacactgggatggggccgcctgcctgaatcttctctcttgacctcctctgccctcacactcccttcagcagaggctgaaaaatctgccttgggaaaggactttgacacatgttcaaaataaagttgagagtaatctctagagggcaagaaaaataaacgagctttaaaaatgcaaaagaaaacgtgttatttaaacaaacaaaaaaaaaaaaaaaaaaaaaaaaggaaaaaatttgagggagggcctcagttcccttgagtaaaagtctctagcctcagcaatgggaggtcacagagatttcagggagacagagacacccggtgtatatgttgtggggtgaccagaccagattaagtgtgagtttagctaagagttagggtccagctcagtgtgtccccatgagggatccacacagcgtgtggggtgggagggcattgccaggtctcagttttccctcctgttgaagatagctctacaaagagtcagggaggatggcaggggctgctggactggagacagcagccagatatcctaacaaaaagaactgaacaagcaggggtgaccaaggtctgcttacaatcaggcagggcctggctggggctattaggaatgtcttctaggaagagagagttggagcaaaccttgtaaacccaaccaggattatggtgggaatgggtagaccagaaagccctcggggcgccgacagtggtgtgagcaaaggcacaaggtgggaacttttcctcctcagtccttttgagaatggtggcttccaatcctctcgaatgtgtttgcttggttaacagccttcctggactttactccacgtgtgacaccatccaccacttgctgtgtgtaaatgatagattttataaccaaaagcacaaccatccccagtgcagttttagaattaattttagaatgtttttatcaccccctaaagagaccacacattattagcagtctttatctattcaccagtcttgttgtgttgtaagacagagtttctctatgcagccctggctgtcctagaagctgatctggagaccaggcaggcctggagttctcagagatctgcctgcctctgcctcctgagtgctgggattaaagacattcggcacctctgcctggcttcccggtcttttttattttgaatttattacattttgatgtgtgtacttgtgcacatacacacacagcagtgcacatgtggaggtcagagatcggcttgctgcagttagatctctcctttctaccatgtggggtcctgaggactgaactcacatcagcaggcttggcagcaaattctgttacctcaggattctcaacccctttggggaatcacatatcagatatcctgtgtatcagatatttacattacaattctcaacagtagcaatattacagttatgaagtaccaatgaaataattttatggttgggggtcaccacatcatgaggagctgtattaaagggtcacatcattaagaaggctgagaaccactgctttccatgctgagccatctcactggccctattccccaagtcttagtcaactgctaatcttctttctgtccgtatgtatttgcctagactctgtgtatatttcttacaagcagaatcctgtattatgtgcccttttgtgtatgtttcttcctctttctcctttcctccctctcttcctccctttcttccatgtgttccttctcctcctcctcctccttctgttggaagagacttaagagtatcccaggctgacctcaaatgcacttcaatcttcccaggtacaagggttttcgggcaagcaacctgacacctggctagtgtaacattttcaaggctttgctacattgtaacatagatgagtagttcattcccttttacctttttattactttaattcctctttatcatcaaatcgtattcttagggccctgtaagagtacttatctcacacaagtaaggtactgggttcagttccgagcatgggaaaaagtagggcttcctgtgtgaatatggtatgtggtgtgtgtatatccctctttgtgtatctctttatcagttaatgggcatctagtgctttctggctcttgtggggatactgctgtgaaggttacaaaaaaggttttgtatgggaaatgttttcaggacagtccatgtcctgaaaaggacatggtgaagggtgaaggaaagatggctaagcaggtagacttgtccattccctgttttgtctcagagcttggaggcagacctcaggaccctgtaccagatgacctgggatctgggagagggataacagggtggactgtgagggtctggtccgtctcctttctctctgccaagcctgccattgttgtgttgggccagcagctgtttctgggccagaaatagtttgggcagctggtattttccctggaaatcaggtgcattttttttcctgtgtcctgccaaaagccaaaattatttaaacacactgagagaagttggtcagtctcagagaaagtcaacaggaagccgactggccagaggacaagagggaggtcagagagtcactccaggctagtgagccttgtataaacccaggggaagcccgtgtgtccctctcacatcacagggacgtggctttgcttgtaggaaaggctacctacaggtgtctgatcccgtctgacagatgagaaagcagggaacctcattgaagggttcttccattcagagacagatgggaaatcggagcccagttctctagttttgctgtcagtaccgggttagtaataactggtccttgaccctgggtgctaggagacctaagacagaaaaacaagaactctgctgttttcatccctcccggaccccctgccaagagagcacgaaccccaccctaacccaacaggaaaacacaaaacaacactttaattactatcttgctttctttctgttttgttctccagccagaaaacatcatgttgttagacaagaatatcccaattccacacatcaagctgattgactttggcctggctcacgaaatagaagatggagttgaatttaaaaacatttttgggacacctgaatttgttggtgagttgtgggattgtttttctctcagtctggcacggaggagacctgggagggagttcagacctgagttcaaggcccagaatctgtgtaagaaagccaagagtagttgtaatcctagattacaagtagcatgctagggaggcagagacaggtagatactggtgggctcaatggctagccagctgagcctacttgacaggttctaggctgatgaaagacactgcctcaaaaaataaggtgcattgtactgaaggagcaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacatacacacacacacacacacacacacacacacacacacacacaaagagagagagacagagacagagacagagaaggagggacagaaatcttcggaacaatccttcttcatgtctgggctgaggtatcccatgctttggcatacttgcaagaaactgaagggttgagaaggaatggctttggtaggacctcagtgaggggacaggagtggacttggctttgagtgccgactgggacaaagagtagccacagggggtgggggtggggggtttaggggcatttggtaggttaaacttccccagaactagctccatcttttactcttgaaagagtttgttgttcagatttaaaatcccttccctgtcctggttccccacatgaatcctctctctgaagtattttttgatttcctgaaaaggaaagaggcagtcatctgccaggtaccggatccaccacaccacctgcctctttggagacctggcctccactcaccagctccagctgaggcctgcccttgctctctcccctctgtccctctcacccctgccctggcctttttttgtcctgcacactagatagtccccaggggactggtccagaggtttggggctcacaagaaaatatctctgcagagaggaaaggaatgagagttgagaatcaaacaatcatttatcttttatggaacttggagtgtttcagagatggagggtgtgatctcctcaaaaggcagcttgaattattttctccatcaagtaccttgttccaggccaaaccctgtctcgaaaaataaacaacaactgccccccccaaaaaaaaccagacaaaatatgagaactttagggctggagaggtgactcagtggctaaaagtgcacactcttgcagaggacccaaattcagatgctagcacccatggtagatagttcgccatcatctgtaactccagctccagagtatccaaacccctctcctggcatctgtgggcacctgcactcacatgtgcatacatacccacacatagatacacacacctgtacagaaatagaaataaaaacaaactctgaaagagaaattcggtgtgtagttgcatgagacagtcctcattttagaaagatgcaatgagattagtttcctagggcagaggagatggctaggtataaagcgctcgccacgcctgtgtgatctcagtttgaatcccagagcccaccgagagccagctatggtactgtgtgtctgtaattttagattctacagcaagatgagaagcagacaggagagtcccccagaggtgatgggctaagcctcgcatacatagatagggtaaatgagaggacgaacaaaagatgcatacacacacacacacacacacacacacacacacggggggtggggtggggggggagagaaggagagagagagaaatgatcctagagaaatgatcacagtttggatgtccaagtgatgtcaagttgccatgtgagaataacttggggttaggcatgttggtccacacctataatctcagtaattgggaggtagaggcaggaggatctggagttcaaggccatgataagctacacagggagtttgagtccatcctgcactgcctaagatcttgtctgaaaaacaaatagatgtttctctaattcagtaatttgagaccaggagattgtgagttggaggctagcatgagctatatagtcagatcttggcttcccaacttaaaaaaaaaaaaaaaagattcttggctggatggtggtagctcacacctttcatcccagcactaaggagacaggggcaggcattctgagttcaaggccaacctgttctaaggagtgagtttcagaacagctgaggctacacaaagaaaccctatctcatcccatcccacacacacacccaaaattctttaaatatatactctcaaattctgcacctctcttattcattgttcatagattacttgaagtccacacctaatttgaatatcatttaaaaagcacacacacacacttttatgtgtctctcagcaaaaatgaaaagaaaaaagtatcagttttgagaagcagaaaccattcaagtgttctctgagaagggctggctgcagacagacagacagcagctcagcacatgggctatcacacagtggggaaaacagaagtccacgcagaaagcaagcacaagcaatcaggcgatataatttcaaatacatcctggcaccattttttagaaagctagggaaaaagtcaaagccagtatgggggtgtctgcatgttgaaggaagaaatgtaggcgagaggacagcagacagcctatagatgctgcggtttagatattatcctggataaattcatgtgcccctacttgccttagcagttatcaaggctccctccttctcttgtgaggtaatgcctttataatatcatctccatcaccacgttcttaaaagaacggacaaagtgagcatgaagttcagcgttggctttctggggcctctgtgctctctgggcagctcacgatcctgtctctttgctggaatcttctctcacaccctagaccgtctcttggccactcactgtatctttggctcagctcctacttccacttgtgttttaatggcttcagctgtgctgcttggcaccctcccctcccttggagcagctgtcttctgtcatgcttttgcaatcccctcatgcttatagtcttacttcagtgacccccaaagatgtcctcggatgaagtcacctgtcaggcaggactcagaggaaaatgaaacccttgactgtcttcttctccatcatctctcagcgtgggcctgtctggagtctctgtccaccagagctccccatagcagatcaccaccaggcctttgtgtcttcttcctaaaccttcttcttcccacaatcctcttcctttgtacctcccttctccctccccatcaaggcttattcatggtggtttctcccaggttagcaagaaactcatgtcttaccctgtctgggctccggcaaccacacaccttagactggctagattataatgaacaactgcaacctattgaccacagtttctatagttgcgagtcccagatgatggtgccagtgggcctggtgtctggtgagggatcttgtcacagataccagcatcttcctctgttctcatgtgggaatgtgctccctggagccttttataagggcctcactttattcctgaaggtttactctcatgagctaatctcctgtaagcccccccccttttataccattgcctaagaattagatttcaatttagactttctgtagaaactcacatagttcttagcaacttgttttctcagcattcttacatccagattatccccatctactgttccaatattccttcctcactattggagactcaagatggagacaattggcacccaatactgtagaattccctagaaccacctcctcttatctctaccccctcttgactcctaaacatgacttctttcagctccagaaatcgtgaactatgagccactgggactggaggccgacatgtggtaagtggtggcccgggatccttccaggggcagaaagccccagcccctgttttatggcatggcctttatggtttaaactcttagttgccaggagcagtagccatgcagccagcagaaggcaatgaggcttagatccttggccagtgagagctttgtcagcaggggagggactgaggcaagtgcaggcttatcctgggtcagtctcaactggggtctagagagcagttaagttagctccatcggtccatccatcaacggttccacaggagcatcctatgtcctgggcatgtgtggcctagcaattctgctgtgatcaattcattacttatttaatttgaccactactttacagttgatgtagctcatgactcagctttctaagaccctgctcgctgtcctgtgaggttgttcttattcttatactcattatataaggaaggtgggttcagtggttaagggatatgccccgatgacagcggctgcaaatatagaagaagtcagaccctgaatttgggtccttgactcaattgcatccttgtctgctgcagaatctggtagggaggagtgggacttggggtggcagtcaggggtcacctgggggaagcaagcgacttcttgtacctgcatggtaactctctggagggttcgaggttgaaatcacacagctctgacacagctctcctttacaggagcattggagtcatcacctatatcctgtgagtatctccagctttgggccgcagccctgctttgcttagtgggagggagagagggtcggagaggcatctggagacctgttaagtccacacagtgcctgaggcagagtgctctgagctcaacttcctacacttgagtagggttagcctgggagagctgccctccctcctacacaggtcacgtctaaatttctttgtggtaaactagggctgctctgctcagctctgcggaccacacatgtttactgcgagactgttactttaccagaagccctgagggtgcctgcgcctgccttctttcctctctttctcatccccagactacttaccctccctctcacactctttcccttcctccccccacccctttcttgtccccttgtatccagtggcttaagccaagatttcctgcataggtttttgtttgtttgttttgtggactgggtgtcatctggggcaggacaccagtgctgcctctttcagtctctgtgaccgtggacaagtatttaacctttggacctgtttttcttattagaaaaaaaaaaataggagctgcagacttcctgccataagaagtaggatgggagtaagctgccttgtacaagcttcctaggctctgctttggtacacagagcaagttggtagatactcagcccccagtgcttcccagagcttgcccttggtagctcacatggaaaatgccatttttatggcattttcacggtaaaagtcagcccatagccagggccagcgttccacagccggggattgttctcagcagcacaggctgggagctacactgtgactcccgcagtacagctgagggcctcaactctgtaggtcttttaatacctactatggcccagaccccacccatgtcacccaccacgtccattaagttagaatcacgagggtagggccatggcctcagtgccttttaacaacttagctgagtctggtgcagagtaaacagccatttctctgtaactccagagctagagattttgtcacccgtttcttcttaaatcttgggtttctttagaattctagtttccatattgaactattaaggaattctacagcacacacagtcttcttatgactccttgaccttgatgagacttatttttattttatattactttctttatcattgttttgttttactgtgcagctctggctttaattatttatttttatggtactagaaattgaaactagagtaactgaacataagtcaggcaaatgcacctgctgaattatgtccctggaatcccttaattatttctctttctctcttcctcctcccactcctcctcctcttcttcttcttcctcttcctcctcttcttcctcttcctcctcctcctccttcttggagacttggtacccatagagggttattatgttttatcaatgacagagattcaccaaattgttcaggctggccttgggcttgtgatattcctgcctcaatttccccacaagctgggattatagacctggtgtctattgcccagacagtggtggtccaagcctttaatctcagcactcaagaggcagagacaggtgaatctctgtgagtttatggtcagcccagtctacagggatagttccaggacaaccagggctatacagagaaaccctgtctctaaaaacaaaaaacaaaacaaaaggaaagaaaacctgttctatcagaagtactgtgccagacactcaggatactgacatggatgagagatggatttgcttgtcccgggctctgtgtctgtgggagataccaccctgtgggagcatggaggtttgaatacacttctgtggaacacagagggagatggacagaaaggtagacatattttaactgggagctatagaatggaatcgattccccacataggagaggagaggtgggtgcggacacagtactcttgacacagaccaacttctggtcttatggaaactggagacttgagactcatagagggttattatgttttatccaggccagaaataatgatttatttctatctagaaccactagcatggatcagggttatacaaagcattttatctatttctttttggtgctttggattagccccaaagaccttaaacatgttaggcaagtaagcgctctacccctgaatatggaatacatccatattcgttgcctatctatctacctatctatctattgagatggggtctcgctatgtagttctggctagcctaggactctctatgtagaccacactagctttacattcatacagattcttctcctgcctcagctttctaagtgagtgctgggattaaaagtgtgcaccattctgcccaatcttcccttgatcttttgaggcagactctatgtagctcaggctggcctaaagtctcttcctcatgcttcagtctcccaagtgctggcacaacaggcgtttactgccatgtctacctgcccagtgtgctttacatacatcagatcttcatgtcaattatgtgaagtgggggctgttactgtcttcactttaaatgaggagatggcatctcagaaaggtcgagagctttcctcagtttacacagttaatgagtggcagaagtggattcaaactcagagctttagcgttttccagtgcaccttgctgttccccacactaagaaagcagtaacagggatgagaatgacttccaagagctatctggtaaatagaaacagcaagcgtttcagcctaatgagaatatggtaagggaatagaaataaaatccaaggtgactgctctttccaacatgggtcagatgctgtggttagacaaggtgggggcagagcatgggtagggtgtgtgcatctcaagggcatatctgcaaagaggtacccagtgctcaagggaaactcaaatcaagagctggtgcttcaggaggtcactgtagggtacatctagccctgtggggatgaaatgttgcacacctgtgcctctcaagctttgctcgctcagtctggaagttctgcctggagccactctaactgctggcagcctattcattctttaagataagagtcagtgcaaacttcagccaccccctgaaagctgtatcgccccacttccctctgctccccaggttctttgtctggctccttattgtatttgactttgttctgccaaggctgtttctcttctttgagctctgagtccattaaacacagtcccctgaagtcaggtactcagttgggggtttagaaagtgaactgggttagactgcactgaaaaatctgttgtttggttgcctggagcgagcaggctgggggttcccaaggcttttcctccggtttctctctcctttccctcagttacacagttctttctctgttgtactcagtctaagtggagcgtcccccttcctgggagacacaaaacaagaaaccctggcaaatatcactgctgtgagttacgactttgatgaggaattcttcagccagacaagcgagctggccaaggacttcattcggaagcttcttgtgaaagagacccggtaagaggatacagtctggtttctcaaagccgtgcccgtctaccctcgctttgacgcccaggccatgtagtccagtctgctcaggtgctgagaagtggccgtggccatgagtaggtgctcatcctgtcatttgattttgtgccttcatctcctgccaacatacaaatgtctctgtctacatgagcatgcactcttgtatgcttgtatgcattgtatttggatatcagtgtaaagtcttccctacacatatgcaggactctgacttgaatcacagtaaactatgaacattttgaagcctattcaagttgagagtggaggcaggcaggcccagagaggtcagaatagtgggagagatgagacatactagtccttcctctgcttcggggcccaggttgagccatgaagctgtatggccaaagacaggggatgggcaagaatctgtgtagtgagctatgacttatctgtgtgagcatcagagaagggcctgcatggacaggggacaggtccacagaccatggtttcacagacttcaaagagaaccagagtggggtcctgtggaatgcagacaccctgatttccctatgtagggcagtgctggggttggggtacctacctgaatgttgagcagtaaaggatacaggagagagctgactgctgctcccagaagtgtcctcatgggtcatttgtcttccccgtcctcattgcaggaaacggcttaccatccaagaggctctcagacatccctggatcacggtaagggcatggtaatgagccctagtgggcaggaggtccctcttctgccatcagggctggctgtggcagtcggatataatcagctgttaagaggcctttgcttgagctcggggactggtcaagggtcctcagagggccaatgcttgttcagatggggttgtgctggctccgttctagagagcttgccacgcttgcatgaggccgtgcagtccatgtagtgcaccacaaaagcaaacaagagtgaataaaatagggttatgctaccttaggtttgcatttcgtgggttcagagagcagtgcactaacagggacatcagttaagatgctttttcttataaaatgtaatttgttgggagtcatctctctgtcccttttcactgcagaagttgggttatacacagatctcaggcactgaaaccttgactttgtaatcaggtatatctctttttctgactactaggctctcactacaggaagacgtgcaagtcagtcacatcactttaattggtgctctgtggtcctcaggaatttggtcctgagacagagatctgctatggaagggaagccaaaactctgttaggacaattctgtggcctgttggagggttagggtagaaagcgaagtcccatctaactctgcttgtagtgaagggcccactggttttcagagtctggtgtgaggagcacattgggagtggtggtggggagcacggccctagccctggttccatgggctggattagctgaccgctgaccactctccagaccactttcattgtttgctgggagggcccattgggatgatctcagtgcagatgtgaagggtagaggcctatagatgatagttcaagttcatttactcctggcggatagggaagggcagtaatcttccaggttaggatgtgcctatagcccaaagctagaaagcctcttgggcacctatctactgagtatgctggtatccccagccttcctctgcccgccttagcctgcatgtttcatcccttgagtggatactggcagagcctctgcttgtctgtgtgagctcctattaaattttttgtgtgtgtcgatactctctaatggtcatttatagagctctctgacctgaagtgagcatgcaggcagtgttcctacattcctcaatgtttcttatggtcttgttgtgtgtagggggcagtgctagcctcaccctggctcttcctaccatgtcttaacacgagcagtgaatgccaaagaggccatgtgtgtgccttttgcctgcagcttggactgccctgtggaacacctagtatgttaatattctggttcttctgtctgaacgcctactagtcaaaaggagaagccagagcccctgaacagtggaaggcacaacctgcccagctgaagaccaaacgcctgagagagtataccctcaaatgtcattcgagcatgccccccaacaacacttatgtcaactttgagcgtttcgctcacgtggtagaggatgtggctcgggtagacaagggatgccgtgccctagcaggagcccatgataccctacaggatgatgtggagtccttggtctctatctacaatgagaaggaagcttggtaccgagaggagaatgagaatgcccgccataacctgtcccagctcaagtatgagtaccgcaaggtggagtccctgaagaagctcctgagagaagacatccaggccacaggggccagccttggaggcgtggccaggaagctagaccatctgcaggcacagtttgagactctgaggcagcagctctcagcagacatccagtggatgcaggaactggttggcatcttccagctggagagtgagaacactgatagccacagcctgggcttcatgttccaccgggaccccagtgagtccctatcggagctgctcaacagatcacacgcagaggaagtcctggccggcttgagtctctgagcaccaggatctagtcagtagtgcattctcagggctttgtagaagcatgctgtcttcccctccgccaggtcatccaggtggaaatatcctgcagggtgtgtgtttgcagccttccaccccctctagagttccccagacactggggtcctagttagtggaactaatctgcacctccctcaccagcctggttttctgagagggcgctggcaacgcagctgagctgtggaaacgattagaaaatatcttccctcagcatgcccttctctgggggtgtcttccggccccaggagatgctttatagctgggtaatgatgatggatcggctcacctctcacattccacgtgcgtgccattatgagtgaagatcttgagtaatgatggacatagctaagaataacttgttcttcagggtactttcctgttacagagtcagggctttaaaatacacagagaaaatattaagtttcacttgaattgtcttctcgctcatcaggtctttatgtctgtgaccttactggatgcttaaagaactctgtgagataagaggctgagattataggtcagtttctagagtgcttgcctagaacccacagatccctgggtttgatgcccagcacagcataaagtgggcttggtggtaatatccagcttgatattagagttcagatcacagaggctaaaggtctgactttacattgagaatgaagacaagagacacacaacaaggaggtctttattctcatatactaggcctgtgggccctgaagtgtgggaaaccccagaaggctttgggaagcacaagcctcattggtctcttctagttccaaaactttgagcagcatggggatagtgtgaggtcatctccccttccaaggaagaaggccaatcagtacatccatgcagacagcatgtagagtatggaccctggaccccacatggtactagaagctaggggcacattgtaatgtttcaagtacctccatagcctcacaaattatccaccagattttaatattaaatattatttccaggttagggagaaagccaaaaagaatgtgacttgtcctgtgttacattggtaataacaatgggagtcttctgatgagtctttcattctttctgattcccttaactcttggactttaggaactcactctgtgcttgagagaatgggtggtacccgagttcactcatccattcagacatagttagtaggcacctgccagtttctaaaaagttgacttgagtctggggatgcggtgttatgtaatatcactctggttttctactttctcagagttctcagttgagtgacagattctagcattactcaagaattatacaaatgcagaactccagctggttcctatgctgtgaaagagaaggaggcaacattttaaggcctggagagacagagggagggagaaagggaggggtggagatagagatagagatagagatagatagagatacagatacagatacagatacagatacagatacagatacagatacagatagaattgggttgatctgctcaggcagtcatctgtgaaggacactgggactgtggtcagctaagtaaaccctgggagagagttgtctcctgtaggctgtcataccaaggttctgtgatgaaaagagaaggaaggaaaaacaaaggagaaagaatgcggtatgtatagtataagagcaggtatgtatagtgtagagagcaggtatgtatagtgtagagaacaggtgtgtgtagtgtagatagcaggtgtgtttagtgtagagagcaagtgtgtatagtgtagagagcaggtgtgtatagtgtagagagcaggtgtgtatagtgtagagagcagggtgtgtacagtgtagagagcaggtgtgtatagtgtagatagcaggtatgtacagtggagagaacaggtgtgtacagtgtagagagcaggtgtgtacagtagagagcagggtgtgtacagtgtagagagcaggtgtgtacagtgtagatagcaggtgtgtacagtggagagaacaggtgtgtacagtgtagagagcagggtgtatatagtgtagagagcaagtgtgtatactgtagagagcaggtgtgtacagtgtagagagctggtgtgtatagtgtagagagcaagtgtgtatactgtagagagcaggtgtgtacagtatagagagcaggtgtgtacagtagagagcagggtgtgtacagtgtagagaacagatgtgtatagtgtagagagcaggtgtgtacagtagagagcagggtgtgtacagtgtagagagcaggtgtgtacagtgtagatagcaggtgtgtacagtggagagaacaggtgtgtacagtgtagagagcagggtgtatatagtgtagagagcaagtgtgtatagtgtagagagcaggtgtgtacagtgtagagagctggtgtgtatagtgtagagagcaagtgtgtatactgtagagagcaggtgtgtacagtgtagagagcaggtgtgtacagtagagagcagggtgtgtacagtgtagagagcaggtgtgtacagtgtagatagcaggtgtgtacagtggagagaacaggtgtgtacagtgtagagagcagggtgtatatagtgtagagagcaagtgtgtatagtgtagagagcaggtgtgtatagtgtagagagcaagtgtgtatagtgtagagagcaggtgtgtacagtgtagagagcaggtgtgtatagtgtagatagcaggtgtgtacagtgtagagagcaagtgtgtacagtgtagagagcaggtgtgtacagtgtagagagcaagtgtgtatactgtagagagcaggtgtgtacagtgtagagagcaagtgtgtatactgtagagagcaggtgtgtacagtgtagagagcaggtgtgtatagtgtagatagcaggtgtgtacagtgtagagagcaagtgtgtacagtgtagagagcaagtgtgtacagtgtagagagcaggtgtgtacagtagagaacagggtgtgtacagtgtagagagcaggtgtgtatagtgtagatagcaggtgtgtacagtggagagaacagggtctgtacagtggagattgggctgaggaagagcggagccagcagggctttggcatgttgagttctgcctttgatcctagggtcaccagaaaccattaatggatcttgggctagtgctgaaggagaaactctcagtgggcagcacagaccagattttgatctaataaagtcattttctagaatcctattaggttttttttttaattagcaagctggatcatttaaaatatcacatataataactgtaatcaataccattttagtcaaatataagaaaccataattttaagatgcatgattattttatggacaattaagacagaaaaaaaatcctatcatgggcagtcttctaggagatgcacagggagagggcacacgtgagacagcaccaccacgcagaagagagtggcaaacacacctggcccaactttgaccctagggagagatggaaaaacttggatcaggaggcatagctgcctttgcaacattgctctttgggtttggaccacatcagtgtgagccagaagaacttcaagcatggactgctgtgccccacagtcgaaggctgggtgaccccacctgactcactgaagctgtgcagccttctctccagatgacctgcctcactccaggcccacagtgatgggatgccacattgattaggaggtgctatgatgtctttgacattgcacatcctgggatgaaggaaagactgcagaaccctgtgccttatgctgaagacaaatgactctgcagtcctgtgtgccctgtcatgggatgtcacatacttcttttaggacaagacaccatgaatattaaaggtccctttgggtgcatcagcagaccttgacatttatattgggtttcctaaaatgagaaaagccatgggtgcaaacatgctgggtgaaccttctttgaacgccaaagtaaatgcaagaagatttatgtcttagtcagggtttctattcctgcacaaacatcatgaccaagaagcaagttggggaggaaagggtttatttggcttacacttctatactgctgttcatcaccaaaggaagtcaggactggaactcaagcaggtcaggaagcaggagctgatgcagaggccatggagggatgttctttactggcttgcctcacctggcttgctcagcctgctttcttatagaacccaagactaccagcccagagatggtcccacccacaaggggccttccccccttgatcactaattgagaaaatgccttacagttggatctcatggaggcatttcctcaactgaagctcctttctctgtgataactccagctgtgtcaagttgacacaaaactagccagtacaatttaagtgatggctgtgatttgattagggagggtggggaagggagggagagctggttttcttgggttggtggaaatctgctactctgctcatgctgagagggtcctcagaggggacctccccaggactctccctctatagcagtttatggggcagcactcatccaaggtcacacagctggtcagcctctgggctggcacagagccatagtggtttccttccgtgcagtgtaattgtcctctgtgttcagtcatgagtgtgacagtgtctcctttagctgtttcataaccagacccttagctggacaaagacaaagttaactgagaaaagtacccaaaggctttcagggaacttagagaagactgtgactttcctatgtcgcctgacacacaaactcctttctcctaaggtatcacaacctggtgtacaggggtgtctgaagagacctatgcagggaatgcagccagtgaacccacctgctcctcacaggctcacagctggcattttaatagccacctggagcacagcactgtcaaggcaggatttgggacagggagtagagtgcctcataggacctagaggaagggagccgggaacatgggacagcatactgctctatgagcctctgccaccactaggatcttctgcatttaggaagggtatacttatatatggggttacacatatgcatatgggtacattttatacatatgtttatgtttgtggaagccagtggttaactttggttgtcattcctctggagcaaatcttccttggctttatttttctggctgtatagtcctggcagacctgaaactcactatgcagaccaggctggcctccaacagagatctacctcctccgcattgggatcaaaggcatgtgctatcacatctggctcatccaccttgctttttgggacagggtctctcattggggcaacttagaccaggctggctggccattgagcctcagggatctgccgcttttggcctccaaggcattgggaatacaagtacacgcccctgagctgggctttttacctggggatcaaacttggatcctcatgcttgtgcaataggcactttgctgactaagatgtctcccggaccctcatgaaggagttttgacttaccagactttaaattaaagcttggcttcgtgctcagctcagacatcattgagtctgtcaggtgggtgggagagtgtgtaacatatccctgaaaagcagttcctaaggaagttgggaggcaggtccatgggcaggaagctgtcctatcctgaagcagatatagccatggctgccctgtgtatgtttgcagattctaaaggctgatgagaaagagttggagcagagcagggagagtgatcagaataggaagaaccagagactcctcctcggcttctcctcctgaggtgacaatgacagtggtagcatcccttcccacagcccagtcagaggtggttgtgcgcccagacataaccacctcatcactgtcaaaccttttagaaatgtctgaggagatgaatggcttttctcctttgtgaaattcttggcctgtggggaaagctcttggcactgaagattaaaactagtggtgggcatactggagtcgcagaggggtcagttcagttgactaaacccccactgtgctctggttctagggcgaggcgagggataagatcatggcagccctgaataagaggtacagtgtacttagttcacggttgatagggagaggtgattctttaatgatgtagccactggtaaacccacccaggctcatgaaaacaaccctcatgaatctcactgggatacacacacacacacacacacacacacacacacacacacacaaacacacgagaggcattagttggaaagaggaaggggattagtgaaagagtggagaaggattaatgggtaggaatatgattgaaatacataatgttcatgtctgaaaatgtcataatgaaaccctttattaaatataattaatatatgctaataaaaacatatttgaaaatacctcaaagtggaaaaaagattcagtatcagaccaatgtgatccaaccaaccgggaggtgggagagacttggtaagttatcagttagaccagtggttctcaaccttcctaatgctgcagctctttaatacagttcctcatgttgtaacacccacacccccaccataaaattatctttgttgttacttcataactgtaattttgctactgttatgaatcgtaagcatctgtgttttccagtggtcttaggtgacccctgtggaaaggtcactggacccccaaaggggtcatgacctacaggctaagaatggctgagtgagaggtatacaatacagtagagatgttttctggttaaggcagtacatgaaggacaacagagtctgcggagatctggggagctgccccttcatggagacacctgcctcctcctgtgtccttaaggaaggtactgggtagaatctggagatctgtgcccagattgggtcaggagcttggaattgagtgaaaggtgaaaaagaaagggtacagagattaaaaggagtctgtaactttttaaagggaaaattctcaaagtgtatgctcaagtatagaggaatggaacgctgagttatgtgtgtcacacctgctccagcagggagccagtccatggccctcacctcgttcatctcctaccaccccccccctcccacacacacacacacactttgtagacatcttactatagtccagcctgggctcagatccacacttctcctgccttagctgccaagtgctgggattatgggtatgtgtccacaagcctgcaagacctttctcgggtgccttctgctttttgtttgaggtagagtcctttctcctggatactcaccaggaaggccaggctccacctgtctcctcctcccatgtcactgtgactacaggtgcccatactcttccatgggttcatggttgaactccaatcctcatgcttgtggggcaagcgcttcaccaactgagttgtcttctttgtgtaagcatcgtgtcatcattatacctgaggacatcagtgattccttgtctcctccataaacctaatccaccctcacgtgacaagggtgtctgttacatctatttggtttattcatattaggacccaaccagagttcacacgtggcatttagttgaaacctttacattctcttaagggaatgggggtggggtggggaggcgggggtggtggtggtggagagttttggaaagtttttctgtttttgtttttgtggtttttttcaagacagggtttctctgtgtagctctggctgtcctgggactcactctgtagaccaggctggtctcgaactcagaaatccacctgcctctgcctcccaagtgctgggattaaaggtgtgtgctgggctttaaagatttacttatttattttatgtatatgagcacacccttgctctcttcagacacaccataagagggcatcagatcccattacagatggttgtgagccgccatgtggttgctgggaattgaactcaggacctctgggggagcagttggtgctcttaaccactgagctatctctccagcccccggagaagttttttttagagccaaaaaaaaaaaaaaaaaaaaaaaaaaaaaaattgctcagaaaacagaaaggcctggtaaagaggattagaacaatgtccgtgtctctgtcctaaaactaccagaaaaatgaggctagaccaagctcggagaggaacatctacacttctcccagtggtgggtggctgcggggtgagctcccgagcacccaggctggaggagatgggttcattcacaacattttcacctgcatcttcctgggaaaataggtgcttgccaacaggggccaaggcccagccagcaaaaggaagggaggaggtgccccttggaggaagacttgagctgagaggagggaagtctaccaggcccagagtgacaggagagagaaagtgggtgctcctggtgttctgtggagtatgcagcttttgggatggcacagatggagacctgaaaaccacagtctatttgcagctcctatggaaagcccgagacagagagaaaaaaaaaaaaaatcgctggagggggtggctcttgtaaagcccacagttcctttctcacatcatgagggtggctgctacagctgctttctctccctgctctggggtgccacttcacacccaaggacacacccctgggctgtttcagagacatttgcatctgtgtaaacaaaatctgaatcctacctcagctttctgttttcttgcctcccttttcgacatttttcctcccaagacaccaaacatccttgggagcctgggcaaaatgacctgggctccctggatagaggcagaccacagaccggaagatggacactcactgtctttttgaagagggaagagctagaagctggcacagtttgttcaaccaaaacaatgccacattccttctgggctcgctacagaacctctctctcccattgactttccagactgagactacatcagccttttgagagactcttagcaaccaaggagcctgttatcgagggaaggccagcctaacagattcaaagcttaggtggccttttccttggaactcgtgtggttatgtgtagcatagagagaggccctagaagtaattgtcaccttctgttgatggccctgggcacagctccacatgacatttcatctggccctctctgggctatgaatgacactgttgaaccagaaggaagtggtgttttccttaataggatttccttttttctgcaggtggtttctccagctataggggctgggggtcagggttgggaatcagccctttctcttctacccatcaataagtacataagaataagtcctttttctccctgagtctagtgtttcaaatttccttatgaaaaacaaatacactttaccagaattaggttcaaaggtcatttatagctgagtgaattgtacctccaaatggtattacgatagctgatcaaagtgccctgggcctcttattggtgggtgtgagcatgcctggatttaggattttttaattatatttgtttgctctgtgtgtgtgtgtgtgtatgtatgtgtgtgtgtacatgtgcatacaagtgccccatatgtagagatcagacgatgatttttttgtcacgtggaacctaggattgaactcaggccatcagacttggcagcaacacctttacccactgagtcatcttgttggcccaggtcctgggatttcattttagttggtcttgtcagtagctcagggactcagttcaaccacacaactagtaagcaggagtagtattattggcttggggaggagggaagaatggcctggtggtatagacaaggacagaagcaaattccagtgtccacaggttgcttcccagctgtgggaggccaagctgacatcaaagggttccacacacaacaaagaaatgtttgaggctctagtgatgatatctagtgatgatattgctgatatcagaatcagcaatatttcttgaacgatgtgtaaaataggatttgaaatatttgggagtatgaggtacggtatccctggcatgggcctcctgccagatgccaggcccaaagctgtgtggatggttgtgtgcactggcctccttctggtacccatgagggaaagtgagagtggagctgtgctctgatgtggttaggtaggacaagctccgaagagcctatgggtggcctcccttagctctcacctatgacagcatcacaggctgtcaaaacaggaagggaacatctgcaccggcttgagggatcagcctgggcagttgttcttgggtcacagggccctttgagaatccaccaaagctgtcagctgtccttggaactgttgcttgcctggacacacacaaacacacacacacacacacacacaccacacttaattttacttccataatgaatatgtcataaactgtgcaattcggtggctctttttgtttttgcaagattgtatcatcactgtcactctctaatccgagaacatgttcattagcccagaaggaagaccttcttggggctggagaggtgactcggcagttaatagtacttgctgctcttcctgaggacccgagtcctattcccagaacccagctagggcactagctccccctgaagctacagggagttacaggcaatggtgagctgcccaacacgggtgctgagaaccaaactcaggtcctttggaagagtagtacgtgttttgactgccaggcagtgaatgacaactgtctgtcttcccccacaccctacacccccagcccctgccccatcgaggctcctatttccttctatttctaacactagaggagtatcagcagtgccatacctgccaataggcttgtatttcaccaaagccagagccagcctagtgctccctgccataaaatgaccccctccacaaagtgatactgatgactgctgcttctagcttttctcagttagaaatggtagtcatgttagtctctctctctctctctctctctctctctctctctctctctctgtgtgtgtgtgtgtgtgtgtgtgtgtgtgtgtgtgtgtgtgtgtgtatgtgnnnnnnnnnnnnnnnnnnnncatgtactacattgtggtaataatagctcagagacattcaggataccttctgggcagcgagacatttgtagcttcccccttactgtgactttcccactgcatgccttgctggagaaggaggtcagcggcaggctgagggacagtgtgcagtccaggattctgtgggggaagtgggtaactgccatttgaagcccagttgacaccatcacgctgtcttctctctcagccggtggacacccagcaagctatggtacgcagagagtccgtggtcaacctggagaattttaagaagcagtatgtccgcaggcggtggaaggtacgtcagggcctggggtgaagggcaggggcctagggactccctgcttctccccagatctccgtctcagctagcagtcctctcttctcttccctcagctgtccttcagcatcgtctccttgtgcaaccacctcactcgctccctgatgaagaaggtacatctgaggacaagcgaggacctggtgagtacatgcagagccctctgcttgggcacagctcctggattgtaggtgtggagggggaggatattaactatttctagcctgttctgtaagccttgtcctcttctgccctgaaggctgaagtgtgaccagcagggggaccattaggaaccctttcctatgggcttcctaagagttgccattccactccccttcccaccccttcctgagggctagtagaccctgagaactgtggaaataggccccatagatcatccaaaatttattctggccaagtataattgtacacacctataatcccagcgcttagggggtaaaggcaggagggtacaggtgacatgagaccctactgcaaaccatgccacctcaaaaagtccatttcagacaatcctagctcctctgtacaatgggtgctttcttatacctttcccaactttccctattttgtcttagactgcctatatcagcagcatttgatgatatattatacttattatagtttttttgtttctttatttaatgttttcatagtactaaggattgaacccagggcttttagtgtatgtttaaaacaagagacttataatggaatatactcatcaagagggtggcctctaaagccagttttccagaattcagatcagccatttccctgctgtgtgaccatgaagaggttacttaatttctctgttccaaaatgtcattatttgtaaaacgggggtaataatacttgttacattgttgggtagtgattaagggtaaatgaggacctgtctccaatgcctggtgggtaagtgctcagtgtgtattagcaatccttaatgctgcttaaaatccttctgtagttctcgaaatgggcatcagcattagcttttcagttggtaggggttccctgagatagcctctccctcatgattgagtggagagaacaggagtgtccagaaggtataaatttatatattcatatatagttcatatattccaggcacagcaaaggcctggaaagcaactgcctgcagccgccctgtgtaaactgaagctgcttagcactgggcctgcaccccagcacccagaatatccctgtactccccggagccccaacacgtcctcaggggtcttttttccatagactgagctcttgtttattcctgcttttgccaggactttggtagctccagaggcctttgtggctgagtccctcttctggccaccagcctcatggactataaagggaactgacttggcaggctctgaggatccctgtttgtcacctgcgagtttacacagcttactcttttattgtttggttctgactcattctaaaaagttgctgttcagcaaagcctgagttatttttgttgtcctagtcagagttggtccaggatgtattggctaagttgatcttgacctcagatttcccactggctcaggcttgcctgcgggatgtatgacaggcagcaggcatggacctagatcttggaccttttgccttgatgtgatgttgttgaagaaagggatgtaaaaatatttcaatttctaactttttcatggtgcaaaatacagttttttgttgttgtttttgtttttcattttttactcagacacttacatgttatatggtttttcctattgaaccttccttaaaataatgtttttagaaagatgacatggccttctgtttagaaagcatagaaattaaacatttttagacttttaaaaatccaaattattcttttaatagtttgaattaactgcagctggagagattgctcagtagttaagagtgcttcctcctcttgctgaagacccaggtttggttcctagcacctacatggtgactcacaactacctgtaactccaattccaggggattcaactccttcttctggccttcatgggcatctgcatgcatagtatatatatatgtgtgtgtgtgtgtgtgtgtgtgtgtgtgtgtgtgtgtgtgtgtgcatgtctaattaggcagacagacaaaaaatttaaaaccttataagaacaaaacccctttccaacattaatagtgattttaacacttagtttaacttggtgggaccagactggaaagacattgtaacatccaggtggttgctccagcttgccttagctgtgtgggagctgacaggttacattttgttccactttcatgaaagtggaactcagaagtctttcccttcagattgctttgcatgaagcttgctgaaggcttggtggagaccagcggaggtggagagcctgaaatgatggcctgcgaccttagggaaagaccaaccacttccccatagactgagctcaggggacccagtgtcccacaaactacctttccaagaggccttgattattgactggcacaaatggtaccagatggcattttcactgctataactgggcccctcctggtacctgtttccccagggatactccaaggaggaggccccaaggcagctagtttggtcccatttcaagtccccttcctattcctgcatggcagaggcctctggatggagctgagggcttcctttgacatcaccccactttcccagcttatcggccccttgcttgcctctctgagcgtggggtgctcagtgtggcttcattcatgtcatctgatgatgccctgccctgggcctctttttctcctccccagaggaactgcgagagtgacacagaggagaacatcgccaggaggaaagcccttcacccccggaggaggagcagtacctcctaactggcccagcttgcagtggctgccagggaggtccaagttcctgccgccctgctgtgcaagctcccggaccctgcttgacatcaggatccagacattctgtgttcctgagcactttgcaagagagaggagtctgcaggactcagaactttccggagaccctgggagttgtggctgtctcccggtggggaacctccagcattcctctggcttgtagttctccagaaaactggctttcatctgtctgctaacctcagaagctggaattgggtgtggactaaggaaatggatctcaaggagtatcttttttttttttaaccacaggttaaaggtcagatttaggcagctttcctcacagagcctaccctgtcaagctcgtgagtaaagactctctagagggagggaccaatcctgtgacttaacagaatccataaggagtcaggctgtttaacgtcagactgtgtctgccagcctcttgccagcccactgtgttgtaggttttttctcatttttattattaaatttcttgtttatctaatgcttgggtgttttagagctgtctccctctggttccctatagcccgagaccccgtggcttggggaacactagggttggctgctaagtggacagaacctcaggtgatctgagcagtcttctcttactgataagatgtggcccttgtgtgtcctcccttgaaagtgtccccctctggcaccccatcacaaaaggccatgacccatccaccactgctgctgtcagccctcctgttaggggctgacttttagcccccttcctcccagtcctcagtatcacagaccgtcaccactatcactagagatagagtgataagtagctcactaaattacagtgaggccatccaggtaaaccctactatgatatgattaatatccttataaaatggggaggactggggtggagagatggcccactggttaagagcaatttctgcttttgcagaggactccatttccagtgccagcacccacaaagggcaccaggcacatggcgtttatacctgcatacggacattcattcaaacacataaaattaaaaacaattaacaataaggggagatttcctctgagcatggtagtgcatctctgtaatcctagcactcagaaggctaaggcagagggattgccatgagttacagtccagactgggatgtcagggagatttatcatatgtggagctgcgtacctttaagtcctaactacttgggacactgaggtagtaggattacttgagcccaggagttaggaacagcctgggcaacaaggaggagcagggggaacaggaggaggaacaggaagaagaggaggagataagatccaacagaaagaacacacgaggacactgctagggagaaaggcctcaaataaaattttaaaataaataaaaaataaaaaggcagctgctgggtgctgtgctggatgcctgtaatcccaacagttgggaggcagaggcaggaggatcatgctacaaagttgaggccacactggtctacacactgagttccaggctagccagagttatgtagcaagaccctatctcaaaaagccaaagggtaacaacctccctacgagagcatgcctctcgcaaaagatctccttcatccctctccagaagaggagaagaagaaacacaagaaaaagcacctggtgcagagccccaattcctactttaagaatgtgaaatgcccaggatgctataaaatcaccacggcctttagccatgcaccaacatgtgttggctgcgccactgtcctctgtcagcctacaggtggaaaagcaaggctgacaaaaggacgctccttcaggaggatgcagcactgaaagcccctgattgaagatgagtgggaaccttcccaataaacacgttttggatatatatttaaaagaaaaaaaaaagccaaagggtagagtttggggcccagtgattaatccatgctgaatctcagacagctggccgtcattgggagaaaatacatttctgttgtttaagctatttagtctctggtgctttgttatggcagtgctagcaaatgggaatttttgactagacagaggagggcaaagaagcacccacagggaaaaacaggaagagaaaaatgagtgaggccagtaaggaaatttactgcatgcaaatccaagacatgcttttctggccagaagagtggccagagaaaggcaagtgtgttgtctaagggcaagtgtgttggaaagaaaaaaaaggaactctggaaggttagtgaaagagttgagccaggaagtacagggtgtgtgtgtgtgtgtgtgtgtgtgtaatgtatgcatatatataatgtaatatagacatatataacacttttttttcctgactatatgatagtaataggattccttagctagtctgccttttaaataccagcagctcagagagagagagagagagagagagagagagagagagagagagagagaaggaaagaacaccggtgagtgtggcattaatcccttttgttgacagtaagggcttttgttgtttgtatcattttttcacgttgattgattgatgatcattgattgattgattgatgatcgtgtgtatggcagtgtacatgctctgtggtccatggcgtgcatgcggagctcagaggacacttgcaagaatcagttctcgtctactatgtaagtcatcctggggattgatttcaggtgatcttagttgtccagctggcttggcagcaggcacccttatcagctgagccctctagccaatccttggtttgttttaaaataggattttatgtagcccaggctgcccttgaactctcgttcctcctacctctatcccctgaatgctggccatacaggtatgcaccatcaatactcaaggtgaacagtaggtctcagtcacactgtgtgagactcacccaagctcccttcatgctagagatgcattcagaacaaaatggtcctcaaagagcagaaaggctttatttccagaaaagctcacagcaaacagaggccacactacccccacacactgctgagtcctgtggcctctccctgctggtggatggatgcaggagtggaagaacaagcccaggggagacaggtgtgttctggccctgagggaggaggcgttgccaagccaacacctcaaggctgagaggtcacagcattctttgaagaaaagtggaagaccagagatgaaaaccacattctgtgagagcagttctttgaagagctctgaggtgcctctcccaaaagtctgcctgtgtgcttgctggatgccacgttaatagcccacaaacacacatataaatattttagcacgcactatgttgtaatcctcatctcacaatcttccttgattccagatctcagattccatttgtcttttccattcatacagttatttgcccatcagacaaagcaaacaaaaactcccagcatatgttgaaagcaaaagaaggtcacatttaaataagcaagtgaaccatgagatctctggaaagaaactccaagccccgtgctccctgggaaatcaaagcgagtacatgcggaaaactaggttgttgaaagggacagcaactatcacaggcttagagaactttctttccatcagccccacccccctctgctcccggtttgatgtcagccccatactgttctattcacagttgctgcaacccccaaaatatcgcacttggcatctgttaagaaggtccggttctcggcaaaccttcacaggcttaggggctctaacagtagaaaggcttcgaatggaggtggttaattgctgtctcaaaggcaccagcacagttggtgagcttccttcaagtttttctgggcttgattgtccctccctcccacggttgccctccatcagaggcagcagcagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaatagcagaacccagggaggcggcgattgtgagggacccgtgcgtcagtgaggcattctctgtagccctgcgcacaaccttgtaagggaagtaagctccttttttaaggatgatgaagccagcctcagcaaagttaagaactgtgcctgccttctcccagctggagctcttgggatctggactccagcccagatttgcctgccctggattcacattctacttttcctgggggtgggggtgggggagtaaaaaatgaagaaaaaagaaaaagaaaaaagaaaaatcttggagaatcacatgcagtacaatcctttttttaaaaaataaaatgcaaaatctatactaataacattgtattttagaagcagagatgacttcagtaaaatggggggtggggcaaggtggacagcggctggtgttcaggattctgcttgtttggttttgtttttgtggcactgaagattaagcccaggcccttgaatgcactagacaagcattcaaccactgagccacagccctagccctgttgctaggactcggtgaatttccctcactctgtttccttgtttttattggtagtattgcattagtgaaaaaatgtcaaaacaaaatatctgggtctgggtgacttaatgcactagaaatttactttctcagctttagacactgcaaggtgtcagtagcgttggctctgtctgagcgtttctccttaatttgtcacaccctggtcttctctctatagatgtctgtcttttaaaaagaaaacaaaaaacaaaaaaacaaggtcaccagttatgctggattagtgtccataatatatcctcatcttatttatttatccctacaaagaccctatctttaaatatagtcactttaaaagttccatatatgggtttaggaggaagtgaacacaattcaggccataaaaataccgtaaacatgggctggggacatagctcagtggcaaagtgctctcttcacatgtgcaaagccctgggttctgtccccagtactggtatagataggtataggtttgaccaacgagagactcagggagagatatctgtgagtccaggcttcgcagcatctgtggcgaccacatcgaactcctgcagctgtctgtctgtgtgacattccaagggatgggactgaggacgctcgagtctgctgagtcacaagactgtgggctctgtatagtcacagttggacatatctcctttcacacacagggagaggaaattgcagtcgggctggctgaccccgcattcttccagaaggttatgaccttagttaacccgggaaggagcggaaacaggaaagctcctgagacctacaggctgacagaggtcgaactgagatgttggccctccccagctgggtcctgggtcattgctttctcagacccttttagtagccaagctgtgggctttgggcctgagggtgcatttcctggttggagaggaaacagggcagacgttcctgaacaactgcagacctcatcagtcgccttcactcagtgctagccctggaaagccccaccagctgtaagagatcatattctggaaaattctccctcccctccttagtcaggcaacaaattacagtgcccaggatctgcttagccacagtgtcgtcaagtgagtctcgcaagcttgtctgatttatgatgtgctactgaaggtactggaagtgacaagaccctccctcaaaagctggaatcaaaccgtgatggtatatgcctttaatcccagcagaggcaagtgagtctctgaaagttcgaggctagcctggtctacagaagcagttccaggacagccaggacatacatttacagagaaaaactctgtcattcatacttatctatatgactaccatatatatgaatactatatatatgacatatatatatgtgaatatatgtatgaatatatgtgcgaatatatatatatatatatatatatatatatatatatatatatatataaaatcagctaccaacgtattcacgtttgacaggttctttcttggctgggcccaaatctatttccccaaagatccacccattgcccccattctgtcttctgcagtcacatgcatttaacacatgtgtagacaaaaacgggaacatgacaggtcctccagaactcacagtttaatgacaggaagaaataggaactaagccaggagctgaggaaggagccttcattctgacggataaggccccagtgagcttttgagatgctcctaaaggacaagatgccttgtgtttgcaatgggtctacagagtctgcagtacaggacccacctgagcagagactcggaggtgggaagaacttatacctcctgaggaggtggggtggtctggtggagtatgctcaggaagaaagcactgtgaagatgatggcttcgaatgtaggcttgagcctcctgggtgatggggaggtgactcttctttagggctgtggtttagatcagcacctcttagtgtggtctctggccagcaactggaaactcgtcagaagtacacattttctagcccactccacctttcctgtattagaagctctgggggtgctaaacaagttgcttaagagattctgctatgatactttagaaaaactactccctagaggctagagagatggctcagttggcaaagtgcttgccttataagtatgagaacccaagttcaacttctaagacagataaggcaatatatgtatgcattaatccgggcactgggaaggcagaaacacaaagatccatggggctcactgaccaaccagcttagcctaattggtaagccccaggtcccagtgagagacccagtctcaaaaaaccaaagagaaaggcttctgagaaatgacccccgaaggctgatctcccgaccacacaagtaccggcacacattggattgggtggggcagcctgtggaggagacaattcagactattgggataagctaaatgggttaggcaaggacctgacctagggagagagcacaaggaaccagacatgttagggttcctctgctacttcacctattagctacccagacgtggacaagacagatgggcctcagttgccagtctttttgactccagtcaaagaaagaatcggacatggaggatggatgtaaggaccagtgggagatacctgcaaagctctcaaatagagagaacaactgcctaagtttgcctgaacctgggcagtttcatgggacagagttccagaagacgaagatggagctccaggcaaaaccatggtcaacgtcactggatccactgcacctgagaaaaggtgagtattccctggcccccaggatcaggcttgctgactgttgatgtaacctcacagaagaggaccttccctgataccatccacacctcccagctggctgtatgcaattctaccttaattgcatgaggcatgaagttccccatggtatataagctgaggaagactgaaagacatcccgtcgaggtgactctggaaagtcatcacctaagcttggcaaagtcttggcagtgtccctgcttcaagatcagccactattctgccagtaagcctcagctgtgctctgtgagaaagcccaataaactcatttgttcaccagagtgaatgtggttggaactgtgccgtgacttacctttggggacttatgaagtgggaagagatgtttatattccccagagaagaactgttctcaacagtggcaaatctagggatgtccagtgcagggctggacttctggtcaccttaccccatggcatgctgtttagaaagaagcgtttgttagggtgtttgtggaggaccaagtgaaggatggagttcttggagagtcccaagttgattctcaagcattttagtggcatctgaagttgcctgtctctcttttcacccatttctggtgcctgttgagcttagcagatgctccttctgcagcccttcccatggcctggttatgcagattggcaggagagaagaaaggcccagacaagggcataaagacagcacttcctggctgtgctgctggccaggtgcctaggtcacctgaaatacaataaggctcatggctctcagaccttgctgatgctgctggaagctgaaaatacccagggcactggcctgatgcctgggtggctcctctgggccaggagtagctatgatgtctccactgggttcttggtacttcagcccaggcctctgtgggggaagggcagggccacacctctcacctttccaacaggttgagtattttaaacagaccaggcttttttgtcctttatcctaatacttgtccagggggaggcaaaactactttaccatgtttactcaactgagagcatcaggcagaaagatacttcgagagttgaagttgccaagttgacaggatccagaatcccctccagacaaatatctgggcgtgtcagtgagggagattctagtttaggttaactaagatggagaatcccactgcagctgtggatgctattcgtggggctagggttctggactacataacaaacagagatctagttgaaccccagcatctgtctgcctctgcttccacacagcagacacagtgtggccagccacttcacactcctgcttttatgcctttgccacgatgcactgtatcccaactgtaagtcaaaatagaccttcttctatttcttctccttcctttttctttttttttcttttgagacagggtctcactaggtagccctggcaggcaggtctggaattaattcgcaatatagaccaagctgcccccagactcacagaggtgtgagccaccatgcctagctttaagttgcttctgaccaggtgttaggtctcagcaatgagaaaagtaatttgcatatgcctttacaggaaatgagcacagacattctgaaaccacagcaaagcctttcttggtctgcatgcacatccctagatcgagggaggtagggggaccaggataaattgtgattgtctatacctaaggcttagtgccttagagcctagggcacaattggttctccccccaaactgctaggaggcagttgaggtctttactgagagaagggcactgatggaggggtgtagtgcctctctccatgcccactgctgggtgatggtaggcaatgtctcttacctcctcctcactggacactggcccaggaggtgggcttccctgctcctccaaagcctataggtacttacctctgttccctagaaagtgtctcccagaaggatgtgctggcatgtgtctttaatgtcagtacttaggaggcagaggcaggtggatctctgtgagttcaagatcagccttgtctagatagtatgttctggcaagggctacatagaccggtttcaaggaaaaaaaaagaaagaaagaaaaaagaaaatatgaaaatgtcttccaggctaggtccacggtactgatctgaaaaccctggcctgagagtcaggttaggtctcagagtttgaatgacatttctgacatcttcttagctgggtgattatttatttaccaaggtattgggcctcagctttcccacttgtaaaacggggcatgccaatatcttccccgcagggcttctatgactattcggttggattagctaaagcatggcggcacttagtgtactgcactcagaaagtggcttctgtcctaacaactgtgctttatggactagcttaaaacaaattcatcagtgagtaggctggatggagcaaatggaagaaggggatggagttcccatggtgttgtttgctgcctctgccaaccattctggtgacatgtgatggtatgtgatgagcaaggcccttgacgtgacatgcctcttgtttctcgtcctttggttttccccagtgcatgctgggggccggcccacatcctgaacattctgtgaagctcggttggttaagaaacctcactgcccagctgcaaagcaccttcgctttccgcctgtctggccccttcagctgcctatggccaaatgcaaaggagccttgctagagagcagcagcagctgctgccttcttgccggtctgcctgtgcctctccactccccccgcccccaccctgtggtttgcattctagaagcatctgcctcacaccaggtctttattgccttccgttctcacagccatcttgagaaagcttaggaaactaaggcttccaggggggttggcatttgttttgtttgcattcagagacaagggctcactatgtagcccaggctggccttgaacttgcaaccctcctgcctcagcctcccctgagctgggaacccaggtgtataccatgcccaaatatttctgtctttttgctttctagatgtcatatatgagcagcttctgtcatgatgtctcaccacagacccccaaggcagcagaggcaagcagccatggacctaaacctcccagactgtgagcccaaataatcctttcttctttttctgttgattatcatagg

SEQ ID NO: 1832 - DNA, 1592 bp, Mus musculus
gattgtatggtccaggcctcgatgaggagcccaaatatgggagacgttcaaacagcagaagtggccagtttgccatcgtgaagaagtgccgggagaagagcacggggctggagtatgcagccaagttcattaagaagaggcagagccgggccagccgtcggggcgtgtgccgggaggaaatcgagcgggaggtgagcatcctgcggcaggtgctgcaccccaacatcatcacgctgcacgacgtctatgagaaccgcaccgacgtggtgctcatccttgagctagtgtccggaggagaactgtttgatttcctggcccagaaggagtcgttaagtgaggaggaagccaccagcttcattaagcagatcctggatggggtgaattaccttcacacaaagaaaattgctcactttgatctcaagccagaaaacatcatgttgttagacaagaatatcccaattccacacatcaagctgattgactttggcctggctcacgaaatagaagatggagttgaatttaaaaacatttttgggacacctgaatttgttgctccagaaatcgtgaactatgagccactgggactggaggccgacatgtgtctaagtggagcgtcccccttcctgggagacacaaaacaagaaaccctggcaaatatcactgctgtgagttacgactttgatgaggaattcttcagccagacaagcgagctggccaaggacttcattcggaagcttcttgtgaaagagacccggaaacggcttaccatccaagaggctctcagacatccctggatcacgccggtggacacccagcaagctatggtacgcagagagtccgtggtcaacctggagaattttaagaagcagtatgtccgcaggcggtggaagctgtccttcagcatcgtctccttgtgcaaccacctcactcgctccctgatgaagaaggtacatctgaggacaagcgaggacctgaggaactgcgagagtgacacagaggagaacatcgccaggaggaaagcccttcacccccggaggaggagcagtacctcctaactggcccagcttgcagtggctgccagggaggtccaagttcctgccgccctgctgtgcaagctcccggaccctgcttgacatcaggatccagacattctgtgttcctgagcactttgcaagagagaggagtctgcaggactcagaactttccggagaccctgggagttgtggctgtctcccggtggggaacctccagcattcctctggcttgtagttctccagaaaactggctttcatctgtctgctaacctcagaagctggaattgggtgtggactaaggaaatggatctcaaggagtatcttttttttttttaaccacaggttaaaggtcagatttaggcagctttcctcacagagcctaccctgtcaagctcgtgagtaaagactctctagagggagggaccaatcctgtgacttaacagaatccataaggagtcaggctgtttaacgtcagactgtgtctgccagcctcttgccagcccactgtgttgtaggttttttctcatttttattattaaatttcttgtttatctaatg

SEQ ID NO: 1833 - protein, 350 aa, Mus musculus
LYGPGLDEEPKYGRRSNSRSGQFAIVKKCREKSTGLEYAAKFIKKRQSRASRRGVCREEIEREVSILRQVLHPNIITLHDVYENRTDVVLILELVSGGELFDFLAQKESLSEEEATSFIKQILDGVNYLHTKKIAHFDLKPENIMLLDKNIPIPHIKLIDFGLAHEIEDGVEFKNIFGTPEFVAPEIVNYEPLGLEADMCLSGASPFLGDTKQETLANITAVSYDFDEEFFSQTSELAKDFIRKLLVKETRKRLTIQEALRHPWITPVDTQQAMVRRESVVNLENFKKQYVRRRWKLSFSIVSLCNHLTRSLMKKVHLRTSEDLRNCESDTEENIARRKALHPRRRSSTS

SEQ ID NO: 1834 - DNA, 152330 bp, Homo sapiens
  misc_feature (1)...(152330): n = A,T,C or G
tgtcaagaagactgcatttcagactgcatttggcaattctctgggccaggctaggggtgggatggggcgcagagatgaataagatccatttcctccccaggggagcttattgccagacatttagggaataataataacagttaataatcattgcggactttaccaagtgccagacactgatcgaattgaaaagtaactgcatgctcacaacaacccaagagataaatgctactataagctccatttgacctatggggataatgaggcacagagagatcaaatagcctgccccagaccacatggcacgtaagttgcatgctgggatgcctgagtgtgggcccaggcagtctggcatcagagtctctgcatttagccgtcacactacacatgctgtaagccaacccaggtgccatctgccatggccaacatgcagcatcttaatccccaccttgcccccttgtcaggaggtttttaggctctgtaaacttgccaggcaccaaagtatgctttaggatatcaccatgactagtgccctttgctgcctgccatggttacatctttatctatgggcttgtattctcatccctgggaagcacaggtcctgtgactctaccatctcacagtcccttggaatgtcttttacaaagcaggtactcagatgtgtttgtcattgagggggttgagaatttccctaggtctctgtgacatgaacagactgggtctcaacctgtgcactgggaatcacctggggagtttaacaaaaactgatacccagaactcatcctcagaggttctgatgtaattgatgtagggtgcagtctaagcatgggggattttaagcaccccatgttattctcagttattctgatgtactgcctggactgaaaagttccagattaacactgttttagaaatcttggaagtttcagttgagggaaggcagcagagggaatagcttcagagaccagtaggcaagattcatgtcacagctcagccacttacaaattggatgagtttgagcaaatcaaatttctcaagcctcagttacatcatctgtaaaagaggataatgacatccccctagaagtgaagcacttgaagtaagattattgagcatctactaagtgccaggtgcttgggtgctcttaggggacaatagaaaacaagacagctatggccccttgtgatatttaccttccttaattcagtttaagaaacctttactgggtttgggatatcaagcactgtatgggttcaaagatggacaagaaattgtacttgcccttgagaaaaggagaagtagacactaattaaaatagaggaaggaagatgacaagagatgtaccaaccaagagtggtgaggttcaaaggagagaggtatttagagggcagaccagggaagtttctgtggaagacatgatactttagaaggctcttagaggatagataagattttgtagaatgggatgaagggtagtggaaacgaacaaaagcatggaggcaggaacagccaataatccaacctggcaaaagagctggatgtgcatgcagaggagggaagggaatgtgcatacacagcaggaaaataagggttggggccttaaatgctagggtgaggcattaacactcgatttggtcagccatgggaaccatgcagggactggaactgagttggataattcttagctcttaatacctggactgcctctggcttcattctggaatttgtgtcttcattgccactgtcctcggggcctccccttttctgctgatggccaccttggtcctgtgttcagtgccctgtcgctgccctcaggtgagggtctgatgaactcacccaaccttaagcataagatgcatctccagatggtaccttcctagatagttgcattctggcaggtacagtggaaggggcaccagactgaatctggaggaggcctggttctaatcctagctctgtctctcaccagctatgtgatgttgggcaagtcacctcccttctccgagcctcagtttcctcatctgaaaagtggccagggtcaattgacaatgacccttccagctgcaatggactctgactaacttgtcaattgctaaacccaagaatgtctcttttgactcatgtaaggggctgctgctgctgacaatgaggtattaagcatgaggctcaagggaaagagatggagaggccacatgtaggtgatcagcagggtcagctgagcccagccttggattcatcacagcccaggtactgggtatgagaatggagaaatctccagatgatttcagcccccagctattcaggtgttcccagttgaaatcccagacactgcagagcagaaataagccatacacactgtgctgtctgaacttctgtccctcagaatgcatgaacatagtgaaactgttgtcctgtgccaccaaggctggtaatggtttgtcaccagtgataggtaaatggaaatggaggaagaggtgtttagggatagtttggtgggggacttctcatgttggtgaaacttcaccagtgggtgtcattcccttaggtccattgacatcagaaaccacctctagtcttggatattactctatatatcatgctgctcttaggagaggaggctcgctggctgcactgttctgaattattgtgaagtttataaacaaggaactctttgccgaggatgtcctggacccggaggcactgctcagctggggggtggggtccatctgtatttgtcccaatgtccaaaaggctgaagggtgtgtgtgtgctcacactggtagaggtcctctaggtgcatcttacacactccatctcatctcagccccaccatagcttcattaggagctaccggaaggtgcgtttctcccactttactgatgaagaaagagccatgcccaagaacacacatgcggagtggcagggcagggctttgaacctggtggtaggactctgaatctaaggcccttttgaggagccccatgggtgacttagggatggaaattccaggggttggaggggtcctcatttgcttcctctaaacagcctcttgttttgaaataagacaaatgaacttggcttaagttctgttttcccttccttcctcccttcaccccctcactctcattccttttttcctcagggattttttggcagagggcagagagaggaacccattcccaagtcctctattagagaaggcgtgatggtgagaggggggcttcactcagcaaccgtgccaggacaaagggcaaacgagggcaggccgctctcaggctgggtcgggggcagtgaggagcagagcggcccttctcatcgcagcccccaccttgctgtacgctgtgggcttgaggtttccaggagagtctgcggtgtagggagcgctctggctgggagggaggagacggcctattcctcagtggggcttcctcgctcacggtgtgtatggtggggagaggagcacacaagtaccattttctgaggattgtgccagaccatgtcatacgtataagctcattcaaatcgatttccagataaggccgggggagggtagccgacttgcccaaggccacgcagcatgtgcgcggtagagccggtagggacgcgcagagggtcttgctaccgactctccccgctctcccgggagtctgggagccctgaggtgtcccctacccggccgggaagctgggctctcgccccgggactgtcccggagggggctccagcagggggcgccccgagccccgtcccgggcagccgggcgcgcctccagccggcgcctgggacggggctggccgctccgccccctcggctcctaggctgctcggcgggcgggtgccgggcgctctgggaggagaggactgcagccgagcccagcgcaccccgccgcgtcccctgttcccgcgcgcccgcgcgccccgccgcgcccagcgggcccgccgcgaccgcgaccgcggcagctcagcctcccgccgtgagtagcacccgtctgcgggctcgatgggcgggacgaggcgcgcgcgtgacggcagcagcgcccgggtctggggctggcggggcgaagagatccggggcactcgctcgcagatcccgggcccgccgccccaatgcctgacgccgtggcccggggcattgtggccggcacccgagcgcgggagctgcccgccgctgccctggggcgccctccggagcctggcactttgacctgggagacagggtagaggcggcgggcagagccaagcacccagcagggagatgggagacagacgtccatcgagttaggccccctggaacgggcagagcacgcccggctcccggccaagtcttctcagcttgggctgactctctcacctcttgctcccgcctggcacaaggatgtgatgcgaggagggtgctcagatgtctgagcttcctctggggctgaatgaagctggggtccccgccgtcaggcgccccggcctggggtagagctaggatgggcgtgggggcggccagcaggtgtgctgcaggttggggtggaacggcttggaagggcgttgccaacagttgactaggactctgggctaggcattttggaggtcccaaggcttgcataggtctggctaaccctcaccgtaactctgcacggtggaaattggtattcttactttacaaaagagaaaacaaggtccagagaggtgagcctcgttgaggccgtgcaggtaatggtaaggcagtggtgcacactggaggagagggcaccatagctggctgcctcgggggcaagcgggcaggtgcagggacagcgcctgacatcttgtatcctggaatcctgtggagggcagccactctggtttctgacactgcgattcccaactgcctctgtggaagatattcctgggagagtcctgttgacctaagaggccgtggtgccttggcctcttcacagctaacttcacagccctgtccttccccaaaccgctcatctcccaagatgttttttgagcaccctcaagtggcaccactgatgattcagcaccttcagaggagacttgggcagaggggtcaggggtgtgtggatgtggctggaggtctgctcctctggggtaagttcctggctggcaggaatgagacccgcactgaccctgcccacctccttgaggcctcccgatttgttagctgtggggtgaacaagcaggcttcccaagggagctggatctttgccagagagaccaagtttttcttgtgtcaactcaggcaggtggctgaccttctgtgggccccagcttcctcattagagactgtgatgggtcaaagcctggaatgtagagaggagctctgtaatgccggagccccatcccttctgttggcagcctctccagagcctgagtgtgatgattcctaatgggggtgtgtgtaatgagacggtcgtgtgtgttttgcccaaccattgcctgccctcttgctgtggtcccgtttcactcacttgcacttggtgaggtgggatgaggaactgagagagttcactttgcagagtgagctgggccagtggtggagagggcttcttgagtgttgagagtttcctatgaggtgatcttccagccctagacacctcctcctagcttgtccctcaggaggccactgactttgccaaccctggtgacatcttggaggagttggggtggctatcaacagaagaagccctgggaagaggagcgggatgggtcacctgtatgatgctcagtgagtcccttcccctttctggatctcagcttcctcttgtaaaaacaagtgggttagaccagacagcagtggttttcaaacttctgtttcacagtgaattcttacccagaacgccaacatatagtatggataacgtggaactgctctggcttccccttctcaccctggtgatcctgaagcagttctaaaaatccctaaatagatgatctatggggttctaggaaatctgtggtagccccctgaagtgttgcctggtattagagttgtaggcaggaatttgaattccaaggactccatcaggagaaacatgggcattaaggtgggtatcatcctgggagcatctggagctgatggcctgtgcttctggccaaaagttgtaactgtgtcccttccctctgccatgtgatttcagcttttcgaggctggaaaggtccttgtgcctctggctccttatctgggtcctagctggtgactataattccacttcagtttcacccctttagtttgtttctaaactggtaaaatgcaaattcgccttaggagaggtgttaggaaagtgcttgaagtggctatcagttgttttacctgatgagcatctgagcagcggccttgagaaaggaggctggggaactaagttaaaatcagccaacacttatatagtgcctactgtgtactagcctacgacaaggggacagaggtaggaatgtcacaattcttgcccttatggggctccaagtcacaaagaggagggaaggaattcacgttatccatggaccgtttaaaacattacacatgggttatctcatttgtctcacattagtctcattttaaaaaattatgtaaaattttgatcacatacaaaatcatcccatatatccatctaactaccacccagatcaggaaacaacattgctggcactctgaagcctccgaagctccccttccaactctcccctgagtgaggggatagccactctgctgacatctagcaccatgcattaattttacctaaatgggatcacacagtatgcagtcttttgtgtctgtctactttcattcaacattatgtttctgagattcatccatgttgttgcaggtagcagtagtttgttaattcttattgctgtataatgattccattgtatgggtatatagtacctcaatttgtttatccagtcttctattgataaccatttggttgtttccaatttttagttattactaatagtattgcagtgaccattctaacgtggatcatttgggaaaacatctgcatgcatttctcttagatatgtccaaagaaattgctgaacagttttccaaagtggtggtcccagtgtatacccctcccagcagtgtttgagagctctagttgccgcacatactcaccaacactagacattgtcttacgttcattttccatggaaggaatgtgaaactcaaaagttatcctgtgctcagctaagacaatgtgccagtaagtgacagagctgggatttaaacccaggtctgtgtgatgactatggaatctattctctccctctgggttagacataaacataagccagaatatgatcaactcgaaccctaaaaaggtatgaagagcactctgggagaacttgaagaggtggagaattgtcatctgtttttgggagggcaaggatcatggagccgcacagagacggtagcatttggctgggtcttgtgggaagtgggtagttatgcccactctccagggctttccagctgggcctcccctggcaagggccccacttcagccgagatatagcagggatgaaagttttaggggaatgggaaaggtcaactttggctggaatataggatatataagggagggggcaaaggctggaaagatgagcgaaagcctaactggtgggcctagtttgtccctaaggggctcacctgcccccctaaccttggccacccaggatatagagcccaaggcagaggctcaccattttgctgggaactggggcttctttgaatcctgctctcagcaaatggagctggcctctcaccaaatgggagatcttagctgttcctgggaccactctcagggtttctgccaacagaatttttttggagtttcctgcttgcttctagctgtgtgaaattggtaaccccaccctgcaggacctgacccaaattgtttatttggaaggaattttttttttccattgaaaagaagatggtagatagcactccctttactccctgggccagtcttgggagatttgccaggatgttggggatgaggggcgtcgagcttctgattatggtcaagctaaacttgctagagggctccctggcatgggttaaatcacagtaataatcatctttcttatttgtacagtagtttatatccttatccccacatggatgtgtgaagtatgtgatatagatagtatcactctgtttacaggtgaggggatgagtcccagagagggtacccacctgctgtgggtcacagggctaatatacactcacgctagtctggaactggggctcctggagcctactcttttcactatttcatgcttgctccagccctggccaagcatggaggatgcatgagggagcctggacacccacaggcaggtgaccacgagagtaagccctgggaaccaggccagctctgcctgagggtcttcaggctctgtgtgccttggtggaagggagagaggcaggcggcatcttggtaatgaagctctggtttgcagggggctaaagtggtggaaagagggtgaaatgtatacacccgctgagagttaggacagctccagccacttggcattgatgagatgtgcccttatataatggtgcctccacccagcctggtgaaaatagtcttttggggttcgtggagcccatgtgtggttgggatctgattggcagtcagcagaaaagctgccagtgctaaccaaaatgagctctgacaggcctttgctaaagacccttggaagacacatccacaggcagctggttttattcttgtgatttgcagactgtgccctgcgccctgctcttgggatgttgtccagagtggcacatggctgtcaggaatgggtaagcctcttggggcagagggatcccaggagacgatgcagacagtcttttctggtggagtggtaagtgctccccatggctcagagttgggctatggctttcagtgagatgcctggggcaggcagagttggctcagttttacagatgaggacactgaggcccttctgacaagaaaggagatcacagagctagttgtaggcaaagctggaactagcacctcaggttcctgactcctggtgcctgtaggaatttgcctcactcctcctgtccatctttcctttggggttgatgagtgagagagtttacagattagttcagacacgcagttgggtggtacaacacctgagggagctgaggtcatgataatcccttaccttttaacagcattttctagtttacaaaataatttcatgacttgaagttgattttacagtattagccccattttacagatgaagaagctaagtctctggcagcttaggtggcttacccaagcaagactggggcttgtacctaggacttctgactttaaagctagtgcttttttttttttttttttttttctgttgcccaggctggagtgcagtggtgtgatcttggttcactgcagcctctgcctcccgggttcaagtgattcttctgcctcagcctcctcccaagtagctgggattacagatgcatgccaccgtacccggctaatttttgtatttttggtagagatggagtttcaccatgttggccaggctggtctcgaactgctgacctcaagtaatccacccacctcggcctcccaaagtgctgggattacagttgtgagcaccatgcctggccatttttttttaaaaactgtacaacagctgcctctttttgcagtagttttgaatttaatgaaaacaaatagctgaagttcaccatggatgtttctctgaacttcttcagacagatctgaagacctgaggagctctcctttcctgtctccttaacaaatttgaattcgtataaatcaaataagaaccatacatcatcagctgcaggtgagaaaaggcttgagcagggcagttcttgaagaaccaaggctgtggattattactaaattattagctcccttgcagccaattacgtttaggccttagactcttaggcttgtgctaatttggatggctgtcctaaccacaggtttcttcccatttcaggattgtatgttccaggcctcaatgaggagtccaaacatggagccattcaagcagcagaaggtggaggacttttatgacatcggagaggagctggggaggtaggagactgtgtgagaggtggggggatgccgagggagccaaagtcatgcttcttctggcacagttgtcagttggtgttggaaggcagggccacaggaccagtgggaagctttaaaaatgagcctgaggattattcacctgcctgggtgactttgcacatggtcattgctctggaaataatgacttgccagtaaaagggatgagaattgttgagttctgtgttttcagcataatctagctggcagggacaaccttcatgattcttgtttgatctgttacttttttcataaagcttccccaggctctggatggagacctgacttgttggttttcttctgagtctcacttgggattctccatggttcccagggttttgttttaagctcagaacttgaatgggaggtgaggtaatcctcctgagaatggatttatgttgagtaaccagccacacgagccccatcatgaagttttcctgggatctttgttactggtgcattttcaggtttgctgagcccagagcacagccagggtgaaaatcagatctgaaagtactatcgttaggatttggatagaaattaagattttctgaagctcttttcttgccttccatttctaccagctgctaatatttaggtggtagtgtagtgattacaaaacaccagtcatgaagtttgagtctcataacaatgcatgaaataggcattatttttactctccttttccagatgaggaaactgtggtccagcgtttgggcaagttgcccaaagttgctgagccagtgagtgacatagccaaggttctgaccagtccattttgcacctgcacacctgttatgccctctcccatgagcttggcacttgtacactcacacatgctcatcagagcacctagcctcaccccttcacacacagcgcagcatgaaaacatgggaatttagagtgtgtagacccagaaaatctgagacaggtgttagttaatttagaaaatttattttgtcaagattgaggacgcatgcccatgacagcctcaggacctgtgcccaaagttgtcacagcgcagtttggttggagactggagacatcaatcaaatatgcaagatgaacattggtttggtctggaagggcgggacaactccaactctaagcaaagatgggaaggctctaatggggagggggcttccaggtcataggtagataagagacagatggttgcattcttttgagtttctaattagcctttctaaaggaggcaatcagatatgcatttatctcagtgagcagaggggtgactttgaatagaatgggaggcaggtttgccctaagcagttcccagcttgacttttccctttagcttagggatgtgggggccccaagatttattttcctttcacaagtgtctactgtatccaacaggcaaaacaggagttttttccctttatagaactcttatgtcaggactaattgtcttactttttttttttttaaactttcaaagataaaacagagcttcaaagccagaagagcttcactccaaagagaatgaaaggcagcaggtgcttcaagatcagggagttagtcctggctggctggatggtgggtcggggagcaaataactgcagagaccccagagggggatgacttttcccagtcttgggcctggtgaaggggtaggaagaggacataggaccagaggctggggttggtcagctggagcctgcctctgaatgggaagccggttctctgtgcctcaggttcttctcctgcccttggtggcaccagcagaaagatgccattctcggcaacaaaccacggccagccctgccaatggtgcttgattcagtgccctcacttggccatgtcctgcatgcaggggtctgtgctgagtactgtgggtacaaagacgagcaagatgagacagtctctgccctcctggagctccaccctggcagttacatacatgctaacaagggcattcttggattggactagagtctgggtgggcagagaaactgagaagttgtggggagtgggactctgaagaaggaagtagaagcagtttcctggggattgcatttataattccttcttagtcttgtctctccctgaccccatatatcaaggacatgtgctattagacccagaagagacctcatgtttcctggtcctccacttgcaacagggtgtggagatcccatgcagctcatagcctggggtgtcttggggtgattctcacctcccctactcttctaaagtgctaatggggcaaaaggtgagtaagcagcaggggaggcccagggactaggggccaggggcctttggagtggtcagatgtcctaggatttgtggtctaggccagatgacctagaaggcctttagaggtcctctcttccaggcctctcacttgacagttgaggaaatggaggctcagagaggggaagggtcttgcctggggccacagaacaggctagaactagagctgcctttgaatgaccactcagcttctgaagggacagtcctattcttctctcctgccctcctgttcttcatttaacgtattcttgaggacctactgtgtgccacgcaccatccaagcagtggaaaacaaaacagacacagtcctgtcctctggcagtttatgctccccaggctggtggagaaaggcactagacaagtggatgctaaaggataaatcaccataaggtgtgttaagggctaagaaatgagagaaaaggatgccctgcaagggattgatggggcatggggatgtaattccatctgggtggttagagaagattgctctgaggaagtgactgttcatttgagaactgaagggtaaatgcaaaagcaaagtcagcagcatggatgagccctgaagtggggaagtgcctgggacctggggaacccgcaggaggccagtgtggccttggaaagcaggccggggcaagcagcgttacatgaggctgggggcatgggtggggaccagatccaggtggtgaattccctgccaacacagagtggtggagaggtttggcctttggggtcacatgggttggggtttgggttcctgtcctagctgtgcaacattagacaacctgccctctctgagcctcagcttttttacctgtaagacagaaatagtaccattacctagctcatggttgtggggatgaaatgagatgctgagtcaggaatccctctcagagctgggcatggggtaagtgttcatgatcaagagcttctggccttcaacagtgaacagatcgagcctttggagtagttttggggtgtcaaggccccaccttctgcctctgcagccttctaggaggaaggcatgggactgcaggaagaagagcagggggatcatcctgatgtctggagagctcaatataaacctctttacttggctgtcagtgagcaccctagtgtagactcagggccctctcattgattttagctcttcattaagtcttaactatgcaaaaatgaaaatgaacaacagtttgttacatgtaacaatggatgaagctcagacatgtaatgttgagcaaaggaaggcagactcaaaagggtctgtactgctttattccatttgcaaaagttcaaaacggcaaaaggaatcagtggtgccagaagtctgaatggtggttatcctttggggactagtgactggaagggggcacaaaagggatttctggggtgctgtattctgtttcttgatctgggtgtctgtttcacagatgtgttcattttatgagtatttatatgaagacatgcatgcatatgggcattttcctgtttattagaccttaactaaaatatatatatatatatgtatatatatatatatatacatatatatacacacacacacacacacacacacacacacacacacatatatatatattttgagatggagtttcactctgtcgccaggttggagtgcagtggtgagatctcggctcactgcaacctccatctcccaggttcaagctattctcctgcctcagcctcctgagtagctgggactacaggtgcgtgctaccatgtctggctaatttttgtatttttagtagatatggggtttcaccatgctggccaggatggtctcgatctcttgaccttgtgatcctccccccaaaaaataaataacctttaactctacttcttgccctggcctggtccacatgtttctgattcctttagaggctttgtctatccttatcctatgagtaagagcatctctgtaggaaaagctttggatggaaacaggataccctggctggagcatcctgcactctgctgggaccctccctggccctgcatattttgcctgatttctagcttccagcgctgagtgcaggcagttggctgtgctcacacttttggcaccagcctgtttgggatgctggaggttgtctgctgtttctaggagtgtttggagaaatattggcttgcagaaatgtttggcatctcccagccttggtagcaatcagtagagcagagcagggaaatatcagagcagggctcataaagagaaactcatccaactcctcattttgtagatgaggctaaggccagagaggagaagaggtgaactggtgatagaaccagggtggggtctggtggtctgactcctagcccaggactctggctaccgcatcataaggacccacaaaacacaaagtcattacttcctttaatcggaatgcttctgaggagtgggaaagaatataagggaaggaagtcttttctgtttgtactcgagggtagtgtagcatggtcaaagttagaaggatgagcctttgggaaggagtgatgtttcccaggaggagggtgctagtaggtaggcccagtgatggttttgtgaacttccgcatagacaactactgcatgcacaatgttataaagtaatttaacgtaagcagcatataatgaagagtgattccttgtttcctatcctttgattactttcctttacttagatgatttttttttttttgagatggagcctcattctgtcgcccaggctggagtgcagttgcatgatctcagctcactgcaacctctgcctaccgggttcaagcgattctcctgcctcagcctcccgagtagctaggattacaggcacacgccaccatgcctggctaatttttgtacttttagtagagatggggtttcaccatgttggccaggttcatctcaaactcctgaccttaggttatctgcctgcctcggcctcccgaagtgctgggattacaggagtgagccatcacacctggccagattttctttacttatattatattaacataaaatcataagatgtttctgttgagctggatttcaacaaaaatttaatccaaatctaccattttatagatgaggaaagtgaggcccagagaggggaggtgatttgtttaaggtcataaacaagcattggaggaagtggaactcaaaggcagaaacttctcgactaccgactaccgtgctggtttaaacaaacgaacaaacagataagaacttatttaaatctacatccaacctttatccatagcccccacttctcttaaggatcttaccttaccattactccacatatcacctctgccctgaagaagacagcaaccatataattgctaccacttagaggaggctcatgtatgcaagacaccctgccagacacccaacctgcagtctccttgcctggggatgagagacttcggcgggggaaggagcctctgcactaaaccctcagcctgcctgaatgtggacaaagattccctggggcagccatgttgatgggggcagggggtagacagactggagtctcccaatgggatcatctgtggttaggatcagccaccgcacattcagcttagccaggacaccttctttggggaaagaaacaacatcctctaggaaatgtgtgaagtttaaatttacccaggctgggttcaatagcccagtctagccacactgggcactatagaaaacaacaaacataggtgttcgatttactcatctcagcccttggcaaaagagctcctaagactaaccctgaagcaagggggcttttatgatccttttaaattaaaaagatgtttgtttattatagaaattattcgaggtgaatgtcataaagttatgaagagtataaagtaaaaagtagaactccctctgccctctcgctgagtctcacaccccacaggtagactttgatggtcattttctccccccccccccccctgagacagagtctcactctgtcgcccaggctggagtgcagtggcgccatctcggctcactgcaagctctgcctcccgggttcacggttcacaccactcttctgcctcagcctccagagtagctgggactataagcgcccgccaccacacccacctaattttttatatttttagtagacacgggcgtttcaccgtgttagccaggatggtctccatctcctgacctcgtgatccacccgcctcggcctcccaaagtgttgggattacaggcgtgagccactgtgcccagcgatggtcattttcttctgtcaccattcagaacctttttaagttaagcaagtgtgtgtgtggacagaggggaccacacgaccataacagtcaacaacttgcttttctcacttaacgaaatctgttgagtatctttttatagcagtgcaggtagatctgtgagacttattttggatcaatggttttttaaattaataaatttaagaccgggtgccgtggatcatgcctgtaatcccagcactttcggaggccgaggcgggtggatcaccaggtcaggagttaacccagcagctattttttttttccttccttccttccttccttccttccttccttcctccttccccctccccctccccctccccaggggtctctctgttactcaggctggagtgcagtggttcagtcatggctcattgcagcctcgacctcctgggctcaagcaatcgtcccacctcagccttccaagtagctggaaccacaggcatgtgccaccatgcccagctaatttatttatttacttatttatttttgagatggagtctcgctctgtcacccaggctggagtgcagtggtgctatcttggctcactgcaacctccacctcctgggttcaagcaattctcgtgcctcagcctcccaagtagctgggattacaggtgtgcacgaccatgcccggctactttttttatttttagtagagatggggtttcactatgttggccaggctggtcttgaactcctgacctcaggtgatccacccacctcagccttccaaaatgctgggattacagtcatgaaccaccacgcccacctaatttttaaattttttgtagggacagggtttcgccatgttacccaggctggtcttgaactcctgggttcaagcaatcctcctgttttggcctcccaaagtgctgggattataggtgtaaaccaccacgcctggctatttttatttctgaatcttgcctactaatctttgcaggggtatttttcatacccacagacttcctgctctttgcaactactgtggcacacgtacttgcatgtagttcacattcccccaagtgctaagcaggggcaggttggagaggctggggcgagcagcactaatggccgtatgagatgaggcttatctggcacttgtttatcaactctttgaaagcaggttcagagctgttctcctatttggaatatcactgcagcactgagacagaggccagaggcccacaaaacgtatatgacttatctttgctcttgctgtttcctcactcttggaaaaattatgctttttcttcaaggtccagatcaaacacggtgactctgacaaaacctgccatgccctgccccatccaccccactcccttctgtcagatttaattccctcttattctggaccacgtctctgatcatacctcatgttacacatagggttttcccggttgtcctccctgctggactgaaggtttccaggctgggctcctgtgtacatcagcttttatctgtccgtctcctctactgtggtgtccagcccaggccttttatacttgataagtgcttaacacctacagatactcataagttaactgcagagcatctgggatctgccttgagttaaatttaaacctaaggcagaatacctcagccaagcaagctcacagcccccataagccctggaattcatgaatgtccaggattccccaaacacaaagtgggaaacaaaacacaaaaattacttccatttaccggacatacattattgcgtttaattctcataacaccctgtgaagtagttgttcccattttatagatgaaaaaactcagtctcgaaaattttaggtaactggttcaagaaatacaaacctaccttatcaaggagatgccaagtgggaaattctactctgtgtgacacagaaaatctcaaagaatgtcggaaataaaagccagaaacttcctctgggcaaagccctcttcactaccctggcctgggatttttgtgcctctctgatcatacacatgcttgcttgtatttcttgctgctgggaaagtgaaaacgattgacatatgttaagaatctactgttggggcaggcatggtggctgacgcttgtaatcccaacactttgggaggacgaggtgggaggattgcttgagcccaggagtttgagaccagtcagggcaacatatgtgaaactctgtctctacaaaacatgaagaattagccaagtgtggtggcacacgcctgtagtcccagctacttgggaggatgagatgggaggattgcttgagcatgggaagttgaagctgcagtgagctgtgattgcaccactacactcctgcctgggcgacagagcaagaccctgtctcaaaaaaaaaaaaaagaaaatctgccctcctgtgagtatctgtgctgagtacttcctgccctttcagaacaattggacttggatcacattcccatttcccaggtgaggacaatgaggctcagagaagttaaataaagtattcatggtcacacactttaaacaaggcagtcaggattccatcctagctctgtcagattacaaagctcatactgtttctattatactatgcaaattccgtgtgtgtgtgtgtgtgtgtgtgtgtgtgtgtgtgtgtatgtgtgtattttgagacagggtcttgctctgttgcccaggctggaatgcaatggcacaaccacagctcactgcagcttcaagctccccggctccagcatcctcccgcctcagcttcctgagtagctagggctataggcatgtgccctagactttgataattttaaaattttttgtagagacgggtgtcttactgtattgcccaggctgatcttgacctcctggcctcaagcgctcttttcgcctcagcctaattctataatttaataaaaatcaatccaggagattcttcagaggtcatctattctagtaaaggcccagggctcagggtggttgagggcgagtaggggtaggggatcaaagagtttgtcagtaaaaggggctggaaggggaggaagggagacagggcagatatatccattctctgcatagggcagcagtgaggaccataccaggccaccaaattcccttggtgggattccatcctgcagccttgatgaggttcttaaacccatgagacttgtagccacaggactatggcccagttcagggttggagagtggccacaaacaggagaggcaggtgaggggagccagcagccctgtcaacatctaggtgcaagggtatcatatttacatcatctttgatcttgtcaacaccacaacagactttggtttttggtttttggtttttgagatggatttttgctctgttgcccaggctggagtgcagtggcgtcatctcgactcactgcaacctctgcctcctgggttcaagcgattctcctgcctcagcctccccagtagctggggctataggcacccgccactcacagctaatatttgtattttttaatagagaccgggttccaccatgttggccaggctggtttccaactcctgacctcatgtgatctgccctcctcggcctcccaaagtgctgggattgcaggcgtgagccattgcgtgcagccatacagcagactttagagagaggggtgtcagagaggggctccctacaccagtcctcctgaggggggtagggaactgtgagctggccggatgcaaaacggtatagtacagtggtctcttgtaactcaggctgtagactgagagcaaaatgaacttggttaaaagcaagaaagcctcctccaccacagcagcaccctagacaagctggtggtttctaaaaggtaagtgggtgtgtgtggatgtgtgtgtgtgaaggagcttatgagtatgtgcatgtctgtactgtatgtaggtcactatcacagttaacaataaatattcttgggcacccactgtgtgttggggaggagacttagggcttagaccttgccccagaagagctaaggctcagatggggcacaggagtactctcctccttagcaaatgaaatgagatgtacctagactatgtgctaatagtgggacccaaaaacacattccaggagatcggaggaggaagctatcaccctgggtgcggcagggtctaatccaggagataggccggtaactacctcaagggtgagggctctgccacgaccaaggagcagaggcccaggcttgggcaagagggcatgtggagagggtgaagggatggggctgccaggaggactgatgactacaaggggccctgggtggcagaggctgtggatgagagagggaggcactttcatcacccattgttaggaaaacaaagcacaaagccactcagacaaagtggccgcattgcacacgcttgagttagaagctcagcacacagtgcaaatcgcttgccctaagggtaggtctcattgagctctgtctgcattatggaaactgtaagagctgggggtggggggcagtacttatgtgggggaaatggaaaccaccatgggcctgtatcttctggatatccttgcttttctacttatttattgccagtgtgtacattttgtgttggattgttgttttttgactccatgttgtttttaaatatgtacctttccacatatccagagttcatatacttaaaaatatttttgttttgaaataatttgaaatgtgataaaaaaaagttgtaagaataacaaaagtcccatatacccttgacctatgtataccagtttataacattttgtcatttctctctctctctttccccttctctacctgcctcctttcctccttccttctttccgtctgtgggttatctgtctgtctgtctgtctgtctacctgcctacctacgtatccatccatcctagtttctgaaccatttgagaataggttgcagacattatgcctcttcaccccttaatacttcactatggatttcctagtgaagtattaaatacatggacgttctctttcataactgctatacagttacaaattcaggacatttaataccaatataatatttttacctaagctatcactcttgctctaattttgtcaattttcttattagtgttctttatagcagtttttctccctacagtgaaagacacagggcaggatcatgtgttgcatcttgtggttatgtctctccagtctcctttaactgggaacagtctttctttgactttcatgacactaacatttttgaagattactggacaattaaaaaataaatagggtcgggtgcagtggttcatgcctgaaatcccagcactttgggaggctaaggcaggcagatcacttgaggtcaggagttcaagacaagtatggccaacatggcgaaaccccatctctactaaaaatacaaaaattagccaggtgtggtggcgcacacctgtagtcccagctacctgggaggctgaggccagagaatcacttgaaccgcagaggtggaggttgcagtgagctgagatagcgccactgcactccagcctgggcaacacagtgagactccatctcaaaaaatataaatagataggtagatagatagatagatagatagatacggtttatgtacttctgctaacttcataatattctacccaggcatgcccaattcaggtaactttcccctgttgtttctcactgctaaaaatattggtgtttcggtgaacattttgtttaatttcctctctgcattattttggttgggtgtattcccagaggttgcataccaggtcaaaggttatgactgatttgcttaatggtttaaactggaaatagtgaatcactttacagtgtcatcagcatgtacttatttccttgtggctttgccaatactcttttattgtttttgtgtatttttgttagtttatgaattttgtaaagatacattaacattttcactgtggggaaatttaaagtagttcaagttttctgtactttccccttaatttcaaaccttattctctcctgcactttacttttcttcgtggtgtttgcatttcatttttatcttttcttttctttttttgagacagggtcttgctctgtcacccaggctggagggcagtggcgtgatcatggctcagtgcagcttccgacctccttgggttcaggcaatcctcccacctcagcctcttgagctgggactatgtgccaccatacctggctaattttggggttttttttttgttttgtttttttgttttgagacagagtctcactctgttgcccagtctggagtgcagtggcatgatctcagctcactgcaacctccacctcccaggttcaagtgattctcccgtctcagcctcccgagtagctgagattacaggcacacaccactacgcctggttagtttttttgtatttttagtagagacagggtttcaccatgttggctggctggtctcgaattcctgacctcagatgacccacctgccttggcctcccaaagtgctgggattataggcatgagccacaccgcacctggcctcatgttttatattttttatagagacagggttttgtcatgttgtccaggctggtcttgaactcctgggctcaagtgatctgcctgccttggtctcccaaagtgctgggattacaggcggtgagccactatgtaagtcatcattatattttcatggatattttgaagttccaatagcaacacaaggtaggtaaggccaacataatagttcccattttgtaagtgatgaaaaggaggctcagagactctacccgacccaggccagttgggactaaatgcagagctcttccctatagactgatggtttcactttccttctctgagaaatagagtatacatgtccttaagggacctggaactcctgccaaggggtctgctcctttgtctctgcttttagaagctggctcacaggattttctcaggaagttttctgagagcgtaccatttggcgaagcaggtacttgggatggggagtgcttttgagagggcaaaagggagagcttctgtcctccaccttgctggggaaaccaaagtgaggcttaagaggtaccctatcaggctgggtgctgtggctcactcctgtaatcccagcactttgggaggtggaggtgggtagatagcttgagcccaggagtttgagaccagcctagccaacatggcgaaaccctgactctacaaaaaatacaaaaattagcctggtgtggtggcatgcgcctgtagtcctagctacctggggggctgaggtgggaggattgcttgagcccggaaggcagatgttgtagtgaacagagttcatgccactgcactccagcctgggcaacagaatgagagactgccttaaaaaaaattaattaattaaaaaaaaagagttaccctatcacctcagctgtagcaaagcaccccagggctctggtagggcaggtgggaggtcatgtgagaccccggcagcttccagggccttccacagaggggatggctcagccgccagcctctcttctcaagattgcccctcacccccagtcagccgtccacagggtctagaaccaggaactttcacctgcgagggctcctacattgttgagtgtggggcacagaaaactatagccctacagccaaaatctggcctgcgccctgtgtatgagtggccctggagctaagattggcttttacagaggaatgtttccaatcaatttgatgatagagaacgctaactttagaccccaattaagcaaaatgttatccatcccccgcaatatccatatttccattcttttcattggaacagctgtattataaaaacaaaataaaactcaattattattatattttgaatttcattaattaattatttaaaaactttaaaacttgtggaaattcgattttctcctttgttatataggtgcctacataatatcctacattttgcttcttggcttgcaatacttcaaatatttaccatctggtcctttgtagaaaaggtgggctactcctgatctactccagtagggtttacagcaaaactgtaaaagtaatttatgatggaattggggtgaagatgaaagtgaaggtgcagtgttgggaaaggaggatgcagcggtgagcagaggccagctgccccttgccctgacgtccttccagggactcagagccctgggaagcccagaagcactgtccacctaggtcaatcctgccctctttggagtgtggctggggtaggaagaagggaagggcgctctggatgttggggatcgagtgtctcctcgatacctggccctgcactaagctctgaggtctgttacctggcttcatcctcttgcagtcctatgagattataggtatttttccctttttacagatgaggaagctgaatcttagagattgaactaacttaccttggtaagtgtctgagctgggatttaaacctatgacttctgaatcctggtccagtgctctctttgaagtaccaagttgcctagaattttctttctgtctgtgaccctgggatcccctccagagaacagggaaggtggttgttaatagtgtctgggtctcttggtggtttactggggagcctgctgagagtccagttgtcctgtgtctaatccatttccagggctggcactgcctccctgctcacctccacctccttgctggcagcttctaaccctgaggccttaggaccctgatcttgaatcctgaaacactggcccctggtggcctggccacagggcttgaagggtgatgaaatatccttccctcattggggtgaggtttatttagcaccctgggggcagggcccactagttgaacttgactgctcagggctgtggtgtggctctagttggtgaagcattcctccctgtctatgttttgcaggctaagagacaagatggactgggcagaggggagaagggcagtggagagacccaggcagaaggataggctcagggcgggacagcctggcagtgactgttctgggcactggaatcaccaggtccaagtctgatcctggctctgccactgtgagctccttggtgctttgcactcataggctctgtttcttcatcgtaagatggttgctatctcatggggttgttgaaataccacatgtggaatctgagtctccacttttccagctttctggggtctctgtcctttaatgtccgaataagaataagcattccattccaggcaacaggaagtcctgttccccaacccaggctttctgagcctccccagggcatgctcacatcttcctccatgccctaggcccttgcaactcgaggatcactttcctccttcgagacaaggctgcacctcctctgtgatcttgaagtctcatgcaaggaccctggcccatttctgagtccctcccttgccactgagactggttgaagcatgaattgattttcacctaaggcttggggttgatgagaggaattgctgcacagagaaggaaatggcttaaagttgggtaacaaaacctctgcttctttgacttctgacctctgccatgataccagggtcttccaggaccccagcctaggccccaaatctgctaccattctttttacttaaccgcgcaaggtagactccccttttctttcagataggcagttaaactccttgttgcagcacctccctgattggaccccaggcctctcttttgcagaaccaaaggtcctttaaagtttttcttaaacaaaaagccatctctgacccccgcacgatgcagtcttccgcctcctgtagcagatggtaacggctttgagcagctttttaaaatagcaccttttccattcctgccacagatgtaagggacatagcgtggcacgtgggaagtgtccagcaaatggccgtagatagcaacatcatttccttaaaggcccagtggtcatcagttgatttgaagagttcacagggaggagttgcagtgaggccctggcatcggtattttttatatgccccagtttgagcagaatgtgcaactggatccaccatcagttcttcaaaatggtacttgagacacatcagaggctctcagagctgttagtttattcctttcctcccttgattgagtgagttggtttattatcctctgtcccagctctgttaattctctctctttgcctttgctcatgttagactcctgctgggatctgcccttcccccaccgtgtgtgtgtaccacacccaacagtgactccacaagccaattcctttatggcttctaggtttacttcccactaataggtgtatcctttcagtggccaccttttccttagagtcctatgctcatctaggtctcacccatgcattgagccctactcaagttctgcttcctcccagaagcctgccctgactactgcaggcagggttgggcgagcctgttctgtgttcccacagcatgttgtggatatccctgctgtcactctttgccttagagtcagcttccaccctcctcgacatcgccccttgacaaagagaagagactctgtaaacccttgctgaatgaaggatgagtaagttaagatggcagcaactaaaagagaaggtaaagagatggtgaggattgtatactggtacctacagtgagtctcctagcacttttgccagaaaatttctggcagagataccctaagggagtttggaaagagtcatttctcatcatgctatcttagaatttagactggaagggccccaagatatcatctgtctaaccccctttgagggactgtgcgctcttttagggcttgagctagaatacacacacacaagtattcttcacttggtctcactctgtcacccaggctggagtgcagtgatgtgatcttggctcactgcaacctctgcctcctgggcgcaagagatcttcccccttcagcctcctgagtagctggaactatagatgcacatgaccacacccagctaattttttgttatttttttgtagagacggcatctcaccatattgcctaggctggtcttaaccttccgggctcgagtgttcacccgcctcagtctcccaaagtgctgagattacaggtttgagccaccatgcccatgggattgtgaactctttaggatcatttaaacattttaagtggtcagttctttacggaagtagtcaccatgcacaagggaacttgtctattgggtgaagtgaagaatacttgtatgtatcctagctcaagccttaattccggctaatgctctctttaggaagctcttctcagaaaaaagtctaggaaacctttgcctaatgctttgaagaaaatgactgttaacagagaaaataacctaaactatttaaatgttaataattgcaggtgctcttttagtaataacagtgttgtacatttccttttgtctctgtgagatcacccagtagccactacctgtagcattgccaagattagctcccttgttgatactaaccagcatttggatggttaccctaggaaaattgtactctatgcctgtggtttgtgtttctaatatgtttcccttccctttttgttaccctactttcctctttgcaaggtaagtgcttccagaccaacgtctaggccatctccaccctatccagtgtctgatacagagtcaggaaagtggctggcagattaaactgagtgatgtgaccaacttagtctcattgctttgcccactctgctgtccaaacttacctcccaatacttccaagctttctcctctctagctgcttagtccaagcctttttataagatgttcttttcctccttcctgtctcttcttgtcttccacttaactaattgtacttagctctcaagtccagtgaaaatacttcctctccctctggggccttcccatgggttcttccttccagccccatctatccctccagctttgagcatccatagcccttagtatctgtgcctcttacacaattactccaaagtagaaggttctctggggattcattctgtatttcaagccagattgtgagcccattgaagacggggccacattttatccttctttgtgtcccttccacctctagcatatggctggatccacagtaggcactcaacgagcacaggggctggtaaagccatcagctgtgcttagccagctttgaggccccaagggcgctgagcttgtgtttacaagcccaggagaaggtagaaattcagcagcaacaatttcatcaaggccctgttcacatgagcttctttgttttcttgtctggagggggtggggcaggggaacagaccaagtgtgcagagctgcttgacatcccagcaactgtacggaatgctcactcgcgctccctttcatgtgccagagtcgtcccacatcgcagtatcatcctgtgctgacgtgagcctgggggccgctgtcctgttcctcccgaaagtgactgagactgaaccccactgaagtgcctacttccaggagaagatgccagggcttccccttgtgggtagggtctgatctctactgaggggaaagatgaagggaaattctgttgccatagatgttctagatcagggttgtggctttctttaaggctaatgataagaggggtagaaagactcatctgtggcatctggcccatcgccacggacttggagtaaagaacttgcttcatatcccactttggctagcaatacgttaatgcacctgggcaaggcactttctgtctctgggtcacaaggcattttggtggcagaagtgagacctgaatgtgggtctttgcactccaggtcctttgccctttccattactccatagaaacactgtaggcatttggtatcacaccaagttacctatcctttcccttttgatttattccttctagtacctgaggtgcttttgggaacagggactttctttagaggcctgctgtcaaggggctaccctgacgtcattccatgattctcctacatttcctttctataaatatttttctttaagcctagatttcttttcgctatcaaatgggtgtgtctcttttgtcaactataaatccttcccagaggagatgggcaaagtagtgctgctttggtgaagcaagcgatacctttccatagctggtgcttaataaaaatatgtgatatgaatgaataaatgacagcaagaggcaagagaattgatgatgccatggtatcaccttaatcattactgcaagagaacatgccactcttggggaagacccctgtgaaattgaccatttcagagcaagtgcccagtttccagtcctgatgaaatgggttctatcccccactgccttctcagctgtttcttcatgttgatgcattcaacaaggtagtgcaataagagtgtgctggcgtgggagagaaaggggtcctggctttggctctggagctgcctgtgcttaggcaagtcctcagtttcctttccgccatctctagcatataagtgccttctggcacttagtgtcctgcaacttcatgattatgtgaagtgttcttactgggccatgggctgtctactcagctggggcaggaatcactcatctagagccatggcttatggcacagtaaagcctgcgggtgccactgagactgcttctgctgagattagacacagtggtttggcaccaagtctgtgaccagtgcctgtttttagcaacatggctagtaaatattgactctgtggcatgaaaatggaaagcagagatgactatgtcaactcactcagaggatagaagttcaccaacctctgataagatgtagttatacaacgcataggtgtgtcactaataaataagttgtttgggggcagggagaatggaaaacaagacaaggaagcattccatgggcaattaacagctgctttcctgtctgcactgtctggctggcttattcatttgttcgctttaaaatgaatggatacttacatacacactggcatgtaggaaaaaaaggctagaaagaaatacaccgaagcattcactgtggcattctctagaaacagtgaaattgccacagatttgtactttcatatactttttctgttttcctcatggtctacaatgagcacatattacttttataatctgaaaaggacaatgtattagacataagataattctttctgaagagtctgaaggaactttcagaatcatgcaagtaccttagacctttgtgttttgcctactggacactgggtagtaccgtagttatcaaaagagaaaagtccatgtaagagaagctactcttccgaataaatcctgatctaagtgtgttcactgatttatatccataaaagcagatgtggtgggaaaatattgcaatcatataagatttcagaatttttttctgtgtaaacagacacttaactgctttgagtgcattctgtaattcacagcagctagctccgcttggcccagaggtgggcaggtctgagacagggcactctggtaaatggttgcttgtgacctgaaggtgggaacaatcagttctggaggattgactagacttcaggatttggaatgttggggtggggatgggggtgagaatggcgttataataataattaccactggttaagcaccaaccatacaccaggcaccatccacatattgttataaccttacaaagccttattggacaggcattagccaccttttagggaggaggaaaccaaggccaggagaagtcacttctctaaatcctcagaggcagtcagcagcaggccctggactcaaacctggcctcaaagcatttgctctttctaccatgctagggtgtctctcagagggttcagagttttgcaacagaaaacagaaactgctaaagggagcctgagctaacaaataaggtacatgcgtctccatccaggactgaggacctttggagtaagaggcagccccaggtgtaaaagctgggcgagtagctacaggtaggatcctggccttgttagccctgaatccaggactgggtgtgtctgccttcctcagcctggtgcaacctagaggggccaggtggcctgggttgtgggacccagagaaccatgggacaggtggccatttccagtctgggagggactttcatctgctggctgcctatgtgatgggggaggccatttgttgcggggcagggagttggagtgtggggttgtggcatccaggcctgtgggtgaagaggagttggtctctcaccttcttcgtacctggttgattaaaacaaccagtaaaagagtcttaaggctgtttagctttttcgctgggttagtagagctaatttctgagtctgaggcagcagttgcttccttgggctcacaggtcctgtcctcacagcccttgggactggccaagtgctgatttcttccacctccactggagatctgtctacctgcaaaccgtcatttgagaatgcttgtctgcccgcctcaccagggaaccaggggcctgctctctgagaatgaatgcctcagagttgggtttcatcaaagttggatttcacttaatttcttaagagaaaggatgtatgttttgggggagaggccaaattgtggtgtgtggtgtttttaaaaaatgacttttttggcccaggcagctgagttgattgaagcccagcagtacccattatagaaatggctcatcttgtggttctctagagtcgtggcttgaatatttttggtctcctggcaaaggcatataggattttgcaattttatggagcaggtttcaaagttacaggaattgcaaggagcagtggtgtttgtcctctcctccttctccgggagtctgtattcctctgaggctcaggccagtgtggctgcttttcaacacaatgggaatcattgtaataatcacctgaatttgtacagaactgtacagttgacaaagcacattgccatgcattgtctgtttcaatgctcatggctacatttctagttaggcagggataattgactattttttacaaaagagaaaaccgaggcttggagatgttaagtggcctggagacacagctaggaagaggcagcatcatagttgagtcaaggctttctgactccagaccagcgaaagcagggaggtttgcacctgttaaggtgtggacctgcccgtgtcctggaatgcggctctctaggcacagggagatgcaagcaccttgagacctgactgtgactgtcctaggcccagcagagccacctcggtggagggttggacagcctttgaggtgcaggtggggcttcgtgtggtgctttgctctcttcctatgccttccttggctgttgtctatttggtctttacaactgccctgtgaggcagcagggtagatagacactattagctgcattttatagatgagggaactgatgtttcaagaggttaggtgactcactcaacatcatgtattcattagtcacaaaacaaatatgtattaggtgcctactgaaggtacctaggggactgaggtcacagccagtgtctggagaagaagagacttgaaggcaagtaagaaaagggaacacagtaggtccctagaactccctgctgagtgagagcccccaaggacagcccccacattgtggatctctttgtatccacaacagcaatgagaacaagttgggcttaggccagtgttctagaaaaactttgtcatgatgtaaataatggtgatgaaaattcctgccatttattgtgctcctgttgtatgcaggccatatgctgggcattttacatgtccgtccttccttccttccttccttccttccttccttccttccttccttccttccttccctccttccttccttccccttccccttccccttcccttctttctttcctcctttctttcttctctgccacccagactagaactcagtagcatagtcatggctcattgtggccttgacctcctgggctcaagcgatcttcccacttcagcctctgaagcggctaggactacaagcatgagcaaacatgcccggctaatttataaatattttgtagagacagggtcttgctacttgcctaggctggtcttgaactcctggcctgaatcagtcctcctacttcagccttccaaagtgtttggattagaggcttgagacattgcacccagcctatgctatttctaactgtcacaataaccttgcaaggcagcgattatttaccccactttacagatgagaacactgaggctcactgagggcaaatcactcatatcccaagtcaccctgggattaaaatccatgtctctttggctccaaagccagaacaatttccactgaactacactgcctctctgtgataatggactctaagaaacttgctggagaaggatagtgccagttactttgggaaactcatggataaggggggtcaggtgtggaaggtgctggagaggtggacaggaccatggctgtgggcagagaatctgtaagaggccgtgtgtcctgctggtgccggcagtacctgagagagaggaggactttcctgcttatggccatgctgacctgcagtcccctggagccagccctccctgcgctgcgtgggccctgaagagcagaggctgctttgtcctctcggatgctttcctgaagaacccaagccttcctccctatgccccctttccctgctgtgttagtttgctggggcctccataacaaatggccacaaactgggtggcttcaaacaacataaatttattctctcccagttgtagaggtcggaagtccaaaatcaaggtgtcagcagggttgattccttggggaggctctgagacagaatcagttccatacctgtctcctagcgtctggtggctgctggtgatcctttgtgttcttggcttgtagacacatcactccaatctctgcctccatcttcatgttgctttctccctgtgtgtctctgtgagttctcttctgtctaatctctgcctgcctcactcttatggcatctgtcattggatttggggcccactcaggtaatccagaatgatctcatcttaagatccataaattaattacatctgcaaaggccctttttccaaatgaggtcatggtcacatgtgccaggggttagaatatggaaatatattttagggagccactattcaacccactatgactgcccacccctgtttcttcttggagttgcatgagaactttgggggtcaatccactcactgcaggctgggcactgagctgacagcagctgcctctactctgcctatagcagtgccctgagtgttgtggtcaagtggtctcgatcctttagacctttaggcaatgggaagaccttatataaagagctcacagagcagctctgggattagctacttttgaacgtcagagtggtaattcccacctcgaacatgctgtcgttgtcctgtgtggcataagcaagagagaggctgtccttggcatggcagggccctgtgggtcagccaggctgtttgttctcctgccagactgcagctggcacagactcctgaccacacggtaccctttcctgctgccttacatttacttaacactgcagaatctgttcttctctcctcttctgtccagatctccctccccatcattccctgcccacctcctcttagcattcttccttactgcatgcctcttggctatcaacgcatctggtactttatctgtcctccctccttcaacaatgtcagaatgttttttttttttttttgagatggagtctcgctctttcacccaggctagagtgaagtggctctatttcacgatttcagctcactgcaacctccacctcccaggttcaagtgattctcctgtctcagcctcccaaatagctgggattacaggtgcccaccaccatgcccagctaatttttgtatttttagtagagacggggtttcactatgttgaccaggctggtctcgaactcctgacctcaggtgatccacctgccttggcctctcaaagtgttaggattacaggcgtgagccaccaagcccagccaggtcttatttttgtgtaataatattaactcttctgagggatcaggccttgtttttccagttagatgtaagcccccctgcagtaccatgcagtctttggtaaacacctgtcagtgcctccttggctgctcaactggcataggaaagtgtttggtcttgtctcctctctgttcctaaatcattgggtgattttgaacaagtgacctactcccagggttttcatttcttcctgtggaaagccagaatgttggactatcggatactatcaaaggtccttttcaggcagaacactgtgtgattgtcccaacagctctcaggtctctgaaggctcatgtctgataaggccagggcctggaccaacataaatgttctccttgtggccaaggtagggtcagagatcccattccctgatcctggtcccagcagtgctgcctccgcaggtagtattcctaaaaacccaaactgcaggatggaccatgcttttccctgtaaagcattctctgtgataaccccatttcccaaggatcaggttctccgtgggtaggtgaagtccatctgggagcctagttagaggaaaaccaagtagataaacacttgacctgtgttggtgcaacctcagcaaggcctctggcagcctagcctcctggccagaaccctggctagaaggtgtttctttctggcacagctgccagccacacccagagaaggttggggcctctcccattttctaagtgaaatgactaattagtcctgaagcaggagatttctatctgctcataatggcatcatgatttattcatgtgaggctggaccacttacagggactggtcccatgtttcctctggctttgatgtgatatgaggccaactgtagttttccagaatgaataatttctcaaatccagcttgctttctcagtcaccgctgccaggaaacctataactctgttcacttaatagcaccctccttcccaggtctgcaatcattttagaaggaatgcattcttatctggcgctcagttccttctctggcaatgtgagggttaggctagatggtatctcagggcctttctagcccttaggtttttctacttttaaagttcttgccccttctcctcatgttttcttaaggtatttgcttccataggactgaatgcaaggtaatcagagacatagctgttgaaagcttctctcctggtttcacttttctgcccaattactaagtcttaaaggcacgtagtgtagtttaagctgttagttcctggcctcttaagactgcccacattcacttaatgtcttgtgacttgcagcctcccagcttaaaatctcagtaatgaagaacaagatcttaacccttgtataaagataatggcaggttaccccatttccataatcccatgcagaacaagggagttagactggtctcattttacagaacaaccaaaatgttattgtgactgctttgtgcacatgcaccgtgaaatgagtcggctctttaatgatttggttgccaccttatgggttgtctgggggtctggggtggcaggggtctcaggcctcctttcagggactaggctagtagggactgacatagttttgcttctgtgaattctttcttgtctgtttgacattatgatcatatcgaagatacaatttatatcccatttccctatttatgttgtagtgtaaacattttacagtcattccctatataaatatattcattggctatgcagtgccccagatagaatgcttaacatgatcatgtttaacttgtatagttaagaaagaaaatcagttaataacaaaatcaaatagtgcatttaaaagttccctcccaccatcctcctgaacctctctagtcctattcctcataagtgatcattaagtttcttgtatatccttccagaaattgtcaatgcatatatgaacatacatatgcatagtctatattttcaaaaaggtagaacagactatatacacagatgggatcagaatgttgttctgtaactttgtattttaatcttgtgtattttcccagatcaggtatgtgtatctttttaaaagctgcatagaccacctgttatggatggaccataattaatttaagcagtaccgtcttgatagacatttaggttgttgctgaaatgcgcatctttttacatacatctgcatacctcatttactcatctgctgtctgccaagtatggttctaggcactaaggatttaactgtaaacaagacaaactcttgtgtcacccttgtactggtaaaattgtcagataaattctggaaaatggaattgttagtgcatcgatttatcacatttcttgaatgcatgtggcatataagccacgtagactattttactgaatgtttgataaatcagtggatgttctcccatcccgcagtatggtcacctctttccagcctctcagtggttaatgggtcatgtattgaggcttcaggaaggttgctgcagcagtgaggggtagtgacagtcagtaatgtatgtttgccaggacttttaagattccttatggtacagctttgcagtgtgttcttgcaactgtgtgaggaaatcagagtggctggtctgcactttacggaaggaactgacacacagagagatcaaggctggggggctggaaaagactcattactttccatgaaggtggctggtggccaagctgggctgagggcccaagaagaggggttttgcttcctgggacttctttaagtggtccttggaatttctcccacttagagtaaagcatgtgcaaactggaggagcagttttattttttcacttactatatggagacagagttctcaaggacttgcatttcatgaattcagttagagctgcattgtccaatgtggtagtcaccaacaacatctgactgcttaaatttaaatgtaattaaaaataagtaaaattgcaaattagtttctcagttgtactatccacatttcgagtgttcagtagccacacgtggctagcagctaccacattagacagcacagatatagaacattttcattatccaagcatcaacctggagtgtataaggctgtagcgttgtttttctcctaaacacttccacaaacacttgagtgttttgagtctaggctcactgcagcttccgcctcctgggtttaagcgattctcctgcctcagcctcctgagtagcttggattacaggtgcccgccaccatgcctggctaatttttgtatttttagttagagatggggtttcatcatgttggccaggctggtctggaactcctgacctccagtgatccacccacctcggcctcctaaaatgctgggattacaggtgtgagccactgtgcccagcttgagatcatctttactctctaacttttagggaaaagaggctcacaggcaagaggtgacttggtgccagaagtcacgtagttgggggtgcaaagccacaagcacagccaatcctccacctgtgttttttccactccaacctgagctgttgatcctgatcctttgcatatggctttatctgttccattgtcctgcctttatgctaatctggagggttcagattgggtgcctaccatgagtggggccctctgccaagtagctctgggtctgtgttgttgctatgtccccagacaggagaccacagaatgagtcagccacctccacatggggttgctggtgccctgcagattctgccccaagactgacggcttccctgtgaaccctcttgtgatgcggtcaggacatgcatcaacagtttataaacaagattacaggaagctcggctgctgttctacacacaaacccaccccacccactgacatgcagagctgggacaggtgctgaagaatgagtccatgggaagcttgtcttcatgaatgggataaaacccaagctggtagcagactgacccattgttttccgaagtggggatgggtagacaaatgagagaccaaaactgcagtaggggctcagaacaattaaagtgccaactctgaaaatcaagacattaaggcaggcgggtggggactttgcctgaagtggtcagctgggatttgggagtgatgagaaataactggtttgaggctgagagacaaatgtagggatcatcatcacattgaaaaagccaagaatgcggatccccatgcctatacctatgctgataacttcttgctcctgaaaactgtagttgggaaagttggcagaggacactaagcagtcaatactgttgttatattattactattgttattgagagtagtagtaaacagaaagacataagttaaaaatgatatttataggccgtctttagagatagaagaaactgaaccttctggcataccaggatattcctgttgcgtgagaactcgtggttctcaaactttggtgggcattagaatcctcagagggcttatcaaaccacagatgctgggccccacccccagagttcctgactctgtgggtctgagcttagggcctgataatttgcatttctgacaggttcccagatgatcctgatcttactggtctcgggtcacactttgagaaacactggtttataccatcaggtgctacagagaactcagtttgtttcagtggcataggtttacaattctaaggccctttgacaaaccctcttacccacagcccaactgtgctggctgcctagaacaagcctttgtgccactggaaactgcttttgtcgttactcatcatgactgtgtttcagatttttagtgctaaccacctcgaagtcttgagctgctgtaaggtgcctctcttacagtgggtgtggtgggtcacacagatgaagtgtaagacattgccctgcccttaacagattaacctaatttaggggcggggggaaaggcaaacacagtaaagaaatgagcataaagagacaattaagtgtactgaactttaggagctaacatattccaaggtgaggattcctggggggtggcatggtcagggaagacttccaggaggagctggaacttgaacttaaaacaggagtagcatttgggtaggcagacgacctcctagtttaggcaaatagggctagcagaaacccagaggtggaaatgagtgtgttggggtgtgtctgctgggaagcagagtacatttgggcaagtagaatgaggctaggtggtgaaaggcccctggggcctggccaaggagctcaggcttgatgggaaggagaaaataatcttgagcagagaacatgatgatgtctgcgttgtaggacaatatactggggaatgtggggtgtggattgggtgtgtgggtggagggctgaagacagcaacactgatcaggaagctgtactaagtgttggtctgtaaaagtctagctcaagaggatggcaggtaatgaagagatactagcccaagtccattcagaaaacatgcactgcagatctactgtgtatccactatagttggtgcctgggggtacaaggctggacaattacagtctactaagggagaataatatatagagaatttcagtaaaatgggctgaatcccatgatggaggtatgcacaggaggtgaaaatagaggagggcctcatgtccaggacaccttgagggaaggatcagctgtgacaataaattctggccaactttcctatgcctcctttaaacaaagaggtcttatgtttgcagactgaaaaggggatcctaccctttcctcccctgtcatctgtaaggcccttggtgatgctgcagctctgtggcctgtccctcaagtacacccttgattggatgacagcagtgcactgctctgttggttagggatgtctatgcaggtgtttcttctcattttcttacttttaaaacacaggaaattttaaaaggaaaagtttcactcaactatttgttatcctcatgcacttttgcatctgtgttctctaatacaaaaattgaatcaaaccatacatatcatttgtgcatgttcacttattattttataaacatgtcccttatgatgttcatacttgctattttaatgtttatataattgtctattgcatccagaacatctgattgccaaagctgttccttagtggagaatgcttagcttgtttccagctttttcttgtctatgaaactatgttctttcatttgaagtctctctagaggccaaattcccagaatacaatgcacctggactcagataatctgactttaagttctagatctgtggcaaattggctctgtgactgtaactctgtgagtctcaacttcctgatctctataatggggatagcactgactgtgcagggtgttgagatactgtctgaggccaatatatgaaaagtgcttcataaagaacctgcatatagggtagagttgatatcacctggtgaaagcatgtgagtatttttatggttcttttttaaaaaaacagagatataatttatatacaattcacccatttatagtgtcctaaagccattagtacattcgcatatagtgtattaaagccattaaatggctttaatgtgttcagagttgtgtgaccatcatcatcatcaattttagaacatttcattaccaaaaaacccccttacccattagcagtcactctctgcttctcccaaacccactagccctaggcaaccactaatcttccttctgtctgtggatttgcctgttctagacattttgtaaaagtgcaatcatacaacatgcggtcctttgtgactggcttctttcacttagcatagtattttcaaggtccatccatgatatagcatggatcagtacttttttccttttaattgccaaataatatccagttgtatggctacaccaccttttgttcatctattcactagatgatgaacatttggactgtatcgtcttgacatttagtgctaaatggcacacagcaaacatagttgtatgctccaagctatttgatgtgccaaaaaagtcggactctcagtcccttatgcagaattttatagttaaacaaactgcaggcatcaggtaactgttaggagaagcatcacagagctatccaaggggattttgggaaactcctgtgcagagtaagcctgtccccctccaggaggggacctgtgcctgccttcccagcattgactttctctgaggctgggagatcaggaggcaggagaggtttcctactggctcttggaggatggagagctctggctggagctaagatgaaatgtgagcaggggacagattgccatgataggggagaggaaggaagactggggggaactggaaactgagtgggggccagaaaacaggctgaggggaccctgtaccttcaggtcattttgagaagagtgagaaagggttgtgtgaaagggaatgagaaaggttggctgggcatggtggtgcgtgcctgtaatcccagctactcgagaggctgaggtgggaggatcactggagaccaggagttcaggaccagccaggatgacatagtgagaccccgtctctaaaaaaaaaatttttttttcaattagctaggagaggttggcacacatttgtagtcctagctacttgggaggctgaggtggaaagatcacttgtaaagtgaaaaagcacagtaaagtgagggtgggcccaccactgcctttagatcctctcccctgcagcccatgcaggtttttccgagttaaggtttgagcctccctgcatttcagtgacttcctggagtcgggctccctatgggtgggagggaagaataatgtctacttccttcttggctacctgctagattgatgtaatctgtacttggcctcacctcctccagctgccaggccttcccctggcaggcaccaaggatgagttgtctgacacatgaggcagggtgagaagggaagagaatggggccacctgacaggagacctgtctggtcctgcatctgtcactgcccgggagaataggtgatgtgggcaagttcctttcctttgctaggcctcagtttccccatttataaagtgaggtgacggtaagaaattccttttatttccatggttccatgaggtttgccaagttttattgtatactgggggatctctgacgtctttcttggttgtttctgccctgctttggtgaagtgggaatggagttgggggagttccttgcttctcttgagcgtctaatataggtgacgatgttgtacgtccttagctggtggttgccaagggctgacatatactgtatagaccaggacatgatataaggagaaaaaagtcatttttgctccctggctggtcagtctgggggcttatggcctctgatggtaaaggctgacattctgcctcctgactgttttttgttaaattggcaaaagctacatgtgtcagaactcaggtggctacacatcttggtggcaggtgctgctttggtggcggaaggatcaggttggtctgggaaagctggatggaccagtgtggtgagcggagaccactcagtgtgggttggtcctgacaccctctcaggagtgatgggatgccaggagaggccatagggagaaccatgctgagctggctgggtttgtacgtgttgcagagggttttttgtgggtttttttttttttttttttgagtcaggatctggctctgtcacccaggctggattgcaataatccgatcataggtcactgcagcagccttaaacttctgggctcaagtgatctttctacctcagcctcccaagtagctaggactacaaatgtgtgccaacacgcctagctaattaaaaaatttttttctttttagagacaggatctcactatgttgccctggctggtcctgaactcctggtctccagtgatcctcccacctcagcctcttgagtagctgggattacaggcacgcaccaccatgcccagccatgttgcagagttttatgtggtttgaatctggttcttctcccagatctagtctttgtgtttacttcttctcctttgtgggcaagacagttttttgttttcctcccctgcccacccctaccttggctatctgtttcccagtatttgctgttggccttaggcatgagggactctgggcagattggtataagcccattcctatgttgggagggcacatggctgtcttcccaccctctgagttgcttcagacattccctttccacatcttctccagcacctgcacatctttccggaactgcacatgatattcttgggctggcatctatgacttaggtcaaggaaaggtaagtttctgctcttgtatctagtatctgtggtggctgaacttaccaaacccttgatcaaacacacaacctcacacacagagcctgaaagtgaatcaaagggtttgaaattactgctctttgggaaaatctaggtaggatgacttgccctgagctaactggatacccctcctgagaagagcctcttggcttccctgagaccacaggacagagcaccactcaaggatgggtattgggttcactcagaagacatgtctttgtcttgtcaaacccacaatcttgcaccctgaagtgcgggcctgaggccagagcacaacagcaggtggatcagttaagctttgggctcagtttccctgtttgggaagtggggtctctcggctagtcacctttcatccttacttaagtgctaggaggattaggtaagagagtgttttgaaagctcatgaaaaccttcatctcaaaggaactctgggagtagaaggaattaacgtttcaaaggaaagataagtcatcactgatttggcactgaagccaagagtgtaaggtcagagaacaacctgtggctgctgaaagggagggtgtggctctcagagttacaggatcattgggttgtgtccttggatgactcaggagcggtgctgcacgtgcttagtgcttttgtatgtgtgccctggagcctgtgcgaaagcccgctgccaaaccaaggggcccactgtggaattattgttatgcaagctgaggggaaagaccccaccaaaccagccagcagtttccattgaggcctagcagagacccctatctccacccttgaagaggggcagtaatgtctctgaaagtctctatcccactaaggtgctcaaagtcctcagaacacttgtctaaaccaagctgccccatccaggcaaaggtatcagcatgaggcaagccatagattatgatgaggatttttttaaaaagtgagggtccccctgttgaattaatggatctaggcattgatcatcagaagctggtaatatcacaaagagagatagccaacgttaggcgcctcctgatgggaacacacagcaccaccaatgaaggagtcttgcaagaaactcaaacctgaatctgatcaagcctctagatccagctactcatttacaggaaatacagggggcagaggaacatgtaaacaatactatcaggaagtggccaataaaatccagacagtgagaaatggtataggtcaaaagacctggtatttatgacaaatgaagtataagaaaaagagaaaaatggagggatggaggggagctctgggaagggagagagagagagagagaagaacctaaagattaaaagaggcttaagagacatatcatttgcaatatgtgaccttccttgggttttgatttgatggaacaaactgtaaaaaaaagttaaggcacatgggggaaatatgaacaccaaatggatattgatgacattaaagaattattgttaattttaaaaggtgtgataggccaggtgccatggcccatgcctgtaattccagcactttgggaggctgaggcaggcagacacttgaggtcaggagtttgagaccagcctgaccaacgtggtgaaaccccgtctctactaaaaatacaaaaaatagccaggtgtgatggcacacaccagtaatcccagctactctggaggctaaggcaagagaatcacttgaacctgggagacagaggttgcagtgagctgagattgcgccactgcactccagcctgggtgacagagcaagactctgtcagaaggaaaagaaaagtaaagaaaagaaaagaaggaaggaaaagaaagaaaagaaacttaagacccaagacaggatgactgatttgctcttgatcactcagctgattaaacccaggtaatgccaccatgggtcagcaaagaagtaggcgaatcctggtgatgctggaagcattggatgccctgtaaggacatgattttgcagtctgcaaagtgtgtctaggtctctgccagagcaatgcactgcctatgatagagtgctattgctaaaccttcccactaatgcagattaatttcacaccctttgcaagtgttgctattccaagtttttcctcactcagccgctgaaaagggacagaatctagagatgtgctctggatcgaagtccagccttcagagttagaagagaagagccagtagggggtcgtctgtccattctatcctcaaggggtctcccctgagatcagttcttccccaccttatcttgtggccttattgcatccacccaccctcctcagcctccaagcctaggtcccattcctgcaaattcctgctttgggtaaattaataaaagagtcagtcttaacactaccccaccacctctggtcccacgacacacacacacacacacacacacacacacacacacacacaggtcccacgacacacacacacacacacacacacacacacacacacacacacacagtgtctcagtctttctctccctccctctctcctcctccctctgctgctggtttcattaattaggcgattctttgtttaaaagacccaagactctaaggaatgatactttacagatgagatatcagtgagtttattgggtgagttgggggcacaaaggccccctgaattcttaccaaatagctgcctactgtatctgtgtgtgagattgatgggagttcatactatcatcccttgcatgtgtgtggccttttgcagtttacaaagcatattcacttgcattgctatgtgagcctcatagaagcctgacataggtagatattagcctcattttacagaagtggaaactggagctgggagagtttagtatgtgttctgccaagtcctccagttggtcatctatccatccatccattaattatgaaatattttttactattatggacaaattatgttgatagatgctatggaagacacagggacaataggagaaactgttaaaacctttaaaaatgtgttcatcttcaaaacgtattttattgaaggacatatattgtttattgctagagcatgtagagctcatttgtgtttccaataagaagacttacataaaaaaaggaatttctgatgaactctgttaataaaaatgttttaaagtagtccatcctttcctcttaacactatggttgatctgcgttgagctgggacgtttccaccagatggggatcagaggtgccaccttggaggttgactgtgccactctccccagggccctgagcttggctcttctgcagtaggagttggcaatacctgtccccatgagcctcccaaggatttgagagtgtaaaatgagaggattcatgtgaaactactttgcaaatcatgaagttgctcttcaagggctacttttattcacagaaggagtcactcaacagatatttattaatttgtgtttgttcataatactgcctttaccaaggtaggaaagcaaattttcagcaaagagggtcagaaccaaaggaaatgtggcatgaatattggggtgcctaggattctgttatgcagtggattggggccttgccgtaatattttctaaaacagcacttctcaaactttaatgtgtatgtggatcacctgggagttatgttaacacacacattctgattcagtagtgctgagatgaaatctaagattccacttttctgacaagcttccaggtggagtcaatgccgctggtacaacatttaggagcaatgttcttaagggtgcaattgagaggaaaggaggggaagtacagcccggggctcctagagtggggaggggggcacactgctgacctatttgtgccataaggggagatttccagaaaggtcttcttgggagctctgatcactgcttagtagccccacttccttcccatcctcctcaagtgggaagaggctgttgtcttcttaggctgtgtatttgctctgaattttggagagagaaaatgtatattgtgagtgcttgagccccatctcggggtaggaggaggaaggaaggagattacaccatcacatacggtaactgttctttgtcgggccaagctgcttggggaagcatggctgtaccatgatctagagacagcagattgagccagtgcctgccttcagcatctgatggcgcagcacagcagaatccagtgcagactagattttttttttttttggcaggtagtggaggtgattaaagagtgttgactctggccgggtgcagtggctcatgcctgcacttgcagcactttgggaggctgaggcaggatcacctgaggtcaggagttctagaccagcctggccaacatggtgaaaccctgtctctactaaaaatacaaaaattagctgggcgtggtggcacgtacctgtaatcccacctacttgggaggctgaggcaggagaatcgcttgaacctgggaggcagaagttgcagcaagccaagatcacaccattgcactccagcctcggtgacaagagcgagactccatctcaaaaaaaaaaagtgttgactcaagtgttttgaagaagagaaggattggggagtaagcagtcagagggtgcccccaccaccttcattttacactcatcagacactttgtcatcacctattcccagcttgccaggctctgagtgccctcatgtggctctccagcaccccaaagacctctactgtgcagccatcttgatctgccttccccctaattaccatggttctccccacccccagcatcatgccttcttccattacattgaaatttcatttttttccccctgcatacctgaattctgccaactagtaggaaagcagtctaattcagtcatgttaaggaatacatggctactgatccaaccagctattagttgcatttttgtgagtcatgacacacaggggttcctccctagttctctcctcccattcagagcctatactttagggaaaaccagaggctttgtagaggtctcttttgctgtagatggtgacatctcaggagtctgggtgtggggacaaagtccaggtatgcttggtgcacgtatttgttcagggagaaaggtttcttctgccccatagcaagcaggccccagtaaaagcgggatgctgtgatataagggggagtttgctgtagtggggtggtttttacacaaagtcctgtggagcagacctaggggctgtgtgtgtgtgtgtgtgtgtgtgtgtgtgtgtagtagtagtagtagtagtagtcaggcaagtgctttgtatcatccccctttcatccaaagcaaagatgctttgatctattctgtacattaaacatctatgtaaggcttatttgaaaacgttattgatcgggtgtggtggctcatgcctgtaatgctagtaccttgggagtttgagccccaggagtttgagcccaggagttcgagaccagcctgggcaacatggcgaaaccccatctctacagaaaatataaaaattagccaggcatagtggttgcatgactgtggttttacctactcaggaggctgaggtaggaggagagcttcagccgaggagtttgaggctgcagtgaactgtaattgtgcctctgcactccagctggggcaacagagtaagaccctgtctcaaaaaaaataaaaaaataaaagcagggaaaaaagcattcttaaatacaagaagacttaaaaatggtgcctctggcaagcagagctagggtgggagaggaatggggcaggggactcttgtttgcattataaggctttctatgcaatctcatttttacttagccatgtttgtgtacattattctgctaaaaagttttaaaataatgaaaaggaaaagacccctactgatggagcaagtttggaaatcctagcagttgtagaaagtcacaggaatagaagtaagggacctgaggtcctgggctgtgtgactgaactgctttgtgaccttgggcaagctgctgtgagtgtttccttagttatgagatgggaggggagatgatcttcctctcccctgtggtttgaccctgcagttccacgagaagcagctgttggcagctgtgggggcagaactgtcctcccagtccccacgtgccctggaaaggctcgggtctgatgcctggcccatggatagtcctgacccccagccccagcttggtcagatcattcctgggctggagaggaagagagattttgaccaaattagtttgcttcttactggcctctgggatccatgggaaaactcctctcagaacagagattgactgctgaagagtgaatgggcgagtttccagcacagcgtctgtgccatgctcccgagctgagtttagtttgtgtcaaagcgcctactgtgtactttgtgggggattgggaggtagaaaatttcacaaaacagccctgccctccaagagcacaggagagtcaatatatagaatatttcctttaggaaagagaagatttgcgaggaagctgccttcttccaatatttggtggttcttccgtggatgggcactgcatcttgttcatctttgtgttcccggtgcttgctctcaagactcattattcatttaatcctcatccagcacaaacgcacaacagtgaacaagcagcactgtcccttcctttcaggagactacagcccacggtgagattccgggaagtagacagaacagtgcagggcaggacgagctgcaagggggaggatgccaagctgtgcacacggaaagcacctactgttacggccatggcaacctcagctgctcctgcctgggcttcctggggattcccctgggtctcctccgggcataggtccaccctgcagagacccagggagccagagagcctggcatatgtggggacccttctctgtgtatagaggaggcttgccagccaggcccagcctctggcaggagagaccctgcagagtccccagcctgcaggaacagtgtggtggcaggcagcctgagggagacagtccatcctttggctctcctgggccctaatatattgagacacaacctggcttctccctctgtcccagagggaaagcctggacctgccacctctcaaggcaggaatgtgcttgtgtggccagcccacatccatgtgggagcccatgactgctctgtgggcctgtttccctgaggacggaggtgattttctggggtactgaggggcagggaagggcagcctgcacccatgggtaagaatgtctgctctgactcatgacactcactgtctgactgcttcatccttcatcaatcagaaaccacttcctaagcaccaaggatatgtcaggctctgtgctgtgttctcccaattctcaaattcctttttcttaactgactgtgagataagtgtattactttcatttcacaggtgggaaaactgaagcccagagcaccaaggataaaatcctatttgttggtgtttaccatgtgctggatgccattgtgggcacttgtgtggatcagtgcatgaaatcatcatagcttatgaggcggttttcattcctgtctcactgatgatgaaactcgcccagggtctcacagccaccttgtaacagaactggactggagttatcttggagtcctttccagagacctccgtgccctcagagcactgctggttaacctctgcccctctttgactccagtgtgggccatgtgggtgaggacaagggcaattagaggcagttagtgtgggagacttgatgggtgggttttctagaggaaagagaccattttagaggctagggtccattttaaattgcagcaaaggccgggcatggtggctcacacctgtaatcccagcactttggaaagccaaggtgggcagatcacctgaagtcaggagttcgagaccagactggccaacattgtgaaaccgcatgtctactaaaaatacaaaaattagttaggcatggtggcgggcacatgtagtcccagctacttgggaggctgaggcagcaggagaattgcttgaacctgggaggtggaggttgcagtgagccaagatcgtgccactgcactccagcctgggtgacagagcgagaatctgtctcagaaataaaataaaataaattgcagctggggtagacaaaggacaaataaatcatgttggatttgacacatacctttcctgcgccctgacaattaggcttgaaggaaacctgtcaggcagtgccaaagcctgtaatggcttagagcagagttggaggagtggggcaggagtggcaaccctgaaggcacctgggagttgctaattgggggtggtgatgacagaggagatggcacagttgcactctgagccgcttgcctgacagaggctctggtgtctgctggggagtagggctggatgggagaggtgtagaggaagatgtgcttctaagaggacttggacctgttccttctgtccccacccagccctccaggcttgtgggcagaaaggctgggtgtggacctaaagccaaatcttttgagggtggggatgagggaataggccacctgcaagcgtgggggcagagggggatgggggtggcaccatttcattcctgtgataaatgctttttgctctacaatgaacttggccattaggatcggctgtacatgattgcctgagtagtcctcccttgggcaaagcctttcacactttgggactccctttagccgtctgtgaaatgggctaagctccgttttggaaggcgtgctctgctgcccactgtatttctccatgctcgtgtcctggagtgaacgctgcagtgatggcagcacagaaccacttatgattcctcttgctcatgcatgttaagaatttgaggcaacctatgatgagaggcacatagaaagcaaacataaaagtggaagatcaaaagccagatgccctccagaagagtatgatttagcaaatgtgtaataaggcccgggtgtctcatttatttttatttatttttaatatttttgtgtttagagccagggtcttgctctgttgtcaggctggagttcagtggcaccatcatagctcactgcagtctcttgttcctaagctgaaatgatcctcccacctcagcctgctgagtagctgggactacaggcacatgccaccatgcccagctaattaaaacaattttggggggcagggtagagatgggatctcactgtgttgccctggctggtcttcaactcctggcctcaagtgatcctcctgtctcagcctcacaaagtgctggcattataggtgtgagccactgcatctggctgtgcctgaatttttaaccagctccccaaatgattctgatatgcccccaagtttgagaatccatggtgcaaaggaagaaggaggaaatacacccaacatctaggtcatcatagttgttgtcatttggtaccaagataacaaaaaggaaataagatagatgacatcattttcattatctgaaatgaggtagacaaacatctttctggtaatttctgaaagaaagccaacatgtgagtcctactgtaaaggacactacacacatgctgaataatttggggtcaggagagatgctttgcctctctaaaggggtcttgtgctggttgcctcacagctgtggcccaccctgggggcaccaggcacgctctgcagcaggacctgctcaccctccaatgccatgccttcctttagtcagctaacaggagggacattgcccggagcaagagtgcagtgactttgaggaaaggaccaggtcagggggacaagggatggcagtgggtcccctgggtcgtgcagtaagtttgaaggtataccctgcatggagtgaccaacaatgtgaccagcaatggcaagagtcactgaggcacagaattgctcccttcagagtagccctaagacacagcagttgggtgattgaagtaacaggcaggcgaagtgaagggaaaaaacttgttaccaccttctgatgctgagaaagacctatagcttctttagacaataaacccataaccactctggcctataagaaaatcagttagggaaaatcttttcaacatatttgacaaaaggttaaatatcacaaatacataaagagcttttacaagtaataagaaaaaggaatagccgggtgtggtggtgggcgcctatagtcctagccacttgggaggctgaggctgcaatgagctatgattgtgccactgtattccagcctgggttacagagtgagaccctgtctcaaaaagaaaacaacaacaacaacaaccagggatgtatgccgagatttatacatgtgtgtatttataacagtatcataatattaaaaattgaaaatgatataaatgtccaaaattgagaatttgctttaaaaaccatggtttacctgtataatatgatattatacagccatttaaaattagatattaaaataatttttaattatatgaggagatgttaatgatctattgttaaggggagaatttttaaaaagcaggcttcaaaatagtatctacagtaccatctcacttacattaaaaaatgaaaaaaacaggccaggcacagtggctcacgcctgtaatcctagcactttgggaggctgaggtgggcggatcacctgagatcaggagttcgaaaccagcctggccaatgtggtgaaacctggtctctactaaaaatacaaaaattagccaggcatggtggcggatgcctgtaatcccagctactcaggaggctgaggcaggagaatcgcttgaacccgggaggcggaggttgcagtgagccgagatggagccattgcactccagcctgggcgacagagggagactacgtctcaaaaaaaaaaaaaaaaaaaagtaaaaaagatttcagtatgtgctgaaaaacatctgaggggcagacaccaagatgataacgatggttatcttagaaaggtgggactaaggaacattttttagcttcctttttgtgcgtttccttccttccttccttccttccttccttccttccttccttccttccttccttccttttcttttaacattcttctttttctaatcaaaaacaatcaagaatgttttatttgtaagtgagtctgccaatgaagggttcctgctgcactgggggccagccaaggatgacaaggccctttatcacacttcccggttcttcagcttaggtcatcatttctacaaacactggctgaatacctgttttgtgccgggtgctgaggtgggccctgtgagagttatgaagataacacctcttactctccaggctcttacaggctggcttatagttgagtgccaagatgaatgcccaggtcatttcttatagaaatacttttgtggtgtttggagagttcagcattttcctggccatgaagatagtccctgagatctgctctccttgcctgaagccctggtcctcctttgtctttgaaaatttagttggctgacacgtgacagatcaatgtcagtagcctggacccatggctgggccctgtgcggtaggaaacccagaaaccaccgtgtgtgtctgtggaatgtttcatatgtatcaatatgaaacatatgatacctgtgatacagtatgtcacacactgacctgcatcagagactctaacagggattggcatgaggacctgaaagagatatcttggtccaatccttcatttttggatgagaaaactgaggccccaagggaaaaggaagcttggaagttggtggtagagccaggacccctaaccctgtactttgcccgtgatatgtagtcttccccattcacagccctgcatgtctgggagaggcaagcaatcttgggcattttcaagtcatggtgaagaaataaacatgggattaaaaattcacaaacattttgagaaacagagaccatccatcctagatggctaagagctgactatatcagtgaaaaacaagattcttacatcaagaatctctcaggccttaagatcctggtggacagaaaaaaattgggcaagaaataactggttatgatttgtacaccatccatattcacatacacagacacacatagccctctgcagagccacctgtttaatgtgaatcttgggaaagtaaaaagacctttctatctccaagtcatcttaccactttgccccatgtgtgcctaaacttgccactattcaagccccttcttggtcacaaatagtgttaaactgtgaaggtgtttctttggagggaggtcaggataacccttagggatcctttgtcaccttacatgaattatgggaaagatcacagggggttgtgggccaggaagaggtggaaagttcacaggaggcgggctggatgcaggagaggggagggcaagtggggagggaggtattctagaacatgaatggttcactttaccattttatgaggggtaatcctgtacccccacagtaacaggagagcctcaaaccatcctggattttcccatcttctttctgcagtctttttcctgcgtggcagcacaagctcgtttttaaggtattatcctttggttctgtctcctgggctttgcccaggctatgggcctggctggcatttctaggagggagcaaactgacctgctctgttgaagttcttttgttaaacatacatctgactgtcaggaactcagatggtgggaagggtgcctgacccaactgagcccgactggtcccttgactgcttgttctctccttccctgtgctcccacaaggaggaaaggaaagggcaggttcagcttcctgatgtatttccttgagaaagtggccacaacctgatagggagggagtgaaggtgagaggttatttggggcctccacagaatgaagtgcttgtgtatcactccctgcctctccagctgttgcagatagttctttcatgcccaggctatatttccttttcatctgcgtttgtctaatctctgcaatagactatataagcctttcaagttgtgaggtgtgtcttgtttacagcacttaggacaatgatcagtaaatgagagacagatggataggtgagtggacagttaggaggatgcatgggtggatggttgggtgagtacatgggcaggtgggtgggtggtgggtggtacccttccaagcccagcatttcctcagtaacctacatcatgtttagtgtctagaatctagactctagactaagggaaatatcagaggatactgagctatattttcagtgaaaatctttctttacgtagccaagtcaaactttaattgagcctaacttatttcaggtcctagacttgcaggcttgagctcatttgacaacagcatcaaaatgtacttaagttaaaaaatagttgtcatactttagcccagcttggccctgctaagtgattccttcctttttgtgctttagtttttctgactccctgtcccccgcaacaacaacaaaaaaatgtctagaggaaggaagttagtctgtaggacctgggaatgaaacaagccagcctctaaaagcagctgctgcaggcccatacagaacagccacctgtgactttgtggacaggggccatttataggtcaggagtcagttccctggagactctggctcctggtacttagcctacatgtgctcctcaccgctgaccctgagttcggcttggttggagtgacttcctaaaagactagataataatactgagaagcatctgcatgttctgtttttcattttcatttatgatttgaaacttctttgggatcatctagagcatgctatgcttccatgctatagagcagtacttctcaaactgtgttccctggagcttttggggttccctgaagcccctttaggcctcatgggtgggggcggtcagtgggtgggctctggatgcctctccaaaagaagcacagcttttcatctgttttacatattggacttcggtgaaagatttgagagagggttccacacctcaaatttcaaagccatcgtcaaggaactagaaagacagtagcaacaaggtcagggaggggaaacaggctcgtgaaacgaggggcctgggtcattagctgggagaagagtcatattaggcagccctgtgccctcttctgtttgcaggttcttggctggcattctgttgttccagactctccacctgctgctgactttgctgctgctccctgcgtgtttctcactcctgtcatgcccatctagttcccagcgcactgcccacctggctttggtaaacttttcctccttacccttgtctctctggcctaaaaccctgacctgtttcctgctctgacctcagataacgttatatttcttcactgctgttttggtttcctgaatatctggtcccttgcttgctctgaccttggggaatgtgtccccaagtgttttctgcgtcttgttcatgggatttggagtggcctggctggaagatggatgtgttgggaaagggtgggaaataaggacagggtcagccacagaggctccacagtggagcctggccaggcagaggagtagggagggggctcagtgacaccatccccaggcaggctgtggctgtgggatgtgggtgtgggtcctccgggatcaggctgacctggttcttgtggactacagctttgagctgctcctgcctttgagacacattggctgaaggtccttggctggaagttcctaagcattatccctgccctatggccctgaaacctcgcagggtaattccagaggaatcacggctcattgttctccagagtggaaagaggaactgcggtgtctgcggtggggaagcaggaggaggaagccagtctccgcgaccctctgctttggaacacttcccatttggtacctctcacctctggtggcatcttgtcccttggctggggccctgcgttctatgcagctctacctcatttccaccttgatagactggtgacttaggggtacatcactcaatctttggacactttagagtcgactaagagagggaatgaggtagacccactcaatccatggacctttctttttctttttctagatggagtcttgctctgtcacccaggctggagtgcagcggtgcgatctcagctcactgcaacctccacctcccaggttcaaacaattattgtgcttcacccttcgagtagttgggactacaggtgtgcaccaccatgcccagctaatttttgtatttttaggagagatggggttttgtcctgttggcccaggctggtctcaaactcttgacctcaggtgatcctcccgcctcccagagtgctgggattacaacaaccacacccagcccatagatctttcaaagcctttagcagcttggccctggtagttgacagaacaagtctggttggctgtggcttaccacagagggtgagggtgggtggcagtgcgagtggtctaccttgatgcaggccgtaaggggtatattgccttttgagaatttaaaaccaataataggcctgacgcagtggctcatgtctgtaatcccagcactttgggaggcctaggcgggcagatcactggagaccaggagttcaagaccagcctggccaacatggtgaaacctcatctttactaaaaatacaaaaattagccaggtataatggtgcgcacctgtaatcccagctacttgggagactgaggcaggagaattgcttgaattcaggaggtggaggttgcagtgagctgagattgcaccactgtactccagcctgggcaacagagcgagactatgtatgtgcgtgtgtatgtatgtgtgtgtgtatgtatgtatgtgtgtgtatgtatgtataaataaatcaaacaaaccgataataaaatcgagtaaaaatcagtctgctttttactatcaccacatgccagcaattcaaaacaatgtcgaatactgttctcttctgggatgggcccctctcctcactacttggtacacactactggtcagttacctcgagagcctcattgtagccggagtcagtgacgtggatctgtgtcctagccctgttccctggcccaattgccagtcactttacttctctaagcccagttttctctctctcttttttattggcttttttttagagacggagtcttgcttgtcgcccaggctgaagtgcagtggtatgaagtgcagtggtatgatcatagctcactgtagcctcaaactcctgggctgaaaaccatcctcccacctcagcatcctgagtagctgggactgcaggttgtgccaccttgcctggcttttttttttttttttggagacaaagtctcaccctgtcacccaggctgcagtgcagcagtgcagtggcatgatctcggctcactggtacctctgcctcctgagttcaagtgattttcatacctcagcctcccaagtagcttgggattacaggcttgcaccaccatgcctggctaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgaaatcccgtctctactaaaaatagaaaaaaattagccatccatggtcgcggtgcctgtaatccaagctactcaggaggctgaggcaggagaatcacttaaacccaggaggtggagcttgcagtgagccgagattgcgccaccgtactccatcctgggcaacagagcgagactccagctcaaaaaaaaaaaaaaaggaaaagctggatgtaaatgttgtaatgttcacattgctatacaaaattgatcccgtggtgtgacatttggttcatgccctgtttatttacccttgacagtgaagactttggggggtggggattaagccaggctcctccatgaaccttaagagctgaggttggggacatttctgagcactgagaagctgttctaggtataccccttttaatgtgagtcctgggcagacaactagagagcccttatgaggtggcacctgggggcctgacaagtttggaaatgaggcccatctgccagtgacactgatcttgacacagcccacttgtcctcccaggtgctgagtgagtgaggagctgagtcctctgcctgggaagaggggtgtgttcctgacagaattgcaggagagtgtgctggcagaagcggggtgttttctgtatcttgaggatttactgtccctcacgaaaccatcctacgtgacttttgcaagccagtctcaggcacagagttcccacccacccacacctcatgctcttctgcaaggctggatggtaaagtcctatctcagacattacctcatgatttcccaaacaaccctgggaagtgggcagggcaggtattatcatccccatgtgacaaagaaggaaactgaggcctggggagttgaacaggctgcccagggtcctggctcgttagtggtagggctctgactagactcccagtctcctgacaccagcccagagttaggaatttggagagtgaagagaaagggcttcattcctgtttagagttgtcccaggctctttggagctgtctgacaggaagctttctaagatgagacctggggtggcagatggagaaacatgaactgaaaaggcagctccctgtcaagcccatgaaactttgatagcagattaggacgaggaatcgggcctcctaccagccccgtgctgcagtagaccatgcataggtattgattgttgctatggggggcagagatactggaatatgtgtgctttgcatatgtataccagattccagtattcccatcatttttgatttagtgttagcaatgactttcattagaggttgaattgctcccttctgctccctccctggatgacattctgggtggctctgtcctaaagtagacaggccctcgcctcccacccatcatccctgtagcctagctggcgacttctgcactgtgggacctcaacttctggctgcagagccttctgtgtgcagaaaaaggcctgttgctgtcacctgcccttgggttggctgggccctctgatgggcatactagagccacctcaggttctgcttttgtgcatctgctgagtacagtggccagggagtgcctgactgcaaattttcactcctgttatcctccgaaagctagagtaatcttctgccttgatttgcatattcataacacagcagttagactggtgaacccctcaagcaaaaatcatgctgatgggagagacaacccctcccctctgattccctttctttactcctttcctgaaatgatcagatcagagaactatggggaagtgtaatactgaaaatgaggaactagtatgagtaacagtggtatagtttcttcatttgtgaaatggagataatcagaaagctgttgtaagtcagccctggctgcatgtcagttacccagcgggcttttaaatagccccatcttcaggcccagacccaggagatcagaatctctcagggtgagacttaaacactaggagttttaaaattccccaggcaatatcaatgtgtggcctgggttgagaaccactgctctaggatttaaagagttggctacttgctcggaatagagctattttcacatctggctgtgcgtgggaatcattggcggggtagggtggtgcttttaaaattaaactgaagctgggtggtgtggcaggcacctgtggtcccagctactcgggaggctgaggttgggaggattgcttgagcccaggagtttgaggctgcagtgagttatgatcacaccactgccctccagccggggcagcagagccagaccccatctctaaaaataaataaaattaaaccaattccttggtttcacattccagaccatttgaatcagtgacttatgtctctggatgtctcttgctcagccttcacatgaaccacttttgagtaccacgggccaacattacaaatatttccagtcttcacaattctctagcagggaaccctgattcccatttgacagatgagcaaatctatgttcagagcaggtgaaagcataagtctctgaggccaggcctgtctgatcttgaagcctgggggctgggtctggtggagggtgttctctgctcttctggaaacagcccaaggagtgggggacaccagccagcagccttggctccctctgaggctcccctctacaggttgagcagagggctgtgcctgagtgaagacaggtgagacgagtggtggtgtgtggtatttggcgccctcgtagtcacccactctcaaaatacctccttttggggagggaaagatgcctgtgcagtgggcctgccccggtcaccactcattgccacagctgtctcgcaaagagaaaactcaggcaggaaaagcaaacactcatttgctttttgagagtttgaggaatttttcaggcatgtgatatagaaaaaaaatgccactgtttccctcataagaggaaggggaaacaacgtcaacatggcctgaaatgtttagctctagtttacaaaagcccttctgccgtttcacaagtcctaaggctgtcaacacagtgcagggctgggagctgggggatttggatgccaagccaagccctgcgccactgcctatgtgctctgtaaacctaagtgtatcccttaccacccttaagctttgctttccccacaggtcaagtaggaactcagggcttctgtgacaaggtcacagggactctgaaatgccaggccctgccagcggctgcttgaggtgtcggagaggagaggcgtgtggctgccttgacactgagactcagagccacccgggcctggaagctcggtcaagtgtttgttggcacctaccaaggcacccgctgtcctcgaggcccagagtggctccaagagaccatatgtgttagagttcacactgaatgtgttcactctggctctgggaggcctggctccactccacctgcgtcagcccttagtgtgtgcacagctcagagccaatatttggaactgaaatagctaaaaatttagagtcagtggacgatgtaagataaatttggctccacaaagccttctctgcccagtccagcccccaggatcttctctttccctagagctccatctgtacctgttgtctgtgcctttggtccctgccccgtagtgcctagcacagatcctggcacagactggatgcccagacagtgttgattgaatggagattaaggcaatggagagatgcatgagtttgtgtttgggaacgtctctgaagtggctgccatagaatgctacctaagtgttggcctatgtatctgttgcttgctgaacttgactttgttgttgttattgccactccgggtattttgaagactgtctcactgaggatgatgctaatgatggagtggttcagatgcagtgctattttgctattttctgcatttggggcaaatatcccaggcatttccctgtatgtagcttttaacccagagccactaagagtgtacctcttaagtctggagtctgctggccccttattgagccattaagctgaaccagaaaactttctgagttactcaagcagtgggtattttgggtggcaagaaaacatggggcaatgatggcaaatggcagtaaggggacgggaggacccccgggcaagatggtcactgggaagtctctgaggacttagatctgctcctgctggtcactgaactgaggtgcagaagcaggtggttggtgcccttccctgtggggagggcccctggagcactcagggaagctggctcagggctgcctgccactctgccatggactccatttcatgcttgctgtctctgtccctggagtaatgggtttctgagcccagccctgggtactagtgcctgaaggggaataataatggtctagactgctctaactatctcagaggctttgtggacagccggttgggtatctgactttgaggcttggctttgccattaactctgcgatgacctcaggcgagtcacatgacctatccttatgcctcagtttcctaattgtacaactctctgtttataccaagtcctctgactgtgatgctcccccactatgatgattaaccttgttaggctgcctcctctccaaactctacccaaacctggatccccaccagcccagtctgcttatggacattgtgatttcatctggtgggtcctagacttgggttctagctgagattttgcaatgacaaggctatgtcatcctgatcaataacctttctgggcctcagtgctcacctctgtacactgggactaagaatactaacattcattcctcatagaaggaatggacagaagggaagcccagtccctgccccatctcatccacaggttgtcatcaggtggggatgcagactggtggcatgatttgtcctgtcctggcagaatcactctgaatttgtgtgacctggtagctgacagtggggtcatttccccaatgaccacagtgatgacctaatcttgtgggtctgtgtccccacagtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggtgctgcaccacaatgtcatcacgctgcacgacgtctatgagaaccgcaccgacgtggtgctcatccttgagctgtgagtggggtccccaggacccacagggttggggggcagcaggggcaggcagagcagtggaaactccagccacaggccccagggggcagcagcaaccaggcctaagctcagcccagaggaggtgaagtcagtggtgggcagatcccctctgtctcagttacccccttcctccttacccgcttcctcctcctgaaactgagccaaaggaggggcaagcttgctgaatagcaggggcagagggcaatggcctaagtctggctttcactggatcctggagatcaaagggaagaaatgactgcactggggtcttttcctggctggagaagcatgtgggagggtgagtgggacagatggtggggtggggccaggggaggctgtcagcgagggctgtgtactatgaggaggggaagtacaaacatctctgggctctgcgaagcccttctccagccctttcctggggaaagtccactgcatttgtgctgtgaatgacacctttattgttataataatagctattatttagagagtcctactgtaagccaagaatttgctaggcgctttgtatctgtcgtcttgttcaatctttaaagactgtgatgagggaaatgtcttactagtgcagacaggttattttgtattcattgtgcaagccaagtacttctgtaccttatttaatcctcataacaacgctgtcacacagacactcttattatccccattttacagacaagaacactgagaggccaggacacttacaggagcctatagccaggaagtggcaggaccaggacttgagtccacacggcctgtgcagacagctatgagtgtgaggcgggttggccttatgctggcttagcagaggaagacctcacagttcatgatggaatttggatagatgacctcaatactctagggtttggctagccacgctggtatcgtcctgggcaggtggggctctgataaacaatagagtttgagttgggttgtggacaagttacagtggctgtgtccagtcaagcagcaaggactatataaagaatgttctggcctggtgcagtggctcatgcctgtaatcctagcactttgggaggccaaggcgggcagatcacaaggtcggagtttgagaccagcctggctaacatggtgaaaccccatctctactgaaaatacaaaaattagccgggtgtggtggcaggtgtctgtaatcccagctactcgggaggctgaagcagtagaattgcttgaacccgggaggcggaggttgcagtaagccgagattgcatcactgcactccagcctgggtgacagcaagactccatctcggaaaaaaaaaaaaaaaaaaaaaagaatattctgaggctcataagcatgtatacacctgcctggtagcgggagtgatagaatctctcaggaatccctgattttgtgcccttgggcaagtcacctcaattccctgagctttagttctcatctgtaaagcaggcagccatccttaacctgcctacagactcggtggaccacctgacatttgagatcattctaatttgagaactatgctctggtattggcaggatatagatttaagtagcagatggacatttgcatactcttgcatttgattcttaaattatccatctcggtgtttaaatgtatagaattgcctgtgctcttcccttcgctagctcccagtgtcctccatgtttctcccacgggcctcccagctggttggactcctggatgcctgccctgcgtgacccagagagaagctgagggtcagcagtcggcatcctgattcccagcagagagtgacaagcgcacctttctggaaaggccgagccacttcttaaaaagtttattatggggaggaaaaaaaaaaaactaagcaggaatggacaagaaattacatttataatcctacaacccaaacacagctatttatgtttttctgtggttcctctcaatctttatctatttgtatacaatcattgtacttgtataatttcctgctctacttttttccccaattaacataattctaaaaattggcttttctcttttaactgactatatgtttcactgaattgcataccagtatttcccttgtcttagtccattttctattgcttataatagaatatctgaaactggttaatttataaggaaaaggtatttatttcttacagttatggaggctgaggagtccaaggttgaggggccacatttgattaggaccttcttgctaatggggactctctacagagtcccccaaggcagcccagtgcatcacacggtgagggggcagagtgggatatctcaggtctcacttcttatatagctaccagtcccacccatgtaacctgttaatccactaatgcatgaatggattaatccattcataaggacagagccctcataacccaatcacctcttttttttttttttgagatggagtctcgctctgtcgtctaggctagagtgcaatgacgcgatcctggctcactacaatctccacctcctgggttcaagctattctcctacctcagcctcccaagtagctggaattacaggcacccaccaccacacccagctaatttttgtatttttagtagagatggggtttctccatgttggccaggctggtctcgaactcctgaccttagatgatccgcctgccttggcctcccaaagcgttgggattacaggcgtgagccaccgcaccccgacccaatcacgcgtcttaaaggtcccactgcctaatacggccgcattgggaattaaatttcaatgcgagtttgtagggcacaaatagtcaaaccatagcatccttattgttggacacatgctttttatttcctagcttttaaccattacaaattttactgataaaacaactttcttctcatgattttctccttttctttttaattaattctttcagcaaagtcctgaggatttagctaacatccccaggaatgggatgactaagccaaaggctgacatttttgggactcaatatcctcacttttcaaagatggtgctggttaaccattactaccacaacgtaggagtgttgctgtgtgcctgcagccctgccagccctgggtcatttgttttgaaacgtgtttcattatttattgatctttatagctataaattgatactttcttactataattggcatgcctttaattgctggggaaattgcctgcttcttcctgtttgtagaaccctaggagtcggtggcggggatgtggcaggtaaatgctcttgagatgtctgtgtttttcccaacagggctcatggtcagccagttatgtgccggcttcttgtgagctcaggtgcaccatctgtaacatcagttgtcacgctggtgctcccatgacttgcttgggcctctgtgcttattaagttctgtcccgtttctgtctcccccttcacttccaagctgtctcattgttctcagggtgcctgtctatggactgctaagaatttatgagattggagaagacccaagcgttccaagactgtccctaacccatgtatggccaggttctgagagggaggacctcccaggagaggagttcctgggcttttgtttttgtttgtttgtttgttttttgagatggagtcttgctctgtcacccaggctggagtgcagtggcgtgatctcggctcactgcaatctctacctcccgggttccagtgatcctgtgccttagcctcctgtgtagctgggactaccagtatgtgcccccatgcctggctaattttttttgtatttttagtagaggtggggtttcactctgttggccagactggtcttgaactcctggcctccagtgatccactcgccttggcctcccaaagtgctaggattacaggcatgagccaccgcacccagcctcatgggcttttgttgcttagacttagtgactcctgttaggctggtcagaagtcttggcctcgtggtcctcactgtgccctaataggttagtgggtttgcccagtaagtgttagtatccacctactcagttgaaagctgcccagttgcaggttttatgaatgagtctacgctgatcccactgcccctctcagcaactgttgtctggtgcagggcttccgcctgctttctgctcaagtggccagcactaggaggacatgcctggctctgatctaaatccctttcagttgttattatcccatctgtgacctccctagaagcagctgcctctggtcgtgactcttgaaggcaggactgggaaggatttaattgtccatataagttgacttctgtatggggtatagaatatattcaaaatctcagcagcttaactcatgtcacatgtggaactagccctgaaaaatgtaagtctccctgtgaaggttgggctggcctcccatcacaggcccctgactgctctggggcctccttgattccaagcctgtggaaagcgataccgtggtggttgcataccagagaactgcctggcagagtgctccagggtggcagtgatgcttcccaggttcctgaattgagcccagcttcctgggcccagcagctctggcagcatttttcccctatcgctgcctgtgcaggtcattcatgtatacatttccagaagagtctgaaaagcattgccagcaggcatgccaccctgcagggaggaaggaggcaaaggtcagatttgcaggaaggggatgatcctgggaacactaggagaagagatgaggccaggtcgtgaggctttgtttttcatcttaaagctaaagagatgtgggatgtaagaggaaagaaacttggaaggagatggggggtggctccagggcagaggtcttagagggtaaagaaatgacactcaggctccttggtttggctttgaaaagaggtgactgagcattaatgtgaatgtcccagcctgggtatccagggcctagacagtggcaggtcatcagcctcccacctttctgagtttctgggggagattctagggggcacagtggctgttcccttcttcatcccaaggagaccatgtctcaccaggtctcctgcccatatctcaccttcaaacagatgactgattactgcaccccaaagtcctccctcaaccccagacttcatgtcagtggcttttgggaatgctaagctaagaagcttttacactgatgcagcattttatttaaagtaggaattgcagggttattatttatttagatatttgcccgaggtcacaggcccacacaacctggcaggggctggcagactaagggtggagctgggttctgtgtgtttcagagggggcactgcagatgtgaaaatttgcagagagctctggacagatctttcacaaataccaaggcttcactgtctatatgatacagaatattctacatcatgttgttatttttaatgttttatttctttctttcttcttttattcaccaaacttctgattgaatgtctttcttgcactaggtgctgtggaagcaaaaataatatagctggggagagaggaagatagatagtgaagcccactgtgaggagagtgtggatgcagcagagcagggatatcagaggactgcccagtgcctggggctgctttgagcctttccattttgcatcagcacctcaggctttgtaatgtggaagggttgtggtgagagggacacatggtgaactggggctgagaaaatctgggtctaaatcctggtcctgccacttactagctgtgtgatcttgggcaagtcacttgctctcctgagacctcagttttctcatctgagaatgaggatgccctccgggtggatatcaagctcaagtgaggaaatgtttgggaaagcacattgcaccggtggcaaacttcaaataaactctaaatcaagcccccttccaccactgccacccctgatgatgacaccatgtacggtgtttatgtcaaggactttatcaagaatctcatagagattcctctcactcccaccctcacatccaaagctggtaatgaaagcatttttttcactcctgtttcacaagaagaaaagttgagccctagaactctcacatgtcccaccccaaggtgaaggttgtatctttgctgctgaaggattggagccatcatcttggccctttgaccccagtctgcagagcagacccagggttactccagcagctgggagggtgctccagcttccagcacctgcccaaggtgggggcaagggtcagagtggggcaaaggacggcctcacccatgagacactgagaaaatagtgcaccagcctggtccccaacaccaaggcagccaccttaggccacaccctactcgaccctgagcagaggggcgctgcagctatggcagatggtacatatgctcaaatgtgccatcttatctcagtctctcttcaccctttcaccttcccccttcccccttctctttttttgcctcttttttgatgccattgatatgttggaaaactaggccacttgtcctgtttcacagtctggattagacttgttccttcctcatggtgttctttaactcattcctctgttccctgtatttcctgtaactagtagttagatctagaggagataccctgcctattggcgctgtccaatagaaatgtaatgtgaaccacatacataattttaaatttcctagttgccacactgactaaacaaaaagaaataggtgaattgattttaataatatttttatttaaaattattaatgagatattttacattctatttttcaaactaagtcttcaaaatccagtgtgaattttatacttacagcacatctcaacctgtttttttgtttgtttgtttgtttttgagaccgattctcactctgttgcccagggtgcaatggcacaatcacggctcactacagcctcgacctcaggtgatcctctcaacctcctaagtagctggaactacaggtgcacatcaccatgcccagctaagttttttttttttgtagagacagtgtctcactatgttgcccaggctggtcttgaacttctgggctcaagtgatctgcctgcctcagcctcccaaagtgctgagattacaggtgtgagccactgtgcccagcccacatttcaattcttacgcaaagcaatgcaacggttaaagtgaaatgcaattctactgaaacaataaagttgtatttaatggaaaatattttataccacttcagtttttaaattagaattaattaaaattaaataaaagttaaaattcaattcctctattacactagccacattgcaagtgctcagtaaccacatgtgactagtggctactctattggacagcacatatctagaacattttcatcattgcagaaagttctgttgatagtgctgaacaagaggcttaagcggatttaggttccattttgtaagtcacagcatatcataggtgttgctgtgtactttctatgtcactattttatgtccggttgttctacttttcatgatgctaagattattgagtgggtccaggtgtgcttctggaaatgtttaaagaaaggagaaaagaagattttgatgttctttatttaggatggactagggggcagggaatgatccccaaagttgggttggagccattttagccatataagaatcatctggagccgagcgcaatggctcacacctgtaatcccaacactttgggaggctgaggtggacggattgcttgaggtcaggagtcccagcttggccaatatggtgaaaccccatttctactaaaaatacaaaaattagctgggcgtagcggcatgtgcctgtaacctcagctactcaggaggctgaggcctgagaatcagttgaacctgggaggcggaggttgcagtgagctgagatcgcatcactgcactccagcctgggcaacagaatgagactctgtctcaaaaaaaaaaaaagaaaagaaaagaatcatctgcaatactcagtatgctgtagtggttgagagctgttctgcttgggtttgaatcctgactctatttactagctatgggactgtgggcaagttgcttaacctctctgagcctttgtttctttaagtgtgaaatagaaaaatgttagtccttagatcataggatattgtgatgattaaatgagataatgtgcataaggcatgtaacatagagtatgtgttcaatgaatattaattgctattattatgttgttatagtaaaaatacaggttttaaggcctcactgctggagaatctaatttgttaaagtctatggtgggatctggaaatctgcattttaaaacaagttctccaagtgatcccaaggtcctggatcccttggcctagaacccttcctgagatctttccctttgggcccatggctttatttcagccccagtggagcacatgctggctggataccccagcttctgtcagaggattgtaaaccaaaaattaaattctaagccccctcaaccaactgaatagacccctctctcagccaaggagattccaaagtaaacctgaaaaactttcaggccatggtgggaagaggggttggacatgcctcattatactctctgcccatttaaattcgggcacaagtgaccagcattaatatgaaaacagtgaacttaagcctaacaaaacagactctttgcagcaataagataataaattccaacctgactctactataacatcacatgacaaatagcaggccctgaaagaaatagaagtattttaccctaataaatcttttgacatattttgaaatggccctgcaaagctgactcttgtgggaaaaatctatattctgtggagaatctctgttcctttccatgtctttttctgatcctgaagagattagctgagagtctagcaccttttaagaatatgaatagtaaacatttgccatctattgcctccaagggcagccacctgtgagacttcatctacataataaaaaccttggtctccataacccttgtcttaactcagacactcttttctattgattccaggtctttcaataataaccaattgccaatcagaaaatccacctgtgacctagaagccctcccaaccccctatcctcaccttcaagttgttccacttttccagatggaaccaatgtacaccttagatttattgattctgcctgtaacttctgtccccctaaaatgtataaaatcaagctgttacccaactaccttgggcacatgttctgaggaccttctgggactgtgtcatgggtcttgagcactcatatttggctcagaataaacatctttaaatattttacagagtttgactctttttgttgacaggataaataagcccaagtagggttgccagatttagcaagtaaaaacctattttatctggcaattctaaatctcaggggagattttttttgctctgtcacatcaactataggaagcaagaatgtagagtgtgaaaaagtagtatcaaacatcaaaaacagtattctagagtctttaaaaatgaatataattaatggggtcttatgcttaagttaggggccatacttagattctcttgagccccataaaggggccatcttttataaaattgaagaaagggggctttggggctgtcttgctcagtctgcttcttttgtaggtaatgaaaccagggcctgcctggagaagggaaatgagttgtccaaggtcagtggcaaggctggaatggaacctaggtctttagtttctggcacagcatttgttcctcttcgtcatctgtcttagtccattcagactctggcattctgtctctgccccccaccccaattaatgtccttttcaaatgtaaaatacattccttccattccaatagttccaaaactcttaattaattccagcatcaactccaaagtttaaagtccaaagtctcatctaaatatctaaatcagatgtgggtgagactcaaggtatgattcattctgaggcaagttgctctccagctgtgaaccaatgacatcaaacatgtcgtgttacaaaatatgatggtgggacaggcagaggatacacattcccattctaaaaggaagaatgggaaagaataaaggagtgacaggttctgagccagtacaaaacattgagaagaatctttggctcattgctctgccctccaggcccatgggggtggaatggaggtcttgcccctgcagctttgagcaaccctgcccataaggctttgctctccaaacattggcccccacaccaaaggcagttctctgcccaggggcccaccagctctctaaggcatcttgtgaaatccaggtgaaagcagccacacacccaccagctttgcttggcacagagcttgccacactgttgccctccaggagccacacctggtatgtctgaggagtatggcaacagagtttggagagcaaagcccacaatgtgaggcagcactgggcagtggaggcccctcctttgatatcattctgccctctaagctctggcactatgaatctgtgatgggagggacacccctcttttcacccccacgatctctgaaatgacttcagggttattcttccattgtcttggacaataggtcctggcttctgtttagatggctgactaatccccttattgtcttgatgaatagcacctggcttccctggagagccatattaatctttttatcaaatggttgcttggtcatacctttgttctttcccaaacaggttttcttatgttttccaatatgaggaggctgagaattttgcatacttttaagctttcttccctttgagtaacaattttgtctttaaaccatttcttttcacattttactttaagtagtcaagaggaaccaggacactcttccaacactttgcttagaaatctcctcagccaaatattccatttttattgcttacaagttctgcctcctataaaacactagggcacacacacaattcagccacgttctctgctactttataacaaggatgccctttcctccattgaccagaccagtaacatgttcctcatatccatctgagacattatcagaatggcctttccatctgtatttctacaaatattttgttgatggccacttaggtattctctaagaagattgagaatctcctctctttgtgatccctcaccaggaccacccttacagtccattcattcatggcaatgtaggctttttctggttggcaccccaaacctcttccagcctctacttgttagctgattccaaagcagcttccacatttttaggtatctgttacagtagcactccacacttggtaccaatttcctctctcagttcattcaggctgctgtataacaaaataaccataaactgggtggctgacaaacaacataaatttatttctcacagtcctggagtctgggaagtctaagatcaagatgaaggttcacttcctcatagatggctgtcttttgactgtaacttcacatagtgcaaggggaaagtaagccctctggggtctcttttataagggcactaatctcatttgtgaggtctctaacttcatgacttaattacttcccaaaggccctatctcctaataccatcaccttgggggttagaatttcaaaatatgaacttggaggaacgcaaacattcaggctaaataatctgcttgtttttgtcccctgccatctcaggcatatggaggggagagggcaacctccagggtgactgggaccagggcctagagtgggagcagaggctcttctgacaacacctccagggtgattcctgcccttgtgatccaaaagaaagaacaaagcaaataggagcaaagtcagtccctggcactggacagacaaagccccagaaataagccagggggattctgccatacaaggtccctggggggtcaggatgagggcttgcccctatcagcccagcctcatgacatgcagagctgactgggcctgggcctcccctccccccgctggtgttttacagagtgtctggaggagagctcttcgatttcctggcccagaaggagtcactgagtgaggaggaggccaccagcttcattaagcagatcctggatggggtgaactaccttcacacaaagaaaattgctcactttgatctcaaggtcagtaaggggagaaagggaaaagaatcaagtttaggaagaagaggcttagtccctcctggtgtctttcccaggatgggcccagtgccgaccagcccttctttctcatcttacagtgaaaaaccctgagctcatgggaaagatgatgccacggaaatgtccaccttctcagtttcatttttcataacaggttttctgcacactggagctgactgcaagaagctgcttaaatcagacttcaggcaccttatttatttcagggagcaggggggaacactttctaaataagtagaccagtgacaggaaacttgaaaccaaacacctttcacaagactgaacttttcagtaacaaaaaactagaaatgtttggaggattgctgaagttggctggctcgccagacccattcatagtgcagcctccatcatcccttgaccagagcttgtaaatcctggagcccagggaccactggctgccctccccaactcacaacccctactgtgctccaaactgtggtcataaaactgcttgtaggggccactgatcatttatggtgactggtattcaggactgagagagttcactgtgaccacataggacttcataaagcaagaatgtggtcaaagtagaaggatcagttcccttagtaactgagctcagttgcatagactgatgagcctatacagatacttaatgtgtaaagtcctctaactttgatcaattctatgacctgtttgctggggagatcccttcatttttctatccagaaatccctgtggtctttcaagcatggtgctgggtgcttgggtattgctgctgatacaaaattcactgaggccctgtctgagattacttcatcttttccaggaaccttagtgtaggagatagaaaaaccagcaactctaagtactatgctagaaggaagcccagggtgggtggggaggctaaaggaggggacatctaagtccaaccggggtatcagagagggctccctggaaaaagtgctatgtagttgagttctgaaggattggtaggaaatagaagaagagaagggccttataaggaagaaaggccagcagaatacatggtcacaaaacagcacaatgcattcagggaagtacaggcatgggaagtgtgtgctgagtggctggggaagaagccaggaacagtgcaggaagcagacacaagggtctgggagctaagccaaggagcttgcactttaccctgagagataagggttcaggtgagcagagaagtgaggtaagcatgtacttgtttcagagtgatccctctggctgggaggatggataggctggagacagcctggaggctggggctcagctaggaggctaaagcaataatctaggtaagatgtgaggagaggacagagtcaagatcttttgcagaggtcaatctgaggattgattaggtgcctaattagaggtagagatgaaggaggggacagggttctggatgacacccaagttctggcttgtgcccctggcccagagagggtctggcatgtccattatctcacagtggctatgccagggcatgagctcagttcccatatgagtccctaccccagctcttactctactctgcctgatagggtgaccttctatgagtccccttagcatggtcctccttccttaggctcactgtcactttttttttttttttaatagagatagtctcgctctgtcacccaactggagcacagtggtgtgatcacagctcactgcagcctcgacttcctgggctcaatctatccacttgccttagcctcctgaatagctgggactaaaggcgtgtgccaccatacctggctaatttttgtattttttgtagaggcggggtcttgccatgtttgcccaggctggtcttgagctcctgggctcaagtggtccacccgcctcagcctctcaaaagtgttgggattacaggcatgagccactgcgtctggccatgattgtcagtttgtttttggtgtttctttttgggggggacagggtctcactctgtcacccaggctggagtgcagtggcgtgatctcagctcactgcagacttgacctctcaggctcaggtaatcctcccacctcagcctcccaagtagttgggactacagaaacatgccaccatggccagctaatttttgtatttttttgtataaatgggtttttgccattttgcccaggctggtctgcaactcctaggctcaagcaatctgcccacttcagcctcccaaagtgttgggactacaggcatgagccactgctcctggctgtcacggtattttttaatacctccaacagaagtcttccagagttttactgaggcgtcacagggtaaaaatgggggtcaccaaggatggtgaggcctgggcaggcctttggacctcagggtagtaacagcaggaaatggtctgccttgattgcacctgtgtgacttcctggtactgctgtggacaattaacttgttgttttattgtgtctttgctggctccaggagagctgcttcaaaatgggctcctttgtcttttcttgaatgggtctggtaggaggagtggctggagcccaacaggcaccaatgactgcagcaggttcgtgatgtttggcttgcctttatggcagctcgctgtggtggggagagcactggcttggagttagccaggctgagttaccatgtaccatgatacacctgaacctcagcttttcagcttcaatgcaaataatacctacctggcagagctgtaagggttagagagaagcattaagtgccagatatggaataggtgctcggtaatagtagctgttattgttattccccttctcagaatagaggaaaaggaaatagaacttttgttacagtgttgtgggccccatagactaggaaaacaaaccctgtgagtacagttctgttaataaattgtccagcagagagctgagttggttgctaggtagaactgctggcgagggctggtgaggctccggggctaacctggacattttccattacctggaaacagtctgggttttctctggatgcatgtgaggtgaggatgctgccagtccccaccatggccaggtatccttagagttgtgaggacctgagctttctgattcttccacccgtgggtcccttggcctaggcccacctgggcaacttcaggaagtgatgagtagctggaactcagaaggattacctcatgatcgggtacatgtttcctggagccagaatgtgggtatgcatgcctcctggctggaacattctgtctcctggaggggatcatgcaattaagatccagctggtagcttagaggaggcttcttggttctgtgttgtttcccaccatataaaatccacatttttcttcctgattttcattctccatgatggattttcactttcctctcctgcttatattctgttaactccttcccaagctcagggtccttactgccccaggaacacagccagcatgttgtctccacacccttacccataacctgttctctatgcacaccttccagcttgaaggggcaggtaatagaagagggttcactctcttgcctacctttggaatgtgaacaacctctcttcaggctggtatttaatcagcttctcctatgttcagccattgtgcaatggacagtcaggctctgtccctgctcaccacatgctcctagcctcgttgcagggagccgacaaatggatatttttttttctttttgagacagagtctcgctctgttgcccaggttggagtgcagtggcacaatctcggctccctgcagcctctgcctcctgggttcaagtgattctcctgcctcagcctccttagtagctgggattacaggtgcctgccaccacgcccagctaatttttgtatttttagtagagacagggtttcaccatgttggccaggctggtcttgaactgctgacctcaggtgatccccaccacccaccttggtctcccaaagtgctgggatcataggcatgagccaccatacccagtccaaatggacaaattaatatgagataagcagtattggtaaaaacaggagacagagcaagatgaccgaatagaagccttcactgatcaccctccctgcaagaacaccaaattgaacaactatccatacacaaaaaaagcacctttgtaagaaccaaaaaccaggtgagaggtcacagaacctggttttatttattgttttattttattttatttatttatttttttgagactgaatcttgcactgttgcccaggctggagtgcagtggtgcaatctcggctcactgcaaactccacctaccaggttcacgccattcttctgcctcagcctcctgagtagctgggactacaggcacccaccactatgcccggctaatttttttgtatttttagtagagacggggtttcaccatgttagccaggatggtctccatctcctgactcgtgatccgcccacctcggcctcccaaagtgctgggattacaggtgtaagccactgcgcccggcccacagtacctggttttaatttcatatcacagaaagaggcactgaagagggtaggaaagacagtcttgaatcacctataccaccccttccccatcttctggcagcagccatgttgcatggagaaagaacctgtgcacttgggggagggagagtgcagcaattgtgggactttgcattgaaactcagtgctgccctgtcacagcagaaagcaataccaggcagaaccccgctggaacccatggaaggagcatttagactagccctagacagaggagaattgctcatcctagtggtcagaacctgagttccagcaagcctcaccactgcagactaaagtgctctgggtttctaagtaaacttgaacggaagtctaggccacaaggactgcaattcctggacaagtcctggtcctgtgctgtgcttggagccagaggacttggagggtacacctagtgagacatcagttgggatggccaaggaagtgcttgtaccacacctccctcagcccctggcagcacagcttgcaactccaggagagaatccttccctccacttgaggagaaaagagggaaaagtgaagaggacttcatcttgcaatttggataccagctcagccacagtaagaaagggcacaaggcagagtcttgaggcccccattccaggccctagatctcagacaacatttctagacactctctgagccagaagggaatccactgccttgaagggaaggacccagtcctggcaggattcatcacctgctgactacagaggccctgggccctgaatagtcagcagtgacatccagtgtatcactcagagatgtgcactcagagacatgctggcttcaggtgtgacccagcacattcccagctgtggtggctatggaaagaggaaagggaatgataaaggggactttgtcctgcaacataggtactagcttgaccacagtggggtagagaaccaagtgggctcttcgggtttccaatttcaggccttggctcttagacagcatttctggacctaccctgggccaaaggggagcccactgccctgaagggagagtcccacgcctggcagtattcaccacaagctgactgaagagtcttggggccttgaatgtgcactggcagtagtcagggagtacttgccataggcctggggcagtgggggccatggggggagatgcctccgcttgtggaaaggggagggaagagtgggaaggactttgtcttctggcttagataccagctaggccacattagaatagagcaccaggtagattcccaaggtttccaactccaggccctggctcccagatggcatctctggaccacccaagggggggaagctcaccaccctgagggaaggacacaagcctggctggctttgccacctgcctattgtagagccctagggccttgagcaaacatagccagtagccaggcagctgttataagccttgggcaagacccagggccatgctggcttcaggtctgacccagcacaatcccagtggtgatggccacaggagtgcttgtgttccccctcccctagccccaggcaggtcagtacagagagagacttcatttatttggaagaaagtaagggaagagaacaagagtctctgcctcctaaaccagataatttttctggatcttatccaaaactaccaaggcagtacctttacaagtctgcaagaaccacagcattactgggcttggggtgtcctctaatacagatttggctggagtgaccaaaaacttagattacaacactcaagtcctttcaaatatctggaaagccttcccaaatagatgggtacaaacaaacgaagactgaagactagaataaatacctaattcttcaatggccagacatcaataaacgtccacaagcatcaaaaccatccaggaaatcatgacttcaccaaatgaactaaataaggcaccagggaccaatcctggagagacagagacatgtgacctttcagacagagaatttagaatagctgttttgaggaaactcagtgaaaatcaagataacacagagaaggaattcagaattatatcagataaatttaacaaagagatttaaataattaaaaagaatcaaacagaaattctggaagtgaaaaatgcaattgatgtactgaagaatgcgtcagagtctgttagcagcagaattgatcaagcagaagaaagaattagtgagcttgaagatagactattcgaaaatacacagaggagacaaaagaaaaaaaaagaatgaagcattcctataacatctagaaaatagcctcaaaaaggcaaatttaagagttattggccccaatgaggaggtagagagatagaggtagaaagtttattcaaagggataataacagaacttcccaaagctagagaaagatatcaatattcaagtacaggaaggttatagaacacaaagaaggttaaacccaaataataatcaaactcccaaaaattaaagacatttaataatcaaactcccaaaagtcaagagtaaagaaaggatcctaaaagcaagagaaaagaaacaacatacgatgaaactccaatatgtctggcagcagactttgtagtggaaaccttataggccaggagagggtggcatgacatatttaaagtgctgaggaaaaaacctttattctagaatagtatatccagcaaaaatatccttcaaacataaaggagaaataaagactttcccagacaaagaaaatctgaggatgtcatcaataccagacctgtcctacaagaaatgctaaagggaattcttcaatctaaaggaaaaggacattaatgagcaataagaaaccatctgaaggtgtagaacttactggtaatattaagtacacagaaaaacacagaatatcataacactgtaattgtgtgtaaactacttgtatcttgagtagaaagactaaatgataaactgataaaaaataactacaatgtttcaagacagacagtacaataagatataaacagaaacaaaaagttaaaaagtgaggggagaaagttaaagtgtagagtttttattagttttctctttgcttgttagcttgttcatgcaatcagcattgttgtcattagtttaaaataatgaattatatgacagtgtttgcaagcctcatggtaacctcaaatcaaaaaacctacagcagagatataaagaaataaaaagcaagaaattaaaacttaccaccagagaaaattaccttcactaaaaggaagacaggaaggacggaaagaaggaaaagaagacaacaaaacaaccagaaataaaaaagcaaagtggcaggagtaagtccttacttatcagtaataacattgaatgtaaatggactaaattctccaatcaaaagacatagattggctgaatggattaaaaaacaaaaaacagttaagaggttccaagatggccgaataggaacagctccagtctgtagctcccagcgtgagcgacgcagaagatgggtgatttctgcatttccaactgaggtaccgggttcctctcactggggcttgtcagaaagtgggtgcagcccatggagcagggaggggcatcgcctcactcgggaagcacaaggggtcggggaattccctttcctagcaaagggaagccgtgacagatggtacctggaaaatcgggacactcccaccctaatactgcgcttttccaatggccttagcaaacggcacaccaggagattgtatcccgtgcctggctcagagggtcccatgcccacagagccttgctcactgctagcacagcagtctgagattcaattgcaaggtgggagcaaggcttggggaggggcatctgccattgctgaggcttgagtaggtaaacaaagtggccgggaagttcaaagtgggtgcagcccactgcagctcaaggaggcctgcctgcctctgtagactccacctctgggggcacggcatagctgaataaaaggcagcagaaacttctgcaaacttaaacgtccttgtctgacagatttaaagagagtagtggttctcccagcatggagtttgagatctgagaatggacagactgcctcctcaagtgggtccctgacccccgagtagcctaactgggagacacctcccaataggggctgactgacacctcatacagccaggtgcccctctgaaacaaagcttccagaagagggatcaggcagcaacatctaccgttctgcaatatttgctgttctgcagcctccgctggtgatacccagtaaaacagggtctggagtggacctccagcaaactccaacagacttgcagctgaaggtcctgattgttagaaggaaaactaacaaacagaaagaacatccacaccaaaaccccatttgtacgtcaccatcatcaaagaccaaaggtacataaaaccacaaagatggggagaaatcagagcagaaaagctgaaaattctagaaatcagagggcctcttctcctccaaaggaacgcagctcctcgccagcaatggaacaaagctggacggagaatgactttgacaagttgagagaagaaggcttcagacgatcggtaataacaaacttctctgagctaaaggaggatgttcgaacccatcgcaaataagctaaaaaccttgaaaaaagattagacgaatggctgactagaataaacagtgtagagaagtccttaaatgacctgatggagctgaaaaccctggcacgagaactatgtgacgcatacacaagcttcagtagctgatttgatcaagtggaagaaagggtatcagtgattgaagatcaaatgaatgaaatgaagtgagaagagaagtttagaggaaaaagagtaaaaagaaacaaaaaaagcctccaagaaatatggactacgtgaaaagaccaaatctacgtttgattagtgtacctgaaagtgacggggagagtggaaccaggttggaaaacactcttcaggatattatccagtagaacttccccaacctagtgagacaggccaacattcaaattcaggaaatacagagaacgccacaaagatactcctcaagaagagcaaatccaagacacataattgtcagattcaccaaagttgaaataaaggaaaaaaatgttaatggcagccagagagaaaggtcgggttacccacaaagggaagcccgtcagactaacagcagatctctcggcagaaaccctacaagccagaagagagtgggggccaatattcaacattcttaaagaaaagaattttcaacccagaatctcacatctagcaaactaagcttcataagtgaaggagaaataaaatcctttacagacaaacaaatgctgagagatgttgtcaccaccaggcctgccttacaagagctcctgaaggaagcactaaatatggaaaggaacaactggtaccagccactgcaaaaacatgccaaattgtaaagactatcagtgctaggaagaaactgcatcaactaatgagcaaaatagccagctaacatcataatgacaggatcaaattcacacataacaatattaaccttaaatgtaaatgggctaaatgctccaattaaaagacacagactggcaaattggatagagtcaagacccatcagtgtgctgtattcaggagatccatctcacgtacagagacacacaggctcaaaacaaagggatggaggaagatctaccaagcaaatggaaaacaaaaaaaagcaagggttgcaatcctagtctctgataaaacaactttaaaccaacaaagatcaaaagagacaaagaaggccattacgtaatggtaaagggatcaattcaacaagaagtgctaacgatcctaaatatatatgcaaccaatacaggagcacccagattcataaagcaagtcctgagagacctacaaagagacttagattcccacacaataataatgggagaatttaacaccccgctgtcaacattagacagatcaacaagacagaaagttaacaaggatatccaggaattgaactcagctctgcaccaatcagacctaatagacatctacagaactctccaccccaaatcaacagaatgtacattcttcccagcaccacatcacacttattccaaaattgaccacatagtttgaagtaaagcactcctcagccaatgtaaaagaacagatattataactgtctctcagaccacagtgcaatcaaactataactcgggattaagaaactcactcaaaaccactcaactacatggaaactgaacaacttgctcctgaatgactactgggtacataacgaaatgaagacagaaataaagatgttcttttaaaccaatgagaacaaagacacaacataccagaatctctgggacacatttaaagcagtgtgtagagggaaatttatagcactaaattcccacaagagaaagcaggaaagatctaaaattgacaccctaacatcacaattaaaagaactagagaagcaagagcaaacacattcaaaagctagcagaaggcaataaataactaagatcagagcagaactgaaggagatagagacacaaaaaacccttcaaaaaatcaatgaatccaggagctggttttttgaaaagatcaacaaaattgatagactgctatcaaggctaataagaaaagagagaagaatcaaatagatgcgataaaaaatgataaaggggatatcaccaccaatcccacagaaatacaaactaccatcagagaatactataaacacctctacgcaaataaattagaatatctagaagaaatggataaattcctggacacatacactcttccaagactaaaccaggaagaagttgaatccctgaatagaccaataacaggctctgaaattgaggcaataattaatagcctaccaaccaaaaaatgtccaggaccagacggattcacagccgaattctaccagaggtacaaagaggagctggtaccattccttctgaaactattccaatcaatagaaaaagagggaatcctccctaattcattttatgaggccaacatcatcctgataccaaagcctggcagagacacaacaaaaaagagaattttagaccaatatccccaatgaacatcgatgcaaaactcctcaataaaatactggcaaaccaaatccagcagcacgtcacaaagcttatccaccacaatcaagttggcttcatccctgggatgcaaggctggttcaacatatgcaaatcaataaacgtaatccatcatataaacagaaccaaagacgaaaaccacatgattatctcaatagatgcagaaaaggccctcaacaaaattcaacagcccttcatgctaaaaactctcaataaactaggtattgatgggacgtgtctcaaaataataagagctatttatgacaaatccacagtcaatatcgtaatgaatgggcacaaactggaagcattccctttgaaaactggcacaagacaggaatgccctctctcaccactcctattcaacatagtgttggaagttctggccagggcaatcaggcaagagaaagaaataaagggtattcaattaggaaaagaggaagtcaaattgtccctgtttgcagatgatacgattgtatatttagaaaaccccatcatctcagcccaaaatctccttaagctgataagcaacttcagcaaagtctcaggatacaaaataaatgtgcaaaaatcacaagcattcttgtacacaaataatagacaaacagagaaccaaatcacaagtgaactcccattcacaattgcttcaaagagaataaaatgcctaggaatccaacttacaagggatgtgaaggacctcttcaaggagaactacaaaccactgctcaatgaaataaaagaggacacaaacaaatggaagaacattccatgctcatgggtaggaagaatcaatattgtgaaaatggccataatgcccaaggtaatgtatagattcaatgccatccccatcaagctaccaatgactttcttcacagaattggaaaaaactactttaaagttcatatggaaccaaaaaagaccccacattgtcaagacaatcctaagccaaaagaacaaagctggaggcatcatgctacctgacttcaaactatactacaatgctacagtaaccaaaacagcatggtactggtaccaaaacagacatatagaccaatggaacagaatagagccctcggaaataataccacacatctacaaccatctgatctttgacaaacctgacaaaaacaagaaatggggaaaggattccctttttaataaatggtgctgggaaatctggctagctatatgtagaaagctgaaactggatcccttccttacaccttatacaaaaattaattcaagatggattaaagacttaaatgttagacctaaaaccataaaaaccctagaagaaaacctaggcaataccattcaggccatacacatgggcaaagacttcatgactaaaacaccaaaagcaatggcaacaaaagccaaaattgacaaatgggagctaattaaattaaagagcttctgcacagcaaaagaaactaccatcagagtgaacaggcaacttgcagaatgggagaaaatttttacaatctacccatgtgacaaagggctaatatccagaatctacaaagaacttaaacaaatttacaagaaaaaaaaacaactccatcaaaaagtgcacaaaggatatgaacagacacttctcagaagaagacatttatgcagccaacagacatgaaaaaatgctcatcatcactggccatcagagaaatgcaaatcaaaaccacaatgagataccatctcacaccagttagaatggcaatcattaaaaagtaaggaaacaacaggttctgaagaggatgtggagaaacaggaatgcttttacaccgttggtgggactgtaaactggttcaaccattgtggaagacagtgtggcgattcctcatggatctagaactagaaataccatttgacccagccataccattactgggcatatacccaaaggattataaatcatgctgctataaagacacatgcacacatatgtttattgcggcactattcacaacagcaaagacttggaaccaacccaaatgtccatcgatgatagaatggattaagaaaatgtggcacatatacaccgtggaatactatgcagccataaaaaatgatgagttcatgtcctttgtagggacatggatgaagctagaaaccatcattctgagcaaactatcgcaaggacagaaaaccaaacaccgcatgttctcactcataggtgggaaatgaacaatgagaacacttggacacggggtggggaacatcacacaccggggcctgtcatggggtggggggaggggggagggatagcattaggagatacacctaatgtaaatgacgagttaacgggtgcagcataccaacatggcacatgtatacatatgtaacaaacctgcgcgttgtgcccatgtaccctagaacttaatgtataataataataaagaaaaaaccagacccaatgatatgttgcctacaagaaatgcatttcacctacaaaggcacacatagactaaaagtaaagggatgaaaaaagattttccaggccaatggaaactaaaaaagagcaggagtagctatatttacatcagacaaaatagatttcaggataaaaactttagagagacaaagccattatataatgataaaagggtcagttaagcaagaagatataacagttgtaaatatgtatgcatccaacattggaggaccttgctttcagcattggacagatcatccagacagaaaatcaacaaagaaacataggacttaatatgcattatagaccaaatggacctaatagatatttacagaacgtttcatctaatagttgcagaatacacattctgctcagcacatggatcattctcaagcatggaccatatgttaggccacaataaaagtctttaaaaaatttttggccaggtgcagtggctcacgcctgtaatcccagcactttgggaggccgaggcaggtggatcacgaagtcaggagattgagaccgttctggctaacatggtgaaaccccatctctactaaaaatacaaaaaaattagccaggtgtggtggtgggtgcctgtagtcccagctacttgggaagctgaggcaggagaatggtgtgaacccaggaggtggagcttgcagtgagctgagattgcgccactgcactccagcctgggcgacggagtgcgactccatctaaaaaaaaaaaaaaatttaaattgaaatcatatcaagtatcttctctgaccacaatggaaaaaaactgaaaaataataacgaggaattttggaaactatacaaacacatgggaattaaataatatgcttctgaatgaccagtgggctattgaagaaattaagaaggaaattgaaaaatttcttgaaaaaaatgataatgggaatacaacataccaaaacctatggggtatattgaaagcagtattaagagggcttttgcaaaccaaatccaaaattagtagaagaaaagaaataataaagatcagaacagagataaataaaagtgaaatgaagaaaacaatacaaaagatcagtgaaacaaaaaagttggttttttgaaaaggtaaaatcaacaaacttttaaccagacctactaagaggaaaaaagacccaaataaataaaatcagagacgaaaaaggagacattacaactgatactgcggaaactcaaaggatcattagtggctactgtgagcaactatatgatttccaataggctggacaacctagaagaaatggatacatttctagacaggtacaacctaccaggattgaaccatgaagaaatccaaaacctgcacaccaataacaagtaagaagatcaaagctgtaatatgaagttttctggcaaagaaaagcctggggccctatggctttactgctaaattctatcaaacatttaaataagaactaatgccaggccaggtgctgtggctcatgcctataatcccagcactttgggaggctgaggtggggagagcacttgagctcaggagttcaagaccaacctgggcaacatggagaagccctgtctctactgaaaatacaaaaattagctgggtgtggtggtgcatgcctgtagtcccagttagttgggaggctgagatgggaggatcacctaagccctggaggcagaggccacgtgagccatgatcaccccatttcactccagcctcggtgacagagtgagaccctgtctcaaacaatgacgacaacaacaacaaagaactaataccaatcctactcaaactatgctgaaaaatggaggggggaatacttccaaagtcgttctaagaggccagtattatccttataccaaaaccagacaaaaacacatcaaagaaaactatggaccatatccttgatgaacattgatgcattataccaacagagttaaggaaaaaaacataatcatttcaattgaagctgaaaaagcatttgatagaattcaacatccccacatgataaatatctcaacacaataaaagccgtatataacagacccactgctagtatcatactgagtgggtaaaacctgaaagcctttcctctaaaatctgtaacacaacaaggatgcccactttcaccactgttattcaacataatactggaagtcctagctagagcaatcagacaagagaaagaaataaagggcgtccaaattggacaggaagaggtaaaattatccttgtttgcagatatgatctcatatttggaaaaacctgaagactccaccaaaaaattgttagaactgataaacgaattcagtaaagttgcaggagacaaaatcaacatgtaaacatcagtagtatttctatatgccaacagcgaactatctgaaaaagaaatcaagaaagtaatctcacttacaatagctaaaaagaaacctaggattaacttaaccaaagaacaaaatatgtgaaagatctctataatgaaaactataaaacattgatgagagaaattgaagaggacacacaaaaaaatggaaagatattctatgttcatggattggaagaattaatattgttaaaatgtccatactacctaaagcaacctacagattcaatgcaatccctataaaaataccaatgacattcttaaccgaaatagaaaaaacaaaacctaaaatgtatatggaaccacaaaagacacagaatagccaaaactatcctgagaaaaaagaacaaaagtggaggaatcacattatctgacttcaaattatatgacaaagctatatagtaaccaaaacagcattgtactggtataaaaacagacacatagaccaaagaaacagagtagagaactcagaaacaaatacatacatctacagtgaactcattttcgacaacggtgccaacaacataactggggaaaggacagtctcttcaataaatggtattgagaaaactacatatccacatacagaagaataaaactagacccctgtttcttaccatatagaaaaattcaaaatggattaaagacttaaatctaagatttcaaactatgaaactactaaaagaaaacattggagaaactttccaagacattggattaggcaaagatttcttgagtaataccccacaagcacaggtaaccaagaaacatagacaaatgggatcacatcaagttaaaaagcttctgcacagcaaagaaaacaatcaacaaagtagagacaacccacagaatgggagaaaatatttacaaacaacccatttgacaagggattaataaccagaatatataaggagctcaaacaagtctgtaggaaaaaaatctaataatctgatttaaaaatgggcaaaatcagcatcacaggaaaggttaaaaaatgggcaaaagatctgaatagacatttctaaaaagaagacatacaaatggcaaacaggtgtatgaaaaggtgctcaacaccattgatcatcagagaaatgcaaatcaaaactccagtgagacatcatctcaccccatttaaaatggcttttatccaaaagacagtcagtaacatgctggtaacaatgctgagaaaggggaacccttgtacactgttggtgggaatgtaagttaatacaaccactatggagaacatttggaggttcctcaaaaaactaaaaatagaactaacataacgatccagcaatcccactgctagatatatacccacaagaaaggaaattagtatattggagaaatatctgcacttgtgtgtttattgcagcactgttcacaattgccaagaattggaagccaccaaagtgtccctcagcagacaaatggataaagaaaatgtggtaaatatacacaaataagtactattgagccataaaaagaatgagatcctgtcatatgcaacaacttggatggaactgaaggtcattatgttaagtgaaataagccaggtacagaaagacaaactttgtatgttctcatttatgcacgctaaaaattaaaacagttgaactcatgagatattgagagtagaaaaatggttgccagaacttggatggagctggagactattatcctaagtgaagaaactcaggaatggaaaccaaacattgtatgttctcactcataagtggaagctaagctatgaggatgcaaaggcacaagaatgatacaatggactttggggactcgggggaagggtgggaggggggtgaggtataaaagactgcaaattgggttcattgtatactactcaagtgatgggaacaccaaaatctcacaaattaccactaaagaacttatgtaaccaaacaccacctgttcccccaaagcccatggaaataaaatttctggttgccagagcctcagaagggtagaggggccaggccaggggtggggggaagggagactggttaatgggtacaaatatgtagttagataaatgaagatgatctagtatttgatagcacaatagagtatagccaacaataagttattgtacatttaaaaattactaaaagagcataattgctttgtttgtaacacaaagggtaaatgcttgagatgatggataccctgttcatcctgatatgattattatgcattgtatgcctgtatcaaaatatctcacataccccataaatatatacacctactatgtacccacaaaaataaaaaaataaataaaaaaaaacagatcatggaatgctcttgcccaaaaatctgtgatgagtccttgttagccataggatgaatgaacccactcttagcatgacattctcgggcctttcttgtactgccttagccctatttctgtcctcatccactgttcctctctccaaaacctagccccgggcaacaagatacagatacataccctggcctctcttctcctctgtttgtgctattctcatcccagatgctgctgctcttccttttttctgctcatggatttcctgctaatcactcaaggcccaacagaattgccatttcctccggaacactttcaccatccttgccacctctgaaaagcgtaactaagaactaatctgcctttctgcttccgttgttctttgtacaaacttttttttcttttcttgagatggaatctcactctgtctcccaggctggagtgcagtggcaggatctcggttcactgcaacctctgcctcccaggttcaaacgattctcctccctccgcctcctgagtagttgggattacaggcatctgtcaccacgcctggctaatgtttgtatttttagtagagatgggttttcaccatgttggccaggctggtctcgaactcctgacctcaagtgatccgcccgcctcagcctaccaaagtactgagattacaggcatgagccagcacgcctggccctgtgtacaaacttctgctgagcattgatcacagtgagtcactttctgctacctagtgcccaacacatgctgagttcctcagtgtcgaacaaatgagtgaatgggtgaatgaatgagtgaatgcgttagtgaaaaccaggcacacacacggatggccaaggccctttcatgtcttacctggaaaatacagaagagattgcaggtggatttcaatttactgatacgaacatttgttgaaggtctactgtatgccagggggtagagtgacaaacatcaatgtgctatggtaccagccttccaggagcccatcatctactaggagctggccatagtgagactcggtggggatgccatcggaaataaaaggtaaccaattatcacaaacaaatgctcgctgccaaggagtgcgctctctgtctctgcagagtggaaatcatcctggtgtgtgttgtacatccaccacagaaagcctgctgatgtgggtaggtggaggtgatgtgcatagacgatgtcacctatcttgacatagatggaagggacactggggctgactgcccttcggtacctggtagcactagatgtaccttccacgggatggatcaccaggaaacagggctcagtatcacccaggaaccgcacccccttgcatgattccaacacagaggccttgtagagggcatttttatgtggttttgtgtttgttttggatttggtagcttcccctctgagtaatggtatgtccttcctccacccccaatctgcacccaagcctgatccaacttgagaactcagaaatggaaggtgaagttttcaggtctgatggtattttatgtcaaaataacaagtcatgagaattgatgaaaattctatgcaggccaggaatccagaaccccggggaggggggaattgctttatataaacagtgttaagaggcatgaatccttgagtaagatattccaaaaaatccaaattcctctatgccctgagtcattctgcgagctgtcctttaataatgtgtgatgaagtctgctggccaagctgtcatgaggatgttaatacttcaaatgtgtgtggaactttctagaacatgatgtgtttacatgtctgttttctcatttgatcctcactgaagtacaggatcttgtcacttttttacatataggcaatggagatttagagaggttaagtaacttgcccaagattacacagtattaagtgacagggctgagacttgaacttagccagtgaggaaacactaaacaaagctggaggtcaccaagttttattttaccagattctaacattacggatttcttacttccttaggttatgccttttacacacagttaatccaaaaaaataaaaaataaaaaaaataaaacagtgtttttttctttctaatagttgtttttttctttctaatagttgttttctctttctggctgggcactgtggctcatggctgtaatcccagcactttgggaggctaaggcaggcggattgcttgagcccaggagtttgagaccagcctgggtaacagagtgagtctctacaaaaaaaaaaaatgttttttaattagccagatgtggtggtacatgcctgtaggcccagctattcaagaggctgagatgggaggatcacttgagcccaggaagttgaggctgcaatgagctgtgatcgcaccaccacactccagcttggttgatagagtgagactatgtctcaaaaaaaaattgttttctctttctaataagttatccctcatacttaaaaatttaatttgtattttattaattgctatagaatgtgcatacatttgaaagtagaacttatgcctggagctatttccatactaaaacctgaaggcatgaagtggaggtaagacttggtagaaatcgaactggcaagatttgttaggatgagactgtaaaggttcaggtccagaccaaagagtttctatcagcagtcacagcatggaagtctttttccctcaaaactttttattgggaaaaaaatttcagaacatttgaagaaattgggagaatacaatagacatcattaaaccctctccttacattcaacattcagccatatttgctttaccatattaacattcccattttgcaagtgagggacccaaggctgaaagcgatgagtgacttgccaagatcacagagctaggatgggtagaagtggaatcgaactcctatctacctaaggatggggccctctgtagcattggttttctaaacactggaccccaactgattttgacttccttgcaggcttgctttgaagtcatgcatcttggagccaactcctggtgagttggatttagttggtttgggaattccgataggcaattagcacagatggggggcccctaaagcacagctaggtcctcagaatgcctgaatccaggcccaggctcctcactggttagatgggagcaacatccatcccagcctcacccgttggctttgagggtctgataaagggaagggaagggagagcccaaggcaaatgctggtggtgtgtggcacagaccataaagccagtgtgctgcttagcccaggactgaaagccagtggtcctggaatggccttgaaagtgaatttttatttctctccctctatcccatgagagtatagagacagagcaggtagggttttctttcctgctttacccagtagggcaacaggaggtcagagccacacagtggcctaccccagaggaggaagcagtcatgggtgagtagccagaggctgtggtttaacaaatccaagtgcaactgagttcaggccctttcctaagccacaactgtgggttttctgggaaaaacatggagctgcacagcaaactgatgaggcaccagagctaggttggaaatggcaaaccagcaggcaagggtgatttcagaaggcacgccggcatcagctagaggaggggaggccatgtgggagagtggagagcacacaggatttggggtcagcctgtgcttgaatctcagctccattacctattagctgaggcagtgtgggcaaacgatctcttgtgccttggtttcttcatctgtaaaactggggtcagttttacaggggtcagaagcaagacagcacttgcttcacagggtgaggacaaaatgagacacatgtgacttctttgtaaactgtgacaaaatgagacacatgtgactcctttgtaaactgtgaagtgctacaagttttgttctacacggacctctaggttgcgtgtgtggaggaacgcaggaggagtgtgagaagcaggccctgccttcagccagtgtgcagtctagcagtgatatggtttggatctgtgtccccacctaaatctcgtgttgaattgtgatcctcagtgttggagatggggcctgttgggaggtgactggatcttgggggcggattttccccttagtgccttggtgctgttctcatgatagtgagttctcacaagatcaggttgtttaaaagtgtgaggcacctcccctctctctccttcttgctccttctctggccaggtaagatgtgcctgctttcccttcaccttctgccatgagtgtaagcttcttgaggcctctccagaagcaaaagctgctatgcttcctgtacagcctatggaaccatgaaccagttaaatctttttttttttttttttttttttttttttgagatggagtctcactccatcatgcaggctggaatgcagtggtgtgatctccgctcactgcaacctctgcctcccaggttcaagcgattctcctacctcagcctctgaagtagctgggattacaggtgtgtgccatcacacccagctaatttttttgcattttttcttagagatggggtttcgctatgttggccaggctggtcttgaactcccgacctcaggtgctttgcccacctcggcctcccaaagtactgggattataggcgtgagccactgcgcccatcaggtatttcattacagcaattcgagaatggactaatacaagtggggaaggcaagactcactcacagagctcttggtggtggttggtgctatggatcaagcttgttgcatgaatggagatgggagaaggaagaagagctgggctgcatatccaaatgatgcttctggaggaaagaaggtttgggcagggcctggaaatgtggttaggagttcaataggcagatgataaagattctcattctgggaaggagagacatcatcaaggaaatagtcacagagactatgataacacctataggccactttatatgccttgtttgatcctcctagtaaccctcttgagataggttttatgattgttattcctaatttataggtgagaaacctatgctgagagaggttcaataacttgcccagtgtcaggctgctgataaatggcagagctgggatccgaacccagattccaaggcgtgcatgcttagccattatctatattctccaaaagcaggatgtgtgagagatgcatatgtgaccgcattggcccatttctttatttgtccagtaaacagtaactgggccctgctataatgccagccgcccttgggtgctggggatggaaatgaaaggcaaggcccttgtccttccttatggggttttagtatagtggggacaggacatgtaaggaaggaattgtagtgcagctgattctctgccagaggtgtgtgcaagctggggacaactagctgtgtgttggaggggagggagatcatagaagaagttccagtgtgtgtgggaactgggtggggagggggagaaggagcttgtcaggaaggctgttccagcagagtgaactgcagggtgggatggggtgatgaagaggtagcagagaggtagcagagggaaagcgggcagggagtaggaggtggggaagcagggccttgaatgccacacagaggcacgtattgggcatgggccacactgaagacttgtggggaggggctggctgtggtcccatcgacagtgtgtgaggacagggagctgagcaccctcaaaacctgtccacagaggcctagcatggagcggccttcctttctcaggttgcccagcactgcctgaataatctggggctgtgcttgacatggccggtgaagattggtaggcagcttccttgtccccacagcacagccctggctgggcctctgctttgctgagcagagcagcctcactcagcagcaggcaggccacacgggcatctggagagggcactgggctggaggtccttgctcagtgaccttggtagtttcttgatgtctctgggctgctctgacatgaagggactaaatgatctctgaggtcccttgcagccccaacattgtgagctcccagggatgactgttcatgctgcatcccagaaaagaatgagcaaacatagccactgttgtctgaaatctcattgggtgctgctccttacataaaccatctctctcaatcacagaacaaccccgtggctcagtaggttttgcccccattttatagatgggaaactgagcctctaagagctccagtgtctgtccagttttcatactgtgaacagcagagctgggatttgaacccagacttgcctttgtcttttgtactttatgacatagccccccaagggtgtcttcatcctgctcagacttcaggacacgctgtgctgggcccacaggccatgggtgccccaccggacaaccaccttctggtcggcaccacagcaggcacctctggccagatcccccaggacacaaaggagcacgttggcctctcccatgggtgcctccctggcgggatgagctgggtgggtttgttttgacaagggtatttctgcctcctggtggcaggcaggccctgggctgggcagtggcggcacctgtgggaatgtgacccctccctccagccgtgctttggaggtgatgtcaggtatgtgggtgaagtatttggttgaagtaaataaagctggaggagaatgacaggagtggggagtatggataggatcggactgccccagagggcactctggcttggacccagcagtgtgtggttgcagcagcctgttcttcctgacctggggccaggagacctgcgcctttacacgtcctgccttagagcccaaagcagtaggaattttcacagccagcttgggaggttgtgccatctcgaaactgcagagcctagagcttgaaggggctttggatgccatccactgcctgacttacagttggggggctgaggcccagagaaaggacgtggcctgcttaagctcacatggccttgggtggtggagctggacctgcagttttccaatctgcaggcctgggctcttttgcaccaccctgctctatttggggagggtggaagcagagaagcttagaccaaattcctggggaactgccactctgctgacccttagcttccttttggaccctcccttagtgccgttccttcctgctccatccgcatcacagccctataggaggaatgcactctggagcccctagtggtggtgcggggcctggcagaaaaggaggagcctctggccccggattctttcaattcatttcctcaaatattaatggaacatgcaggatgcaagacgccacaggggataccaggaatcctaaaaccaatttgaattttctcagggaaaaggctgccacccaggaaagtggcatcacctgtgagagacagcctacagcttaggactgccagcaggccagcgtcatcaacacggaggggttagagcacagggttgggggaagctcagggagaagtaagggagttagctgggtggtcagggtggctcatgtctgtaatcccaactactcaggaggctgagcggggaggatcacttgagctcaggagtttaaatccagtctgggcaacatctcatctctttttttagaaaaagattctctctaagtaagggagtaaggggaggcagggttgagggggaagaggctctgaaaatgaagaggagtaggacaggcattccaagccagagcaaaggatggagttgagatgtcgttgtggagtggtagtgcccaccctgcggggatatagagcaggtacaggcaagggatgggtggtgaggctggaaagagagcatggggcagtcagtgccttgactacttcaaatatcaggtggggcatttggactttctccggtggccagtgggaccactgaagatatttaaccagattcagtgatgtgttggggagaaagggattggactgccagggaagcccccaccccactgctccccactgattgtgacattacaagctgttgcaccttggcaaatcatttagccctgtgtgagccccgttttcttatctgtgaaatggagtttataacagtacctatcactcagcgtggctgcaaggatcacatagaacactagcatcaaatttggcttagtaaacatgctgtaaatgttagtccctaccctctgtcctggctgtcatcaggctaatagtggagcttgggacagcaagaaggaagcctgtctgaaagcaggtagagcttcaggtttaggggcccaaatcccctggccagcctataggtaccttggtggcctaggaaggaagcagaaacatggctggatagcagggagccatggcctctgtttactcccaatcagggcaggtctgagtctatgggtatgtctggtccaaatggcccaataagtgaatggtgaaggtagggacgagaacctgggtcctgacgacccaacagagcattcctactgccccacggccaccttccagcctgaaacccccaggcttcatccttttatccagacccagcttgggtgttcgccctgccaggacctccgttttctcatctgacttgaggacctcctgctcaggagctcctgaggccagggatgggttctggggctactcacttgcatggaagcatcaccagaagaaaaggcaccctggggtaggacacaggtgccagaggaggaaaacagctgtgtctgagccaggcacgaggttgccccaggttgccaggccagagtggcattgctgcttctctctgggatagattttttttgttttgttttttttgagacagagtccctctctgtcacccagactggagtacagtggtacgatctcagctcactgcagcctctgcttcccgggttcaagcaattctcctgcctcagcctcctgagtagtggcaactacaggcgtgtgccaccacgcccagctaatttttgtatttttttttagtagagtcggggtttcaccatgttgaccaggctggtcttgaactcctgacctcaagtgatccacctacttcagcctcccaaagtgctgggaatacaggcatgagccactgcgcccggcctcctgggctagattaataagacccctgagaagcaaggaaggggaatcatttagtctagcggttaggagcacaaactttggggcctgagagataaaggttaaagttcctaatgagggataatacaaactaatgttatagtctcggtttcttttcttttttctttttgacagggtctcactctgttgccaagtctggagtatagtggcacaatcataacttattgcagcctcaacctcctgggctcaggtgatcctcccacctcagcctcctgagtagctgggactacaagtgtgtgccaccatgctgggctaatttttaaaaattttttttgtagagacagggtttctccaagttgccctggctggtcttgaactcctgggcttaagcaatcctcctgcctctgccacccaaagttctggggttacaggcatgagccaccacacctggctagtcttggtttcttcttttttttttttttgcaaaaggaatgataacacccaccatgtgaggtagttgagagttcaatgaagtgtaaagtatgtcgcatgtttgcttagcactgggtcctgtatattgcaggggcttaatcagtggcacctgtcttcacttggggcacatatattgagcagctgctggatatcaggctctatcccaacctctggggagatgacaggaacaaaacccttgggcaacccagtagagggagacaagcagacaagctcatcagagtaagaagcactgtgttcgggtattacagggtactttgggaactggggagggtggtaggcagggagagagcagagaaggccttctggaggaggtactacctttgctgaaatgtgaataggaactagccaggtttggggttggggtagtgcagggagagtgttccaggcaggagagaagtcacctgctgtgtgttaggtgcttggggtggggctgaggacagatgagactcgggcgggggaaacatggccctgccctggggttcttttttttgtttgtttttttatttttgttttttttgttgttgtttttttgagatggagtctcactttgtcgcccaggctggagtgtagcagtgtgttctcggctcactgcagcctccacctccccggttcaagtgattctcccatctcagccccctgagtagctaggattataggtgcatgccaccacgcccagctaatttttatatttgtagtagagatggggtttcaccatgttggccaggctggtctcgaacgcctgacctcaggtgataccccctgccttggcctcccaaagtgctaggattacatgtgtgagccactgtgcccggcctgccctgaggttcttatagaccagtgaagaaaccatctctcctggactgtgtgccacagaggtgagcctgtgtgaggaaggagactcccatcttatttcagcctcaattcttcccctccaccacctcatccctgctgctccatagtcctggggatcaccaggtctggctcccacccccattcagcgtgtggtgtgagatggtgtcctgggctctcagctatggtggtcgggagggctgggccatggcccttcagccccagggagatgtctcactgtcttttccctggaggagaggagaagttcctaagagggtgaaactgcctgcctgggaggtagttggcagttgggaggttgcagctgactgcatggggtgccaggacacttgggtccatgggcagcccccagtgggctggtcaggggtgctagagtggggccactttcctggatcctctccaggtcataagctgacttcacccaccctcatgctcctttctgtacagccttagggaaatttgcggtgccttggggagacttggacacattttcaaaacagtgttgagagtaatctccagaggggaagaagaataaaaaagcaaaaaaaatgcaaaaggaaatgtgttatttattttttttaaaaaaaggaaaaaaagccaaggaaggcctcagtcagctcccttgagtggaagtttccagctggaaggtcacagagaccataggcagccagggggacctgggagaaggcatctgtccagattcactatcagttcagctaacagctagggtcaccctcagcatgccagctgctgtgctctgcattgcaggggcaaagatgcaaagatctgagtcctccttccggctgaggacagctctggtaggggagctatgataaaaacagcaaagggcctctggacaagagaaagcatgccaaatgtcatcacagaaaggttcaaataagcctggtggggcctggagcggggtggggctcactcctgggggtggtggagggtgctcagggttgctgaggaaagtctgcaagaacacagtgggttgagttagactttgaagcccagctaggatttcaatggacagagactgaacagaaggctttccaggcagagcagatggtgtgaacaaaggtgcaagctgtggaaacccttcagtgctttaagaaacagggatgtttgattttcttaaatatttatttatttaatagctttatggagatataattcacatactatataatttattcacttaatgtgtaccgtttacaaagttatataaccaacaccaccatagtttatagaaaatagaaaagaaaccttgtactccccatctctccattcccccaatcctaagggactactaatctactttctgtctctgtggatttgcctatgctgggtattttgtatcaatggaatattttttgtcttttatgactggttctttcccttagcataaatgttttcaaggttccttgctgctgtagcaggtatcagtacttcattcctttttatatttcattttatttatttatttatttatttattaattgagacagagactcactctgttgcccaggctggagtgcagtggcacgatcttggttcactgcaacctccacctcctgggttcaagtgattctcctgcctcagcctcccgagcagctgggactacaggcgtgcgccaccacacccacctaacttttgtatttttagtagagacaggggttttgccatgttggccgggctggtctcaaactcctgacctcaagtaatccacccacctcgacctcccaaagtgctgggattacaggcatgagccaccgcgcccagcagtacttcattcctttttatttttttctttggcttcattcctttttatggccaaatcgaattcacatgtggatactagatgtgctatgggtgttcacatcttgtttatccattcattcactgtttccccttcagggctattgggaatatgctgctgtgaacatttgtatacatattttgtgtggatgtgtgttttcaggacatttcctttagagtggagtgaaggaaagttgtgtggagtgggagaaagtgggtgaggcagaggggaccgtagtctgagtggttgggtgggagtgagaagggagagctcaggattccattgcagcctcactgggagtctggggtgtgcgagggccaggcccatgggtgtgtgaggggctgtcccctaccctgcacccacctgcattgttgtgtcagacctggcagctgcttgctgggctggaaatagcctgagcagctggtattttccctggaaatcgggtgcatttttcctgtgtcctgctgaggaccaaaattagttaaacgcagagagaagtgtgggctacacagtgagtctagaggaggggaatgttgtcaacaggaagttggctggccaggggaaagaggcggtcaggaagaccaaggtcagtaagccaagtataaacagaggctaagctgggatgtccccgtccctttcacacccacacagcagtgctgggtttgtttacaggaaatgctgcaagtatctcattggccccatttgacagataggaaaacagaggcactgcattaaagggatctgccactcagagacagaatggagatgaaggctggagtcttcagttctgctgtgagcagaaggtttggtaaaacccaggccttgccctcaatgctttacctgtctttgggttcacagagaagactgaggaccaaaaacaaggaagagtttatgctgtttcagtctcctaaaaagaacaccaagtcccaccccaaaccccaaagccaaaacacgaaccaaccagcctttaattaccgtctttttttttcttttcttccttccttttttttttttctactttttgttgtccagccagaaaacattatgttgttagacaagaatattcccattccacacatcaagctgattgactttggtctggctcacgaaatagaagatggagttgaatttaagaatatttttgggacgccggaatttgttggtgagttgtaggcctgtttgtctttcagctaagaatctggcatcaaaggtagggatcctgggaagaaacctgtgtctggggctatggcctctgagcaaagagatgatgcattgggacatctctagaaacctaatgggtggggaaggaaatgtcttattgggcctggggatgagggcccaggtgtaggctttgagtgctcagtgaggcaagggctgagtggggcccagtggctctcagtggggctacagcctgtaaggttaaacccttgtagcgctggccccacctcgtgctcttagatgagtttattcttgtgaagacttaaaattacctcgccctcttgaattcccataaactcaaccttctctgaactagcttttgatttcctgaaaaggaaaaaggaaatcatctgccaaataccacatccacccactcgcctctcctctatgcctggctttattcatgcatgggggtgcccagctccagtggggccctggctgctttctcttccctctgtttctgtcacccttggcccaggcccctgcccattctgtaccccagaagcctccttatagggcttgcgccggagattggggtcatgaagaaatagcctgtagagggggaaggaatgagcgctgagaaccaccatctgtttatctgctttgggagttggagtggtcttggagatagggagggcatgatgtcctcaaaatctgggtgctaaaacttctgaccacagtcaaataaaaaagaaagaatgtgtcagaccaaccacctggtggattttcaggctctgcagccaccgtagaatgctgctcagagaccccacagatcccagggcaggaagcccttgctgtgtgccaggcactatgtctcatgctctacaaacattgtcttaattatccccaaatggcttcatgaagcagagttaattattttctccaacaggtgccttgttcaaggcaacccaaccagtaggcagtggagctgagattcaaatacagatacagccaacagcaaagcctgtgctcttcccattatgccaggttgtctctctaacaaaccctgccctcaaagagcttacaatttagttgtagaaacaaggcatcaaaccatcaaaaaagagtgccagaaggatctttttagattttctggtccagtttaacacacgtggagatggcaggctgggggattttagttaaggtaaactcaggttatttgtcacctactgtatgacagatattaggtgatgtatgggggacacagcgatgttaaggagccatactcagaatgacacacccaaggtcacaagttggtggcagagccaacttaaacctggggcacagacatctagacttgagctttgtctgaaagagcagttgctacccaccattcacatatgtggtaaaaatgcatgtctattaagtttattataattgttaaataacaataaacaactagaaactgagagcaataaggaagaggtatcacaagacaggatgtgattaagtgtaaagcaagtaaaatagatgttctgaaaagactgttcatatgagatacccactctggcaaagtcaatgggatcagtcatggccttgagtgagtgagaggaaaagggctggtgttggagtgggagaggtctctgaagaggggtggggagggagccagaggaggggaggaacacctcccaggttcactgataccctaccagggaagtaaggccagagtaaggcatttatcagggacaagtcactgtccactccaaatggagcccagagttcacactagactgttagtgtgagtgggttattgatggatgaggctatacaatggagagttttgcccagtggtatgctgataaatatccaataaccaggtctcaaaaaaaaattccctaatttatagcattggccaatttcaaggtactggcatgttgtcactcaacacagagttggaaagacatatacctcattggcttttgtgagccagtatggttttgtttgcactggttttgttttaccttaaaatatataagatgacttctccaacctcttggctaaattgtgatgactttctttcccaagacccctgagaaacaggttataaccattttcccctgctcccaccattcctttgatattctaacctgagacccagggttaaaaaattagtgtcagcttttagtactagggtggattaggtgttctgaaaagccctcctcctacaaaattggatttttttttttttttttgagacagggtctcactctgtcacccaggctggagtgcagtgatgcaatcatacctcactgcagattcaatgtcctgggctcaagtaatcctcccacctcagcctcctgagtagcttggtctacaggcatgcaccattatgcctggcaattttttaaaaatttttttgaggtggggtctcactatattgcccaggctgatctcaaactcccggattcaagtgatcctcccacctcagcctcccaaagtgctgggtgacaggcgtgaaccaccatgcccggcttacaaaactggattcttgagaaaaattttctttttcatgaaattctggtctcacaggaaataagagaaatctttatttttatttatttattgagacagagtctcactctgtcacccatggagtgcagtggtgtgatctcagctcactgcaacctccgcctcctgggttcaagtgattcttgtgcctcagcctccctagtagctgggattacaggcacccaccaccacgtctggctaatttttgtatttttagtagagacagggtttcaccatgttggccaggcaggtctcgaactcctgacctcaagtgatccccctgccttggcctcccaaagtgctgggattaccgacgtgagccagcgagccaccgctcctggccagagaaatctttaaacatagtaactccttcagcaccacctgtcccacccccaaaagctgatgagttgaacctagagctagagcagtgagcagcaagaaaattcaacagaaggaactccactagaggcaagtgcacttgtcgccacttcagttagagactagcaaaatttagatgttcaaggacataagatactgaaattatcagatgttgactgtaacatctgatggatggaatatatacactagtggaatataaatattaaagtacattttatatacatagaaataaaaggtagactcacaagaatgagcaagcaacaagaggtgtcaaaaatgaccagatgaattttaaaaagaacaggataatagaactttaaagaatttaattgttgaaatgtaaaactctgtgaatgggttaaacagcagattgtatacagctaaggagagagttgaagaattgaaagagctgaaacaaattagctagagcaccatagagtgacaaagacatagaaatatgaaagagaggataagcaaaagaggataaaaagaaaacttatcatagatctctttggaattctaaaaggaggaaatagatacaaaaagaaaaaaaggagaagcactatttgaagagaatggctgagaattttcagaactgcatccatgcatccacagacacagaaaggacaatatataccaggcagaaaaaaacaaaaatcttacctagacacattatagtgaaactgaagggtaccaagacaaagcagtcagggaagacaaatacctgcaaaagaacaataattagatctacagcatatttctcaaaacaacaatggaagccagtatccagtggaatattatcttcaaagagctgaggaaaaataaaaagtaaacccataattgtgtgcccagaaaaaatatatctcaagaatgaggccgggcatggtggctcatgcctgtaatcccaggactttgggaggccgaggtgggtggatcacttgaggtcaggagctcgagaccagcctgaccaacatggtgaaaccctgtctctactaaaaatacaaaaattagccaggcatggtggcgcacgcttgtaatcccagcaacttgggaggctaaggcgggaggatcacttcaacccaggaggcagaggttgtcgtgaactgagatctcgccattgcactctagcctagacgacagagtgagaccgtgtatcaggaaaaaaaaaaaaaaaaaagaaggcaaagatttaagaaaaacaaataagaacaattaaaaaaaaaccccaaaacattgatatagagtttaccaccaatacaccatcattagcagaacttctaaaagatgtacttctgaattaaagaaatgaactctgaagggaggcctcaaagcaagaagtaatagaagcaaagaaatcagtaaatattaagcaaatataaacatttttctgcctaaaattgtgatgatggctgggcgtagtgactcacgcctgtaatcccagcttttttgggaggccaagacggttagatcacttgaggccaggagtttgagaccaacctgggcaacatggtgaaaccccacctctactaaaaatacaaaaaattagccaggcattgtggctcacacttgtagtcccagttacactggaagctgaggcagaagaattgcttgaacctgggaggcggaggttgcacagagctgagataacaccactgtactccagcctgggcaacagtgagagtctgtctcaaaacacaaaacaaaacaataggctgggtgccatggctcacacctgtaatctcagcactttgggaggccaaggtgggcggatcacctgaggtcaggagttcaagaccagcctggccaacgtggtgaaaccccatctctactaaaaatacaaaaattagctgggtgtggtggtgggtgcctgtaatcccggctacttgggaggctgaggcaggagaatcacttgaacccaggaggcagaggttgcagtgagccaagatggcaccattgcactccagcctgggtgacgagcaagactcagtctcaaaaaaaaaaaaaaaaaaaaaaaaaactaggataaaactagaacatgaagaaaatgttagatgcagcagtgtttaaaattaatgttctgaggtttttaggttgttcgaggagcatcaaaatgttgatttatattagaatttgttagatatccacagttatgtctcaaagatagctgttaaaaaaaagaagttggggaaaaacaataaaaccaaaagtcttcattttttaaagaaggcaagaaaggaaaagaaaagcacagaaaaaaagacaaataaaagcatgttgatgacagaaataaaagtgtatgtatctcagatcaatggcatgagaaagtgagttctgcttctcaatctatgatgaaagctttaaaaaaaaaattcagctggaagtggtggctcaagcctgtaatcccagcactttgggaggctgaggccggaggcttgagcctagaaattgaagaccagcctgggcaacgcagtgagacctcatctctacaaaaaaatttaaaaattacctggtatagtggcacatgcctgtggtcccagctacttgggaggctgaggtgagaggatcgcttaaccctagggggttgagtcagcagtgagctgtgatcatgccactgcactccagcctgggtgactaagcaagaccctgtctcaaaaaaaaaaaaaaaaaaaatcaatctgtcctgaactgctacttcagtaagatacaataaaaaataaattcttaggccaggcgctgtggctcacgcctgtaatcccagcactttgggaggctgagaggcgtggatcacctgaggtcaggagtttgagaccagcctggccaacatggtgaaaccccgtctctactaaaaatataaaattagcttgttgtggtggcgtgcacctgtaatcccagctacttgggaggctgaggcaggagaatcacttgaacccaggaggtggaggttgcgatgagccgagatcacatcattgcactccagcctgggcaaaaagagtgaaactctgtctcaaaaaaataaaaataaaaacaaataaattattagaaaaatgaccacagtttggatgtcacaacagtgtcacattgctatcagagtctctaaatgcatagtccaaatttctgtgcctatcttgttggaccagtgacagtctgtggactattcgtctgcagaccacactttgaattatcactgacctaaagaaagtctttcatgtgcacattaggaaacacatgcaaaaaaaaagttcatagcaatgtcgtttcaataattgtttaaaatgggagccatttaaatgaactctgagaggagaatgactaaaaaatgatacacattcacacgatggattaccgtatagcagtgaaaatgtaaaaagcatggatgaacaatcagtgaacactagaagcataaatgttcagtgaaaaaataaagtgactataaatcacatgcagtatgacagcatttttataaagctaaaacagcagcaaaaccaggagcgtagttccctgagtcttaaagtagcaggatgcaagaggacaggagggcagacacaggctgtggatgcaatggttttgatattgttttagataaactcacactttcccactctccaccttttccattcgcagttgaatgggctcagtccttcctccttctcaagctactgtcctcttttttgcctccatgatctccaagcttttaaaaagtgtcatctaaaaaaaataaataaataaataaaataaagtgtcatctatactcttacctctacttctttgtagcttctttttttttttttttttttttttttgagacggagttttgttcttgttgcccaggctggagtgcgatggcacaatttcagctcaactgcaacctccatctcctgggttcaagcagttctcctgcctcagcctcctgagtagctgggattacaggcatgtgctaccacgcccggctaattttgtacttttagttgagacagggtttctccatgttggtcaggctgatctcaaactcccaacctcaggtgatctgcccaccttggcctcccaaagtgctgggattacaggcgtaagccactgtgcccagccttttttttttttttttttaaacagggtctcactctgtcacccaggctggcgtgcagtggcatgatctcagctcactgcaacctccacctcccaggttcaagcaattctcatgcctcagcctcccaagtagctggggttaaaagcacccgccaccatacccagctaatttttttttatttttagtagagatgggatttcgctatgttggccaagctggtctcgaactcttgacatcaagtgatccacctaccttggcctcccaaagtgctgggattgcaggtttgagccaccacgcccatcctataccttcttgacactctgggcactgcggggctgtgaaattcaacactcactttccagggattatctgcttgatctctggggagcatttgatcttcttctctccttggcagagccatctctcctagtctctgcaccctctcctgctcatcacatcgttggctcagctcctgctccttcctgtacatggatggctccaaacgtgatggctctggaccactcccctggagcctgcccctggacatcttcccctggctgcccctcaggcacctcaagctcattgtctcagggacccccaggaatgtcctcctgctcctcaggtgggaggtaccctctttcagaccagactcaggaaaatggagttcttctctgccttcttcttcatcactttccagcactgacatgactggtctttaccagagagttctaaagcaggccacatagccgaggccccatttctccttcctgtaccttcctctccctgcccttctcttcctttttcaggtgttcggtgtacttttcctcttcctatcaaggcctgtttgtaaaaggtttctaccaggataacagacaactcttttcttagtccttttgggctgctttaatgaaataccttaaagtgggtcatttataaacaacagaaatttattgcttacagttttgaaggataggaagtccaaggtcaaggtgccagcaaatttggactctggtgagagctcaccctgtttcatagatggtgccttcttgctaagttgtcaaatgaccaaaggggcaaacaagttctctcaggcctctttttctatttctttctcttttttttaagatgggtctcactctgtcacccaggctggagtgtagtggtgcaatgatggctcactgcagcgtcagccttcccaggctcaagcaatcctcccacctcagcctcttcccaagtacctgggactgcagacatgtgccatcatgcccagctaattttaaaaaatgttttgtggagatggggtctcactgtgctgcccaggctggtctccaactcctgggctccagcaatcctcctgcctcagcctcccaaagtgctgggattataggtgtgagccaccacagccagccctcgggcctctttataagggtactagtcccacttgtgaggtttccattctcatgacctaatcacctcctaaagactctacttcttaatactattgcattggggatttgctttcgatatatgaatttggggacgcacaaacatttgggccatggcaactcctttcctcagaatcttagatgcagatcacctttatctgctgctctaattttcctggagattcaggatggagatatttggcaccaaattccctaaaattccctaaaaccatctctcctctcattttcacactcatgttgactatttaatatgacttctttcagctccagaaattgtgaactacgagcccctgggtctggaggctgacatgtggtaagttggataggccactcaggtgacctagcgatccttccaagggcggaaggcctcagatcctgctccaggtgacatccgcttaaccatgaaagccccttactccacactcactgttcagagcctctggctgctcccccgatgtgttagacctgtggccagggcagctggaggtctctaggcctggacctgaggccagttagctcctggccaggtcagagctttgtcaggaatggaggagcaagaggagaggcaagggggaggcgcagactcacccgtgggcctgccccagctggggttaaatataatagtaacagtagctcgctcagtcagccaaccaagtcatcactgaaagtccatgagttctgggcactgtgctgggcctgtggatactgcagggattagtcctctgcacagatgggactcgtttcatttggacgctgctttatagttggccaagcacctttgttacctggttttctaaaatcctgccaacagtcctgtgaggtagttatcattatcctcattttacaaggggggaagggctccgaggtggtaagggacttacctaaatcacacagcctgcaagtgcaggagtctgatcttgaacttgggtcttcggactcagggttcagagctcgatgactccaaacacaccccgggctgctgctgaagagcaggatggagatgggtgtggagcatgagacggcatccagggtctgctgtggaggaggcaagtgacctcttccccttagatccatgagggtgtcccttgctggtcggggatgggacccaggtggccctgacttgactgttctttattttgcaggagcataggcgtcatcacctacatcctgtgagtatccctgatccaggggctctggctcagcttagatctgggggaaccagaaggaatgagagaggggcaggctgatagactgacatttactaagcacccaccataatccagatgtgttaagtccacacagcaagcctgaggctaagtgctgtaggtccatttcatccatctgaccctggcattgaggttgaataggcatccaggggagcagcctcaggctctccactctgcacaacctgtgtctgcattcctcctatggaatgccagggctcccctgctcaccctcccccagactgaggtatactggagaatgtcacttttcactcagaactctttttttttttttttgagacagagtcttgctctgtcacccagtctggagtgcagtggcgtgatcttggctcactgcaacctccacctcccaggttaagcaattctcctgcctcagcctcccgagtaaccgggattacaggcacccaccaccacacctggctaattttgtatttttagtagagacagggtttcaccatgttggccagactggtcttgaactcctaacctcgtggtccatccacctcagcctcccaaagtgctgggattacaggtatgagccactgtgcccagcccttcactcagaactcttgggacagccctgtgaagctacttatgccctccccaatcttgcctcttctttctttccccttttccccagatccccttttcttcctctcactgactctctcctcctttttccttcctctttgcctgtccctgaagtactcagttgcttagacagagatttcctgcatagctccagtgtgtagtgagttacctctggggctggagtcccatgatactatcactttccatctctgtggccttgggtagggacttaacctctgggcttgtttttctcatgagaaaaataggaatcacaaacttcctgccatgggtgtgttgtgaaagctaaataagtcaacatgcgcaagtctcctagccctgactctggaacatgcacagtgggctagtgagtattcattccatcagcccttcccaacctttttgccttcatggcacacatggaaaatgctatttttatagcaccctggagtaagagtcaaccagatggggcagggggcaccagtgctcagcagctgagaggattattctctcaatgatccctatgagccaggtccctgattctcccagcagctcttggactaggagccctgtgtgacgtggtggatccccctgagctgcagctgaagatctcaaccctggctgcacagcagagcttttaatacccaccatggcccaggccccaccccagatctattatatcacaattgctaggggtagggacttagtatctgtatcttttaaaactccagctgaatttgatgcaaagagaaggctgagaaccatggatctatagtttcagatcagagccagaacggtctgatgttggctcttgaaactttgatttcttcaggactctgatttgaactatgaagggatcccatgtaatcccagcattttggaaggctgaggtgggcagatgcttaagtccaggagttcaagaccagcctgggcaacatgacaaaaccccatctctacaaaaaacaaaacaaaaaactagctaggtgtggtggcacacatctgtagtcccagctacttgggaggctgaggcaggaggatcactggaggatcgcttgagcccagaagttgcagtgagctgtagtagcaccactgcactccgtcctgggcaacagagcaagaccctgtctcaaaaaaaaaaaaaatggaatcccagtgtctactgagcacatagtcttcttgtggctcatttgaatttaacagctttgttgaggtctgctccatggcaggcactgtaccaggcaccaggatactgacatgaaggagggtcttccctgcttgctggggctccctgtctgtgggagacacaccatacacctaactcacacccagtggaaccaaggttaggctggaggaatgaacatgcctctttgagacacagatggggagccactggtttgctggactgctgaaggtttattgagagagaaatagagacagcacatgattgatggatcaatttgaactgggatgtagggaacgaagttaattctgtgggtggaggagggaagggctgtgctggctgaggaaatggcatgagaaaaggaacggtaaaccttaagtgtggctgaagtgtaccaagcgtggggtaaggaccaactcttgatgccttgctcaagagtttagatgtgatcctgtagaagatgggaagtcatagagggcttttgtgttctcacaatgacaataataatggccattaattccagagcccttagtgtgggccaggattgcatgaaggcttttgtatgcatgtattcttcacagcaatcacatgaggtgggaattttattttcttcattttgcagatgaggaaactacacaaggggttctagcttcacacagctaatgagtggctgagctgggattcaaacccaggattgcaacaccaaaatttgtacagtgcaccttgctgccaccatgctaagaaagtggctgtggaaatggggatgactttcaagagatatttagtaaatggaaccgacaaggaagcttttggccagtcagatgtggcaagggaatagaaagaagagtccaaggtgactcctgtgcttctagctcgggtacatttgtgaagtaatgtgattcatcaagggagtgcttggaatgggtttggacacaatgagtttgggacaatggcacatctgatccagacactgctggatcatacctctaccaaggcatcccatgaacaactgaaatctgagtcaggagatagtagatgtaggagtcattatttgtatgacatccttgacaaaccctgttggggaaccacacagacccttcttgtccctaatggcccatctatttccaaactttgtgggctctgctcaagttgctcctgtaacccagaaggcctttccgtctccttctctgactgctgacaacctctttattcttcaagacacaaatgatgcaaatatctgtgccaccgtgaagctgcactgggcctccctctttcctgtgctcccctatcctttggctggccttccattatattctgcttgtcttgctggggatcacaaagagacatgtctctgtgtttctctcccctccgcttttgagtccgttgaagacacaatttctctctgtcgggtgcttaggaggagctccatgaacatgtattgaattggacttagctgaacaggctgctggttggctgcccagagggggcaggctgtgttgctgggagccttccagctccctgcagcagtcatggggcagggttccccgagtccgtaatccccatttccacctactttcccttagttatttgattccctgtctgtcgtactcagcttaagtggagcatcccctttcctgggagacacgaagcaggaaacactggcaaatatcacagcagtgagttacgactttgatgaggaattcttcagccagacgagcgagctggccaaggactttattcggaagcttctggttaaagagacccggtaagaggacagagaagccactggtttctcaggtactgatcccttcctgtcgcctctgtcaaagacctgtcagtatgtccccactttgacatagctgtcatctgcactgttgtggtctaatccgggcaggtgctggaaagtgtggcctagccaagacgtggcattcatcttgtttgctcaagtctttctgctttcttctcctgttgaaatgtaaataatgtgtgtgtgtgtgtgtgtgtgtgtgtgtgtgtgtgtgtgtgtgcgcgcgctacaagtcagcctgggtttctttagggctcattaccttgtgcagtctgtcccaaaggcacctggaattcagatttgaaaagtttaagtggcagggttttcaagccagttcaggttgggagtaggagctggtaggctcagagaggtcagtacagtgggatggtggaagacatgctaaccctatcccttctccaggggccagggtgagtcccgtggctgtggggtcaaagaaggaaataggcagggaattgcagggcgctgggtacccagagcatgctctggatggggcaggaagaaaggtccacagactagaacaccatgtcctctccatcccacagacttcagagagggccagagtggggttgtctggagtgcaagggccctgattttcctgtctaagaacagtgctagggagagttgcttacctgggtacagagcagcgaaaggcagagaacggatccaggaggcaaacagaaaaacagaccagggatttagcaatggagagttggcttttggaagattctggaagctcattggagcatttatgactcttcttaggcctttcagctttgggactaatagtatgggtgtaggtaacaaggccactctattgaggggtctgtctggactgcttccttcccctggagtgcaggatttgcagccagctcccatccatctctgcatcctccattccactggtttgacggcagtggccaaataatgccaaaatataggtctaaaaagagtgagaacggagatggttgctcccaacttctgtcctcatggatcatcactgtttcccaatcctcattgcaggaaacggctcacaatccaagaggctctcagacacccctggatcacggtaagggcacagccatgagttccaatgggcaaagggtccctgctctgtcgccagggttggcctgggcagccagatgcagagggcccatggagaggcctttgctttaaacactgaccctgggcacagatgaaagctagccaggggccccagagggcctgggcttattcgaataggtttatttgcttgctattttaagtttgtgtgtctcaaattcaggtaacttatgaaatgaaaccctcacaaaccacagttgaaaccctttttctttggggccaacttacacagtgttctttgttgaagggtatgtcactgccacttctccaagtggaaatcaggactccccaggtgtagaaagatagatgacaattgaaaacccccactttgtgaccaggcctccttccttctgatttttggggctctaagtcaaggatgacacttaaatcagccacccacctcctcaggccctgaggaatggggcctgagacagaggcctggtggggaagagagacagccactgttagggcaattctgttccctctggggagagtcagggcaaaaaaatgaatccctgcctaactcgccttgcagtcgggcttcctgctggctttccagtcagctgctggctttccagaggctcttgtggtctggtgtggtgaagagcactttgagagggtgagactcagcaggattcaggccctaattctgctgactgaccagctatgcacacccagggacgtcaccagacttcccattcaccttaactgttatgtgagaaggccagcaaggatgaaatgaccataagaaaggtggagataagaaaaggtgaggcaggccaggtgcagtggctcatgcctgtaatcccagcactttgggaggccgaggcagcagaaggatgacttgagcccaggagttcaagaccaacttgagcaacatgccaagaccccatctctctaaaaaataataatcaatcaatcaatacaaagagaaggtgaggcctgtggaagacagaacagggagggctggagtcgtctgggaagaggtcagctttatctgctcagcttcatcagctcattgaaggatggggaaggcccaaggagccctgaaggagagatgctcctcagccctgctgcgtgagccctggccttgcgtgctccagccctgcgcagatgcctgcggagtcctggctgcagcctgcttgtctgcgtgagcaccccttaaatgctatgtgtgtggagctctctctaatggctgtggacccttctgccctgaatgagcatgcagacagcacccccacactccttgacctcacttatggcctaaggaggtgctcatcccaccctggttctccccatggcctgacgcatgcagtgaatgccagaggccgcttgtgtgccttctgcctaccctttggactgccctctggggtgggcggcaaattaacactctgattcttctgtctgaacacccaccagtcaaaaggagaaggcagagcccctgaacagcggaagacagagcccacccagctgaagaccaagcacctgagagagtacactctcaaatgccactcaagcatgcctcccaacaactcctatgtcaacttcgagcgttttgcctgtgtggtggaagacgtggctcgggtggacctgggatgccgtgccctggtggaggcccacgataccatccaggacgatgtggaggccctggtctccatcttcaatgagaaggaagcttggtaccgagaggagaatgagagcgcccggcatgacctgtcccagctcaggtatgagttccgcaaggtggagtcattgaagaagctgctgcgagaagacatccaggccacgggatgtagcctcggaagcatggccaggaaactggaccatctgcaagcccagtttgagattctgaggcaggagctctccgcagacctgcagtggattcaggagctggtgggcagcttccagctggagagtgggagctctgagggcctgggctccacattctaccaggacaccagtgaatccctgtcagagctgctcagcagatcatgcactgaggaatttctggcaggctggaagctctaatcgccagaatccagtcagtgatgcatcccaagaggtttgcagaagcatgttctcatccaccctgctgcggcctccagctagaattatcctgcaggggtgtgtgtctgtagtatagccttccagcccctccacagaatccagaattgctgaggtgccagttaattcttcattctgcacctcccctcaccaatctggttttctgggagggctctggcagggcagccaagctgttaaaacaattagagagtgagtacccctcagggaccccttctgcagagggaggatggctggccctggggaaatgcttgagaattgatttgtgatgaaggatttgttcatatctcactttctgcctacataccttatggactgtagatcttgggtaatatttgagttaattaggaataactaagtcagcatggtgctttcctgctacagaagcagggatttacaatgcatagagaaaataatattgcctttcgtttgcattgatttttcacttaccaagcactcatgtctgacaaatgacctcacttggtccttaaaagaactcagtgagataggaaggtgggtggcattattattattattatttacatgtaactgatgagaaaattgactcagagagggaaaatgatatagtcaatcaatacagatgaaacagaaacccaggatgcccatctctaagatgaggtatatgggagaaagtagtaaggctttgctgtaaatatctaccttaatattaaagtccaggtcccagaggtaaagtaagcaacttcatgtattctgccaggtgtaggtggaatgcatacacctgcagatgattgtcccaggagctctgtcccagaaggcaaagtcattgtccctacccatccctgtctctgtctgaagaccagcctgcaagcaggagagaaggaaggaaggagtcttcccattctccaccctttctcctcttctggctaacggccccaactctgtgtcgagaataaaggccagaaggtcctcaacaggaggttccttttcttatgtacctaggccattgggccttgaaggcctaagaagttccgtgagggtttttgaaaagggcaaacataaagatggggaagcgcaaggccacatggtcgtttcatgacccaaagctttgagcacccctccccaaggattataagatctcatctccctttctctgggggaggggacagtcaaccaactcatgtcaacagagcatggcatatgagcctagtgctgagctagaagcttgtgggtaggggcataacttgtatagttcaaagtgtcttcatggcctcacaaaacatccctatcttagaggcagactaaacgatattcccaatttagagctgaggaaacagggagaggatgggattttcccaaggtcacatcattatggcaaaagtagagaccttctaatgacaagtctgttgctctttctgcttcccctggctgcgccaggctccagaagtttactccctgcttgtgggggcagctcacacctggattcatccatccatttataaattatacttaggcaccaaccaacttccagatgcccggcttgactctggggatacaatgtttagtaaaaataggcctgattcctgtctcacggagtgctcagtccagcgaaggatttgaacattgaccaagaatcacagagagatagagctgcagcttgtgttcatgctgggagagaagcacatagcactgcaggggcctgccgtcagggtctgacagcatcgggggaagcgtcctgaagcagtgacactggaacggaggtcagctaagccaaccagggagagagaagtttcccaacagagccatcataccagagctctgtgatgagaggcggtgtggaaggttgagaatgtgaggactgaaagctggaggggagagaataggaatacagtgcggaaatgaccggagaacaagcaggagcagcagggctttggccatgtggaagagctctgcccttatcccgaaagtcatgagaagccagcgggttccaggtgctggggagggaatgccccgtgaacagctcagacaggaagtggtttaggacaagacaggaaagcttcatctcatgaaaccatttcttcagaatcctgtctccttttctatatgcatgaaggatcatttcaaatatcatatacaatatttgtaacagaaacttacttcatcagctatgagaaaccgtggtgataagatgcatcatcattttatggaccactaagaaaaaaggcccaagatggggcgtctaataggaaactctctctacccccaccacataaagctgtgatgccctcaatgagagggtaaatgagaaatagagccaccatgcagaaagggggagcaaggaaacccatgcatctcaaccttgacactaaatgggggtgaaaaatccttccctgagaacaggagtcccaagccggtggtactcatgcaggtttgctttctgaatttgcactatcagtgtgatccaaaagaacatcaagcagagagtgtaatgtccaacagtctgaggctgggtggccctggatggctggcaaaaacagtactatcctctcccggagcacctgccttctgtccgggccaacagtaagaatatgataccatcatctgggagatgcctcctgacttcagcgatccaaaaatgtatatcttggaaccaatgaaagatggcaaaagctccatttcctacatcttaccccagagaattggttcaaatgacctgtctacagtctctccaaggtcttacctgccctgtcacgggaagttgtatacttgtttggtgctgagacactgcaaatattaaatgtccctttggccatgttaacagaccttgaccttcacacagccaggtttctaaggagaggaagccactgatggggcaacacagggcaagctttttagtgaaggtcaaaatagaatgcaggcccagtgtggtggctcatgcctgtaatcccagcactttgggaggctgaggtgggtggatcacttgaggtcaggagtgtgagaccagcctggccaacatggagaaatcctgtctctactaaagatataaaaattagctgggcatggtggtgggtgcctgtagtcccagctactcaggacactcgggaggctgaggcaggagaatcgcttgaacctggaaggcggaggttgcagtgagccaagatcacgccattgcactccagcctgggtgacagagtgagactctgtctcaaaaaaataaaaaatagaatacagtaaaagagtaaaatgttggcaatgatttgaatggggaaaattgggaaaagggagggagaagtggttattttagaatcatgatcagctatacacagtgctgagagtcacccatttagttggccgtgagctggactccgaactctaagtggttttccttatagcagtgacatcgtcctctctatgctcatgtccagtcactgtaactgtttctcacttagacgtgtcgtaaacagacctttttctgtacaaagagcttctaaagacaaatgaaagagagttgagaaatgcccccaagtcttttggggaaagcagaggagaccatgaccttcctctgtgtcctggccagctgaagtcccgtccttccatggcattggaacctgatgctgggggagcccgggggcctgtgggatgcagccacaggacctgcttatctctgctccccacacgccctcagctgactttttacaacagtgtggagggctaacaatggcgggaagggctgtgagaatggactgtttcgctggtgcctagaggaaggaaggcttgtgggtgctgctctgtgggcaggcccctctgccattgaggatttttaattcaccaaattgcaatttttttggtgggggagccgcacagagtctcactctgccgcccaggctggagtgcagtggcatgatctcggctcactccaacctctgcctcccaggttcaagcaattctcctgcctcagtctcctgagtagctgggactataggtgcgcagcaccatgcccggctaatttttgtatttttagtagagatgggggtttcaccacattggtcaggctggtctcgaactcctgacctcaggtgatccacccacctcggccttccaaagtgctggaattacaggcatgagccactgcacccagcccagactgcaaataaaaggtcggcttctgtgctctgttcaaacaccatcctgggctgtttgggaggggaaagtgagtgtatgacattgccctgaataacaattctcaaggaagctggcaagctggcccttggggaaggcagctgcctgtccctgctgtgaggcaggtgctcacagcctagcattgcctgactgtgtgtcagaaggtggggtgatggtttggtaatcgatgattctgcagctgtgggagcctggcagtgaagggatggagcagaggaataatggcagaaagagctggagtctcccccatgggccccctcccctcccttacaggtgatcatgaagatggtggcttcctacctcactccatcacgcagcacaggtggcccggcccttgctggaggtggctgtgtgcccagctgtcacccctactgtcaatcttctgtaaatgtctgtgggactggatgccttttttccttggtccatgaaattcctgacccagcagtgggcatgttcacgttgcaaaagggtccagtcccgttgaacaaacactgattgtgctctggctcagggggaggtgacagacaaggacaagataacctcaaataaaagattcagtgtctggggcagatggggacccagccaactagattggaaaagctatggtgagtgataaaatagagcttcctcatctcctagaaatcaaaggagagaggaattctgattgagaaagggtaagagggttgcagagaagagaggccttcccagggacgccgtccccaccagtgaccgccctcctccactcccaagctgtgtcccttgaggaaggcatgagtaaaatctggaaggggggtggggctgagccaagattggggttaggaacttggaacagttgaatggagattaaagagagggagattacacagatttaaaagagtgttttaaactttttgttatggtcccctcagcaggaaaattgccaaaacttgcacagaagtataaggaatgggatagtggattccaggacctatgaccccgctccagcaggaatcaagtcatgcgggtcctctttcattcatctctcccattacttttcttctggggtattttaaagcaaatttcagacttatttaactcataagttctccagcataaatctctgctaaggattttcttcttctttttttctttttttttttttgagacagagtttcactctcgttgcccaggctggagtgcaatggcgcgatcttggctcactgcaacctccatcttccaggttcaagcaattctcctgcctcagcctcctgagtagctgagattacaggcacccaccaccacacccaactagtttttgtatttttagtagagatggggtttcatcatgttggccaggctagtcttgaactcctgacctcaggtgatctgcctgcctcggcctcccgaagtgctgagattacaggcatgagccaccgcacccagccaggactttctttttaatacaaccccatgccattatcacacttgacaaaatcagcaataattccttcatctcatctggattcccattccatcctcacatgtccccaccactcccaacagtgtcccattacagctggtttgttcaaatcaggatccaaacagtccacatgtggcatttggttgctacgtctctcaagtctcttgggttttataacagtacaaaaggaagaacctttgaagcttttcctggggacaaaaaattgctcagaaaactgatggtcccatagaagaataaaaaacagagcgtatccatgtcaagacctaactcagaaatgtgagaccaggccaagcaaggaaaggaatgtttctgcctccttccactggcttgttcactgtaggggacagccttcaggctcacagcctttctgcagctgtccctcccacttaggaggaggcagagcctcaagcctcccacaagccccatgtgctcctttcctgggaaaacaggtgggtgaaggcagcagagcccaggcttcagccatcaaaacatccagcgaaggggaggggtggaggggtgccacctataaaactccattgagggaagggcagcggggaggggtcctgggcaggagagaagtgggtgtgagagtgccctggctttcactggagtaaggggctggagagatggcacagatgggggttggaggtgcaatctgcttgcagttcctaaagaagacctagtatctagagaaaatcgttgtgtggggggtggagttgggggagtcgcctcttcagtaaagccaggattcctttttcatgccttagcagcggctgctgcttcctgcccctgcctgtggatgttggtactgacctggcacaccccactggactttttcaaaggcatttgcagctgcataaacaaaacttgactaccccacagttttctgtcttcttgcttcccttttggacatttttccaagacaccaaacacactcctaggagcctggtcagaatcacccagggctccctggtatcacggatggaccacaaggccagaaggcgggcactttctgtttgcagggaggggcgggtcaggagaaggcaggacacagttccatctccccctcacaccccaagtcgaatcaaaagtgtttgtgccacattccctctgggaacaattttgctgcagaattttcacctctgctgcagaatttacatctttccaggctgagatgtcagcatcagcgtttggtggggctcttaacaaccaggaaggcccattgattaggaaaggccagcctgacagaatgatagccccatgctgcctcctcagggttggtggtgttgtgtgtagctataaacagggccctcaaaagaattgcatcacctcccattaatagcctctgggaatgatctcacctgacattttagctgggcccctctgctcagtggctggcactgctgggccaggaggagggtgggattctcattaacgagattccccacacctgcaagttgaccttccagccatgggcttagctcttcctcccctgggtgagggtgccaatcagtaagtgggcaaaaagaaatctcttctcccccagagtctactaatcccatctgagcaaactctccttgtgaggtgcaggtgcccctgtgagggttaggctcaaaggtcattcatgcccaggggaattgcagacatcagtgaagttagacttagaaatggttgatgggttggggagggtgctaagcaccttggaaacgagattctaggagcttggaggtgcaagggagagaggactaacaaaaaacaagcagtcagccctccctacctgcaagttccacatcctcagattcagtcaaccacagatcagaaatacgcaaaaagtaaaaataaaaataacattacaataataaatgcaaataatacagtgtgacaactatttacatagcatttatatcatatttgctattataagtaatctagagatgatttaaagcattaggggagggtatgtgtaggttatatgcaaataccacaccattttataataagggacttgagcatccatggattttggtatctgcggcagtcctagaaccaacccttcaaggatactgaggactgaatgtgaataaatacagaatagaatattgggtagcaccacgtgtaatgaagatttagtgccccggcatagtgaatcatgggggaagttggcttgctactttatatagggtggtcaaggaaggcttcccttaggagataacatttgagcaaagacttgaacaaggtgataaagtgagtataggagagagcaagggcaaagacccggagactttggattcacagaccagcaagtggacctgtgcgatgggagccaaatggacaggaaggagagaggtagaaaatcagggtggagggtacaggccttgagggtctccatgagctcgtggggatgtatagagggcacagggaagccactggaaggcttggagaagggaaaaggcaaggttttcagcacagattggtcaccctccatccacttttgtgcctcccttccagggggggactagacccagggctgggcttgcaggtgcacagagtgggtgacagacagttaaagacaggatctagagggctggacatggcctgctggttcctccggcagccttgtccttttctcttcccattccttgtctttctccttcccctcctctctttccttctgtactctttggcccaaaagcactgtgcttcagtttcggagggtgaatagccccaggttttctcatctcccatccacttccaggttgcatgcactccccctccagctttgggtcaccccaccccccgccccggagctgtacatcctactgactcctgggcagagccatggggaacctttgtgccctgacaccctttcaaggtggtgtgactgggctgaccaggtgacctgggcccctcatcagtgggagtgagtaggtcccaggtcctgggatttcattccaacttatctctccaacagctcagggaaatgacttaaccatacaactattaagcactcactgttgtaggtcccgggttgggaggagagtagggcagggcattgacatagacaggaagaaagtctgtgccctccagtcattttccaggagtggggtgattcctctgcaaggctggttctgagaggtgctggacttcataaaggagcatacatgtgccttgttcatgtcagggagggagacatgattttctggaatttgtcttggaggagatcatgtctgaattgggctttgaaatacttgaaggccttccagggggatgggcagcaggggctgccatgggatggacctcctgccagaggctgccagctccagagcagcgtggccagcagtgtgcactggctttcttccggtccctgatgccatgatgaaaaatcaagcgtggaggtgtgctccgagcatggttaggagacaagacccacgcttgggaatcaataggctccctcgcttagcattcaccaggtgaatgaggcattgcggcaggaaggctgtcagagcagagagaaaaccagagctgcccgggacctttggaatcattctaggcagttcattttcttgaggtcatgggggcctttgagaatcgataaaagctattgactctcctccaaagaaatgcatgtctgtacatacatactaaattttaaaaattgagttataatttatatatcataaaattcaccattttaaaatgtacagttcagtggtttttagtatactcacaaggttgtgtaaccacatcactatctaattccagaacatttacattaccccaggaagaaatgtcataccctttagtagccattccctgttttcccctttccctagcccctggcagctacccatctgctttgtttctacggatatgtctgttctggacattttatataaattgaatcatacagcaggtagccttttgtgtctggcttttttcatttaacataatgtttttaaggttcatccgtgttgtaaaatgtattggactcaattttttatgaatagtatttctgactaatattcctttgtatggatatataggcacattttgttcacagaacccctgaaacctatctcttgatttcacaaaaccttattttacaaaaggggggtgttgaaaagggaatggagaacgcaggaaagctcacaataacttattactatttattgagtggtgctgggctaagcactttatatatgcatgatcatataatccttaacaaccctgtgacatgatattattatccccatattacagatggggaaactgaggctcagagaagccatcccaagcttcttggagaagtcaaaatttaagctgagctctgactgccaggctgtgaaaagcaactgcacatcctgttgcctcttgactttcatcaaagcccttatttccttccatttattttttaatggagtatgaattccccgtctaccaacaaggcatttgttttgccaagcccagaatcaccccagtgcccagagggcatcccagactgctgtaaaatgaccctctccccaaagtgatgtgcgattggagggcctgcctcctgctattccccttcaggagctgctgagcctccagccaaggctgtgtgtgtgtcaggctgtggtaataatagctgagaggcaactcctgaacagctgagacatgtgtagctgttgccctgactgtgatgctcccacggtgtgccccacctggcggggagatgccagggtcaagccaagggcggtgggcatgcggtgggtggggagttctgcggcgaggagggtggctgctgtctgaagcccagcatcagctgccatgctctgctttgtctctcagccggtggacaaccagcaagccatggtgcgcagggagtctgtggtcaatctggagaacttcaggaagcagtatgtccgcaggcggtggaaggtgtgtccagggttggggcggcgggggacagggtgggggctagggcggggtttctggctctccagggtctccatgcacattctcacctggggattcctttcctctgcctccctcagctttccttcagcatcgtgtccctgtgcaaccacctcacccgctcgctgatgaagaaggtgcacctgaggccggatgaggacctggtgggtaaatgcatgccctcttcttgggcagaattctggggtagcctggagctcagggatgggtgagttccctttcccctcacaaggcaggtgggtgttcactgtttccagccagttctgctggcccagtcctcctcttccctgaaggctgaagtgtgatcttcagaggagtgtgttctggggacctctgggtggtgccgggaggggaccactgatgcagcagcatgaactcctggaggatctcccatcctttcctggtgggccttcagaggggccgctgctgccggctgaccacagacaacccaaaatgtatttctgataacccaaaagctgctttagaatgggagctttacattcttttttccatatttctatttctgctttgtttcagattaccatcatcataatatttagacaatatcttatatttgattactttattgccattttgtatacatttaaagggagtagcttataacagaatatactggtgaagagggtgccctctgcagtcagactaccaggattcaaatctgccacttactgtgtgaccttgaggaaattacttaacctctctgtgctgatagttcatcatttgtaaaatagggttaataatagttcctaaagattaaataatgacatattcttcctcttcttcttcttctttttttttttttttttttgtttgtttagacagagtttcactcttattgcttaggttggagtgcaatggcgcgatctcggctcaccgcaacctctgcctcctggcttcaagcgattctcctgcgtcagcctcctgagtagctgggattacagtcatgcgccaccacacccagctaattttgtatttttagtagagatggggtttctccatgttggtcaggctggtctcgaactcccgacttcaggtgatctgcccgcctcggcctcccaaaatgctgggattacaggcataagccaccatgccaggccaataatgacatattcttaaagcctggcatgtaagtgctcagtaagcgttagcaattgttgttgtttaaaaccttcctgtaggctggcagtagtggttcgtgcctatagtcccagcactttgggtggctgaggcgggaggttcatttaaggccaggagttaaagaccagcccaggcaacaacagtgagaccctgactctacaaaacaaaaacaaacaaacaaacaaaaaaattagccaggtatggtgacaggcacctatagtcctagctactcagggagctgaggtgggaggatcacttgagcccaggagttaaaggttacagtgaattatgatcacactactgcattgcagcctgggcgacagagcatgaccctaactctaaagaaaattaaatttcaaaattaaaaaagtaaaatcctcctgtagactttaaaatgcagttggtaggggttccctggacagcccctccccccgcttatggagcgtggtgtagggtgctcaggaatgtctgggatggcacaggtcaggacagaaggggacgccctgctcagggagcgactgggaggtgggtgcctaagagggctgagcagccttatgatgcacggctagacctaggatagccctgctgtccccactccctccacacagcctggggtcttctctctttagcatgatctcttgccagcacttgaggatttatggcccagaggccccaaacaactgtgtggctttggccaagccctgtgccggctctggctgctttcctcgtctcctatgcagggcactggaccgctctcccgctgagaatccctgataatgacaagcagactttacccagcttatttttttactgtttggctctgactcaagctaaaaagttgctattcagcagagcttgagttatttttattgttatagccgggcttggtctaggatgtatttggctaaagttgatcttgaccttggatttccagctggctcaggctggaggaaggggaaaaggccctgggaggatgagtggcagatggtgggcatgcctcgcaggctgagccgctggcccttcttccctgacagatacaatctgtggggagagaagaccagagtaattgagaagaatgtcaatttttttttttttgagacagagtctcactgtgtctcccaggctgcagtgcagtggcaccatctcagctcgctgcaacctctgcctcccgggttcaagagattctcctgccttagcctcctgactagctgggattacaggcttgcaccaccatgcctggctaatttatgtatttttagtggtgatgggattttgccatgttggctgggctggtctcgaatccctgacctcaggtgatccacccgcctcagcctcccaaagtgctgggattacaggcatgagccaccacgcccagccaaaaagaatgtcagtttctttccaaacttttgttcttgtacaaatattcttaaatagtactctttttactcaaatagcaagcaccatcagctcaaaggttcatcctagaagtggaaaaatgttgggtcccagatatctgttatgcagttttcccaaagggactttccttaaaaaaaaaaaaaaaaagagtaatgataggtccttttgtttaggaagcactggaattgaacattggacaacagatattttaggaatgaagtcactgtggattagtacttcttttaataattttataattacattagatcatcatgacttggatgaaaagacattatggcctcggggtggctgcctcagctctggtttgccatgtaggaactgacagacagtactttatactcatttcctgttttataaaaatggagctcagaagtcatttccctggaaacactggtcagcaaggcggctgaaggtgcagcccatcaaagaagaaggggcatgggatggtggctgtcaagcatggggagtaccttgtggctcacacccatcctccagtctctctaggctgagctcaggagacccagcagccacagaccacccagccaagtggccttgattatatggcagccacaaagggaactagatgtaattttctttattataatttggcctctcctgatgtctggtttcccttagatgccctgctgctttccttcctccaagcagttggtctggcctcgtttcagatccctcccatcccccagcccctggatggatcagcaggcttgctttcaccacccacctccctggcttgtagtcccgtggtccaggtgaatcaacccaggttgcccagcacagccccattcctggcgtctcatgatcctcctgccctggacctctttctcttttttttctccagaggaactgtgagagtgacactgaggaggacatcgccaggaggaaagccctccacccacggaggaggagcagcacctcctaactggcctgacctgcagtggccgccagggaggtctgggcccagcggggctcccttctgtgcagacttttggacccagctcagcaccagcacccgggcgtcctgagcactttgcaagagagatgggcccaaggaattcagaagagcttgcaggcaagccaggagaccctgggagctgtggctgtcttctgtggaggaggctccagcattcccaaagctcttaattctccataaaatgggctttcctctgtctgccatcctcagagtctggggtgggagtgtggacttaggaaaacaatataaaggacatcctcatcatcacggggtgaaggtcagactaaggcagccttcttcacaggctgagggggttcagaaccagcctggccaaaaattacaccagagagacagagtcctccccattgggaacagggtgattgaggaaagtgaaccttgggtgtgagggaccaatcctgtgacctcccagaaccatggaagccaggacgtcaggctgaccaacacctcagaccttctgaagcagcccattgctggcccgccatgttgtaattttgctcatttttattaaacttctggtttacctgatgcttggcttcttttagggctacccccatctcatttcctttagcccgtgtgcctgtaactctgagggggggcacccagtggggtgctgagtgggcagaatctcagaaggtcctcctgaaccgtccgcgcaggcctgcagtgggcctgcctcctccttgcttccctaacaggaaggtgtccagttcaagagaacccacccagagactgggagtggtggctcacgcctataatccctgcgctttggcagtccgaggcaggggaattgcttgaactcaggagttggagaccagcctgggcaacatggcaaaacgcagtctgtacaaaaaatacaaaaaattagccaggtgtaggggtaggcacctggcatcccagctactccaggggctgaggtgacagcattgcttaagcccagaaggtcgaggctgcagtgagctgagatcacgccactgcactccagtctgggtgacagagagagaccatatccaaaaaaaaaaaaagttgccagagacgagtatgcccatgctccctctacctcactgccaccactcctgctgttaggagctgagtgtgtctccctaaaatttctatgttgaagtcttaacccttggtaccacagaatatcactgtatttggagatggggtctttagaaaggcacttaaattaaaatgagctcactgatatgggccccgatgcaatataattggtgtccttataagaaggggaggttaggacacgcaggaaagaccacatgaaggcccaggagtgggagggggaatagccatcgacaaactaagggggcctcagaggaaaccaaccctgctgacacctcaatcttagactctggcctcaaaaattgtaagaaaataaacttctgtcttttaagccacccagtctgtggtactttttttatggcggccctagcaaaatacacacttgccaactacagccaagatgggggcaggagaattcctaacgatgtgggcggagaagggcgaagaaggatccacggcgagaagggagaggaaaaagacggatgacctggccccttcggtggaaatggcaagggaagctcactcaatggcatcgaaatgtgggccctgtttttcaggccaaaagaacagtgttgctgagcagcactcaagagacgacccatggaagtcagaaataaagtcagggcgaggccgggagattgggaaagcacatgggaagaggctgaaagagaagttttggaaggtgaggaaactgagctgaggaagtgagccaggaaggagagaggggggaaaactattattaaaaggaaagggtgctggggaaagaggtcccagttcccttcgtcagcagccagttgatgggtccagagcaaaatgaccccacaggaacagcaaggcgacccagtttcagaaaagtgtcgagccagaaatggagtgagcccacaagctggctgcagaaagcttagcagctgacctggacttcttgagcttccccagatctcaggcagaaacagtcctgtgcctccctccaccctgggaggatagcagaggccgagaactgccaactgtgggcaagggccctgggcctgcgaggggctcttggctatggttggttacataaatcagcaggcatgttctggaacagggctcactgggagctcctaggaagtcagttacggtaaaggtggggctgccctcctgctaggaagaagagcaggaaagacctttgacaaacccagtcttgatcagagagccttttacaacttgtctagcccaaccactatgtttcactgaagaggaaaccgatgcctagagagaggaagtgactagtgcttcacacaacaaatttgtgaaaatatctaatgaaagcccagactttctggcccctagtaacggtgctcatttcttcagctgataaactgcagtggacctttcaggaaaggatgaaccgttcgctttgcctcattgttaacgagtctcatctattcttgactgtggcctgcctcatccttcattcttggaaatggaagaaattgacacacttgcttctgcccatctttcacagtaaaggacactgcccctggatgggggcatctcagcagcccacccccacaggctgcaaggcagtcagggaaccagtattaatcgggctcctgctgtatgcttggcactgttctagatgctgggttggaacagagcaggacagacacagaccctgtcctaaaggggtccacgttctctaagccctgggaaaccaggactccatcatgcccatatctcctcctggccctcttctcatccaggttatataaagcactgctgactgagtcttcttagcccagctttctggtgttggatggcacctgctgtgtttcctagaagcccttgggaagcacagggccaggcagtgggcagaggggggcctttgaggatgcacaatcctttgaggatgactttgaggaccagcagccagaagccaggcacccatgcgcctcccagacaggggcccagtccctgtggcctctgctagcagacgactgcggcccccaggtgtgaggatgagcgcagcagctggcccagggcgccacgtgtgttctgttggctctgaagaaggatgtgttgaccagctgacacttacagggctgaaagagaccacagcattctcagaggcaaatggaacattccagtgatgaaagccatgccggttcaaatgcaattctttcaagaggtctggagggttcctgccccagagtgtgtgcttatgtgagtgttggatgctgcattaatatttcacaaatatccatataaatattttagtgtgttgcatttcgatgtcaatctcactagctttcctgactccaaatcttagattgcatttgccttttcccttcgcatatttatttgtgaaaaccttattttggaagcaaatgaaggccatactgtaagaggtgaactacaacatctctatgaaggaaaagtcaggccctggactccacagacaatcaaagtaagtacacgtgaaagagctaacttgaggacttgtttctcacagggaattctatctggcacaggattggagaactttccttccatagagtccccaacttgatttcatcctgatattgttctgttcactgtagctgcaccccaaaggaaaatgtcttccttggtgatctgctgagaggatcccattctaagcaaacattaataggcttagggattgagcagctgaagatctgtgaacaatggttaattgacatttcaaaaagcagacacaccattggtgagttccccttaacagtttctctcctccggtttttccctctcccactggttcttcttctctcccccttcgtccattagcaattcataatatatagctgaagtatatattttagtcatttatttacttactgaatgaaattcatgttcccagttcttaatctaaaaagcagttgattatattatctagggagaaatttttttaaagtattttttcctctatgggtcagtgatcctccacccctaagctagaggaagagtgaaagaaaagaaaatgaagctcataataattgtttaaaatctgctctgcaataggaacattttgcatacatttcatttagtcctcttcctaatcttgtaagggaaatgagagccccatttatatgatacagctgagattcagcggagttaggaaatttgcatgcagtcacacagctggagtacttagaatcgggattccagcccagttttgcctaccctcaaatccacattcttctctacttttcctggagaagtacggtgttcaatgaaaaagtaatcccggagaactatgtacactattatactcttttttttaaagctcacaaactatgccataagttgtttagggatacatgtgaatgtgataaaatttaattaattaattaattaatttttgagacacagtttcactcttgttgcccaggctgaagtgcaatggcgtgatctcagctcactgcaacctctgcctcccgggttcaagtgattctcctgcctcaaactcccgagtagggattacaggtgcatgccaccatgtccagctgattgtgtatttttagtagagccctatgtttcagcatgttagccaggctgggctcgaagtcctgacctcaggtgatccgtctgcctcggcctcccaaagtgttgggattacaggtgtgagccactgcacctggcctaaaattgaattttaaaagcaagggaatgaccactctcaaaattctggatgaaacttacatctgggtggctgagatggggaggaggacaaggtgggcactgggctgttggcagtgttccagccaacactaagttcacggtgggctcctgcaagttctatttattataatgctttctaacttacatattagttgtctatgcttttgcatgtatcaaatattatgttaaagataaagggagaaatgaggtgaaaaaagtccatcctaatggtcaccatttgccgcagcagcctctattagggacaggacgtagtgcccctccctgcagtgtttttctcacacgactcgatggtgggctttttttgtgttcttctaccagcacctagatcagaggtcatcacaccactcaatgtgagaatacctggctggaatttttatttcccttttatttatttatttatttttaaatttattatatatatatattttttagatggagtctcgctctgttgcccaggctggtgtgcaatggggcaatctcggctcactgcaacctccgcctcttgggttcaagtgattcccctgcctcagcctccctagtagctgggactacaggcgtgtgccgccacgcccagctaatttttgtatttctagtagagacggggtttcaccatgttggccaggatggtctcgatctcttgacctcgtgttctgcccgccttggcctcccaaggtgctgggaccacaggtgtgagccacggagcccagcctttattccccttttaaagagaagggataggaaataccctctgcacctcccagccctgcctcctcaaacatcacttcccctgggagtttgcgtaaggacttgggtctgaggacaacttccaaggccgacgaagctgagtttgccagctcatgctctggtgccttcatgtctctttggatttaaacccagaggccagaacagcatttgaaaagtcagctgggccattatcctgctcctagatgggattgcacttgggtttcttcgtctcattttggaattgagccagggagatcctatatcatctctcaattcccttttccagttcttaacagtctttattatattttaccaatcagatccaaaaagcctgggctaagtcctgccactttgcagctgttggaacttagccttgtcattcaacctttctgggcctcagttttctaatctgtgaaatggtgatatcagtgttacttgtcatgagtgccttgttgaaaccaattttgtaaacgagctttgtcaactttgaaggacttggcaagcataaggaatttgtttttacacaatttagttacactctgggaccataggcatagagtgtaaggaagctccaacttcctctgaagattccataacagtcgcttctgaaataaattgacaatagacagattgacaggagaaaaaccattttaattttgtggctgtacacaggagcctcatagaagaatgaggctccagagagggacccaatggttgaagtttttacagcataaaggaatagagccttgaggctttggggggaggtggtgataagttacgggaaggaaaggggaagaactgcacagagaatggtgtcttatgcaaatacaagtccctcaggtaatcaaagttgttttggaactccctccagaataggcaatagcctgtctgggggtggtgatgacttttaatctccttgtggttattaatattccctggtggtttgatgagattcctagggaaggggttcaagacaattccattccttttggaagaccattcctcagtcaagaggtgggaacttcagagggagctcctccctgccctagggaggaaaaagaggggtgggaaggagaaggtcagagagagaccttagttttcctctggggcctttcagtctcctttgttcaaagcagtcagcatagcaccccaataagagcaactctgagaaatgtagatgttagtcaaccatggccaatagtgagactcaacactgcttacctagactctggatggagggctcctggagatcagtgcacctcttacctctccgactctcagcagtggtttaaacacaggagaaagcatcacgttgatgctggaggctctcagcgaggggcctctcagctggctgtcttcctcccacccctccgagagggcctgctgggagtcagggagctgagaggacagtatactgctcctttgtcttttcatttagcaccctaacacaggttctgaatgaaaagacaaagcgtgtaacaactcttttttttttttttttgagactgagtctcgcacccaggctggagtgcaatgtcgtgatctcggctcactgcaagcttctcctcccaggttcacgccattctcctgcctcagcctcccgagtagctgggactacaggtgcctgctactacacctggctaattttttgtatttttattagatatgcggtttcaccatgttaaccaggatggcctcgatctcctgacctcgtgatctgcccgcctcgacctcctaaagttctgggattgcaggcgtgagccactgcacccggcctgctctttgtcttttcattcagcacccaacacaggttctgaatgaaaagacaaagcctgtaacaactctttaaagaactaagtgcgggacttgactatttgcccctaccccgttttcttattttgagtgttgtattagtttgttaaggatgccataaccaaatatcacagactgggtggcttaaacaacagaagttaattttctcacagttgtggagactagaagtccaagaccaaggtgtcagcaagatcagtttctcctgaggcctctctccttggctggcagacagccgcctccttgctgcctcttcacacggtggtccctcagtggatgtgcgtccctggtgcccctgtgtgtccatatttcctcttcttagaaggacccttgtcagattggattagggcccttacagcctcattttaacttaatcacctctttgaaggctgtctctataaatacagtgacaattcagaggtactgagggttagggcttccacatgtgaatttggtggggacctaattcagcccatacactgatgtgaatctaattcttcatttaaaaaaaagtaagtactttgccttcctgttttacatctagcttctgaatacccctgggagatggagctatgggcccagcctggcacagactatctttggtttatgaggtcaggtgtgccaaaccaccagcagggcagagacaagcatctttgtaggctttatattccaggcacccttgggcactggacaccctgcctcttttcttactcaggagttgattgtctgtggagtccagggcctgacttttccttcatagagacgttgtagttcacctcttacgcgtggtggcgtgtgcctgtaagcccagctactcaggaggctgaggaaggagaattgcttgaacccgggaggtgggggttgaagtgagccaagatcatgccactgcactccagcctgggtgacagagtgagactcccactcaaaaaaaaaaaaaaaaaaaatctccacagtgtaactctgctgtggttggtgtgtatctgcctttttcactcgtttttatagatgaaatactattttatgatgcatcccaacaagtatttgttaatttcaagacagtagtggataaaagtgaggtgcatggggggttaaggtaagaaagaagctgggaaggccgggcacagtggctcacgcctgtaatcccagcattttgggaggctgaggtgaacagatcacctggggtcagaagttcgagaccagcctggccaacatggtgaaatcctgtctctactaaaaatacaaaaattatccaggcatggtggcgggcgcctgtcattccagctactcaggaggctgaagcagaagaatcacttgaacttgggaggtagaggttgcagggagctgagattgcaccactgcactccagcctgggcaagaaaagcgaaactctgtctcgaaaagaagaaaaaaaaaagaagaaaaagctgggaagaattatgttgccattgaaacttagaaatatacttcaaatagccaaagagtttcattgttttggctgcttcacttatttacacactttgcccctgtgagcaggcactgagtgtttgtctctgggctggctggcaagacagagggtggtggaggtgcttggaagatctgtccggaagggccgggcagcctgacggaaggtcgtgcaagcttcccgtctgtgggtgcaagaggaagctctggatgggagctctttgaagggaaggactgtgtcagttcatttatggggctccacagtgtgctggtgcctggcagatggtatgaagatctgaggaggaaaggtggggtgggagggaatgaaggagggaatgaaggaaggagggaaggagataagaagtgtggcagccccggaagtgccttcaagagagaacccgcagcaaagagtgctattcactgctggcccccagctgccaccccttcagggtgttgtattagtttgctaagtgccagctgacttttcaaatactgttctagcctgtaggtttaagtccaaagagacatgaaggcacctggagcatgagctggcaaactcagcccagttggccttggaagtcgtcctcagacccacgtccttactcaaactccaagaggaggcgatgtttgaggaggcagggctgggaggggcaggggtatattctaccccttctccttaaaaggggaataaaaatcccagcccaggtattctcagagcattctcagagtagccacaaggtcttcactctccgtaggctgcttttggccagtgattgagcatggtgggatgggagacacgcggcgggtactcgaaccaggccattcctgcccagcatgggacccttctaatatttgcccctggactgctcatcacctggctgagcccttctctgggttgctctgccatcagaggcacttcctagccagccctccttccttcccaccctccttccttaggtgtcacacctacatcatggcctgaaagctctcccttgcctactcctgcttcctttccccttcatccttcataggcgttcctcatcccacaccccaggtctccagcacttctcatcccatcttggcatctgcttcctgaagaatctgaacccacataggagagagggcaaaaggaggaaagtttgaatttgctccttctttttgtctccactgattcctttggcaggcatggactgacacagccactgcactcaccttaaagctgtcagctggggacagtggtgcacctgtagtcccagccacttgggaggctgaggcgagaggactgcttgggtccaggagttggaggctacattgcaaactatgattgtatctgtgaatagtcactgcagtgagacctgtctcttaaagaaagacaaaaaggaaaagaaagctgtgaacagagcagttggtactcaattcgtctttaaaaaaaaaaatcaatggtgggccaggcgcggtggctcacacctgtaatcccatcactttgggaggctgaggcaggtggatcacctgaggtcgggagttcgagaccagcctggccaatatggtgaaaccctgtttctaataaaaatacaaaaattagctgggcatgctggtgggcactgtaatcccagctacttgggaagctgaggcaggtgactcgcttgaacccgggaggcagaggttgcagtgagccaacatggcaccattgcactcc

SEQ ID NO: 1835 - DNA, 1716 bp, Homo sapiens
gattgtatgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggtgctgcaccacaatgtcatcacgctgcacgacgtctatgagaaccgcaccgacgtggtgctcatccttgagctagtgtctggaggagagctcttcgatttcctggcccagaaggagtcactgagtgaggaggaggccaccagcttcattaagcagatcctggatggggtgaactaccttcacacaaagaaaattgctcactttgatctcaagccagaaaacattatgttgttagacaagaatattcccattccacacatcaagctgattgactttggtctggctcacgaaatagaagatggagttgaatttaagaatatttttgggacgccggaatttgttgctccagaaattgtgaactacgagcccctgggtctggaggctgacatgtggagcataggcgtcatcacctacatcctcttaagtggagcatcccctttcctgggagacacgaagcaggaaacactggcaaatatcacagcagtgagttacgactttgatgaggaattcttcagccagacgagcgagctggccaaggactttattcggaagcttctggttaaagagacccggaaacggctcacaatccaagaggctctcagacacccctggatcacgccggtggacaaccagcaagccatggtgcgcagggagtctgtggtcaatctggagaacttcaggaagcagtatgtccgcaggcggtggaagctttccttcagcatcgtgtccctgtgcaaccacctcacccgctcgctgatgaagaaggtgcacctgaggccggatgaggacctgaggaactgtgagagtgacactgaggaggacatcgccaggaggaaagccctccacccacggaggaggagcagcacctcctaactggcctgacctgcagtggccgccagggaggtctgggcccagcggggctcccttctgtgcagacttttggacccagctcagcaccagcacccgggcgtcctgagcactttgcaagagagatgggcccaaggaattcagaagagcttgcaggcaagccaggagaccctgggagctgtggctgtcttctgtggaggaggctccagcattcccaaagctcttaattctccataaaatgggctttcctctgtctgccatcctcagagtctggggtgggagtgtggacttaggaaaacaatataaaggacatcctcatcatcacggggtgaaggtcagactaaggcagccttcttcacaggctgagggggttcagaaccagcctggccaaaaattacaccagagagacagagtcctccccattgggaacagggtgattgaggaaagtgaaccttgggtgtgagggaccaatcctgtgacctcccagaaccatggaagccaggacgtcaggctgaccaacacctcagaccttctgaagcagcccattgctggcccgccatgttgtaattttgctcatttttattaaacttctggtttacctga

SEQ ID NO: 1836 - protein, 372 aa, Homo sapiens
DCMFQASMRSPNMEPFKQQKVEDFYDIGEELGSGQFAIVKKCREKSTGLEYAAKFIKKRQSRASRRGVSREEIEREVSILRQVLHHNVITLHDVYENRTDVVLILELVSGGELFDFLAQKESLSEEEATSFIKQILDGVNYLHTKKIAHFDLKPENIMLLDKNIPIPHIKLIDFGLAHEIEDGVEFKNIFGTPEFVAPEIVNYEPLGLEADMWSIGVITYILLSGASPFLGDTKQETLANITAVSYDFDEEFFSQTSELAKDFIRKLLVKETRKRLTIQEALRHPWITPVDNQQAMVRRESVVNLENFRKQYVRRRWKLSFSIVSLCNHLTRSLMKKVHLRPDEDLRNCESDTEEDIARRKALHPRRRSSTS

SEQ ID NO: 1837 - DNA, 29934 bp, Mus musculus
  misc_feature (1)...(29934): n = A,T,C or G
tttatactctctctcccactctcttctgcaaaatggagtagtcctctgagatagttccaaacacatttcccctgaagctttctttcaccaggtaaaggctaatacatgtcactattcatgttccagacaaatgaacgaaataccctaagacaaggctaccgttaactccgcaaaccattattcggtgcaaacaatgaatctcaaatatcagcaggaacgtttcatgttggtttccacggtgcaagctattaaagttactttctctaaggttaagagtgaccctgttttgaaagcagaggtttgggtctctgcctactggagtttttaacatatcaaacaacatttattttgctcattctaccttcaataagtatgtatgtaaaggtaattgcaagccaagccctgttactaacatctttaaaacttccaaaaatgaaacaaaccccctcgtagtgcttacaccctggaatggaccacatagttggtcattaaccaatggaagcagtggcatgttgtataagatggagaccaagttgccctttgcagggctgacaggaaggccttgagtgttggaggcaggagagagcatgagtgagaagccagaagacaggaccacaaaattccatctgaaatatcatgcacacacacacacacacacacacacacacacacacacacacacacactatcttgaaagatctgcacaacaaaatgataagcgtgaatggatcttctgagttttttttttttaaggtaacagagttgaaattatgcttcacagaagattctggaacatttcttccctaagtcctcaccttcttctctcagctgtccccatgcactgaattccactgcgatgactgaatgatccctcagccttcagactcctgtctgcacggagttccatctggtgagaagttggaggagcaaggcaggtgagagggtgtgactctgtttcattgcatgcatgtatgacatttccaaagaataaatttcaaaagctaaaatgtctcccaaaataagaagcctaaatcagcaccgtgctttcttaattcttaaaatcatttttcctgggggctgaagagacggttcagtggttaagagcacttgttgctcttccagaggactttgagtttgattcccatcacccacatggctgttcattacctctgtaactccagtcccagggaatccaccgcccacttctgacttgtgcaggcatcgtagatatgtggtgcacaagcatgcatgcaggcagaacacataaaatataaataaaggttacattcctaaaacttagctttctgtatattgtgtgtgagaaagaaagtgtgtgtgtgtgtgtgtgtgtgtgtgagagagagagagagagacagagacagagacagagacagagacagagagacagagagctcacaaactctcgtgcatctgcttatctgtgtgcaccccacatatccagtgctagcagtgaccagaagaaggtatcaaatcctggaactagattacaggtgatggatgacccacctgatctgggcactaggaactgaaccaggctcctctataaagcagcaactgctcttaaccactgagctatctctccagtgtccggagacatgctttctagagataccttgataatgtacacattgagaaacactagctcatctgttggtagactcctacttagaaagagcatgtgcaatcattattccttacgaaacaaaatcaaaatgctagccctgttaaaagcaagttgagccgggcagtggtggttgcacacctttagtcccagcacttgggaggcagaggcaggcagatctctgtgtttggggccaacctggtttacagaattagttccaggacagccagggctacacagagaaaccctgcctcaaaaacaaacaaacaaacaaaaacaacaacaaaaatgaacaaaaaggcaagttgatacacttcctctaggaactgtaggtgcttaaagcaaacagcagattctatgaggctggcagtggttgacagtgtgaaactaatattgacagcaaccaaggttgacttgggacttttggagttagtacccagcatgtcaagtgagctctctgcaaatataccctcacattcatcagcttggcatggccaaaagcaaacaaggtacccaaccacttgatcagaagcgaaagctcgacaccagtgccatagcaacagtgggttttgtttcctgctctgcgggccagccagtggtgtgagtactggccagaaggaactggcacaaacagagagggtaggatggaggtatggcttgctcgaagcagcacagtatagagagtaaaaaccgcaagagagggaagccaaggttatcatcaaaatgtggctgagaaacacaagatctgaaagttttgttaataatgatagtaagtctcaaaaaataatgacagcagcaatagatggcatctgcttgtaggactcctgcaaggcactagctcccaaatgtctttcacctctactgacctctgagacaaggttacaatgtttctttctgttgaaaggttactgtttcccactgttctgtgtttagtctttgcttactagagcgttgtttgctgagtggatgaggtacctgggcacagagcagttatgtaacttgcctgagcttgatacagtaagtggtaaaggaatgagtcaagacagaagaaagcaaagctggaaaccagaaaatgaggtttgagtcagaaaccacagagagggaggcgagggataggtcggtacaagtgtgttagaagaccagaagaacttcagaaggctgaaattctctacagctcttcctgaagtctcacagaagtgataacggcagccaagaatagccatgtgagtacggggaaagcgggttgccatgaagggaccaagcatgcctctctaaggtgagccttttgaaacagccctgtatcccggctgcccaagaaggtgaagtaggaggatcaaccccagttcaagggcagcctgggatgcgggtgtgttcaagaccagcctgggtaacttatagagacctgatgtcaaaatagaagagcatgaaaaggtctggagatgtggctcagaggtgtagtgcctgcctgtcatgccaaaggtcctgagttccatcccctggaccacccaaaataaatcactatagactctaaaaaagggtctgctcttttttacttacttactctgtatttgttttatttatttatgtctttctagttattctgcatttatttaccaacatgacaagcactgcttcaggtgtaggtgaagtgctagccttggtccaatgggtggttgtcactcacacccttctctcacaatggtatcaggctaagaaagttcaaggcaggataaagagaaagctttctgccctggaggcaaagcctgtgctcctgcccggggttctctggggtgcacatggctctgacaggaagagcagagatgcttggagttagaagcactgtcaaaaccactaaaccaaacacctcaccttctgctttttggcttaccgtctttcagtcccacccctctccgtcttacacacacacacacacacacacacacacacacacacacactggggtgggagaaacagagggggggagggagaggggaaagcgcgttgccatgaagggaccaaagcatgcctctctaaggtgagccttttgaaacagccctgtatcctggctgcccaacgtgaagtaggaggatcaaccccagttcaagggcagcctgggatgcgggtgagttcaagaccagcctgggtaacttatagagacctgatgtcaaaatagaagagcatgaaaaggtctggagatgtggctcagaggtgtagtgcctgcctacaatttcaattttcaaagccaacgttaataatggttcttaaatgttttaaccttccttccagcccaccacccaacagaggtagtagaaagaaaatgttaatagggcaagggggaatgtggacctgttcagaaatagttctttgggacaattccaatcttcattgtcaggatattagcagttcagttcacaggaattaacagtagtagcccaatccgcttgcaaacaccattcgcgaatcagcaatgacagttcaatccagaaggaaccatgaggctctgccaataggcccaagttcatggaagctgcaagaagctgctgccaaaatatcacgagatgaagtcacagcaaataacaatcagcaaagaaggcaaggcaaaccaatgccacagcactgtcgtcagaaaacagcatcagcaaagcctgatgaaaggttctaaagagttacaaggtgaaccaatgccacactgtctcccactgtttgttgggctatatttatatcctctccaaacatcatgtgctctctcaaacatctgctctaacaaaacttcacatgccccttttccaggcaacttctagaaaaacaccacatgtctgttctcatcaaaacatcctctggtaagacagtttccagaaaaaaacattgtaacctgtctcagaggttggtagaggtgaaagacatttgggagctagtgtcttgcatgagtcctacaagcagatgtcatctgttgctgctgtctcattattttttgagacttactatcattattaacatagctttcagatcttgtgtttctcagccacattttgatgataaccttgcttatcagaaatttccacttcaataccctcttgcatcagtagttccaagcaatgttttataaggttctagatgttctgagatctctcaaaggtaagtaggaaagcaagaaagaaagcttctacaggcccagcacccgagcctgctgagccccgcctctcctcagtgacatagggatcgtttcatcttttctgttttgtcttgaagcttccgtgagaactttattggaagaaggggttctacagttagggggaaagactgacgacttgggggatagctcagtaacaaagaacttgccagaaagcataaggccctgagttcaattcccagtgccttcctgaaaagccagtgtggtaatcctagggccgaggatgagaagacagatgagttcctaggagtcactcaccagctagcctggcctgatccgtgaacccaagatcctttttctgtttctgtgccacaaggtctcaacaaaagcagcttaaatagggaaaagtttatttagctcataggtccagtgtggagaaaccctgctaattaaggtactagtctaccattgcctggatagccttctgaactcggtacaagatggcagactccctttgtcagcagggcttcttctctcaccttgtccagggaactcaccccccccccacacacacacacacacctctacctgcagaatgtcacagccttggttagattaccagttcagctttctccctttcagcaagcacctgagattcctagagtgccttccatgctaatgaggcacctccatgccttagccttcagccgatgacctctgcccaccatggatatgcctaccccttccccagagctatataacccttgattcacccccaagtaaagttgacctgtctcccttaagctgatcctgaaatgtgttgccatttctgtttgtactcacaggtcacccaaaatcctgtttgtcgattctgttcccttcatccttgtgggccagtggccaacgaccccagggacaagggagcagacccacattccaggatacagtgcaccatggtgcagaagtcatggccccaggatcttaaagcatccacagttagaaaccagagggtgtgactatcagtgcccagttctctttgtcctttttgttcaacccaaggaatgatgctgccaattaacctaatcaaaataattgtcccagtcacacccagaagccaccctaatctgcagacttcttctcaagtgtgtccagaggcatacaaattctagatcttgtcaacttagccaccagcattattagtcacacagaatttgtctcaagagagaatgtgggaccagcaagaaggctcagagggtaaaggcacttgccaccacgcctgacctgagtttcatctccagacccccacatggtggatggacagaaccaatttccacacgttagcctccaacttctacacatgagctgtgtcatgtgtgcacacaacacacatacacaatgaaacaaagaagaaatgatacctaaggctgtcctctggctcccacatgcatgggcacatacatgccacatggagccatagacatacaaaaatgcacatacaagcgcacatacacataaaaaagaaaagagtttgaacatccttgtttctggaatgaatctccaagccattggtgtaaatgtcaactcaaacagaactgaaaacacatcagctgcctgtgctcaacaatctctcaagtcttagaacaagccagaaaccagcttcaaacctgccttcctcttctacgcaggtccccaggcttatgcaggactctgccctctcaaagctgttagaatggatccctagtttctcacctctgctggtgtcactggccccagttcaacagtagaaccaactgagaagttttgaaactgccacttcaagggttaaacgtggtcaacccatgacccagaaattccactcttaagcctgtacccaaaagaaatgaaagcaaggggctggagagatggctcagtggttaagagcactgactactcttccagaggtcctgagttcagttcccagcaaccacctcgtggctcacagtgatctgtaatgggatctgatgccctcttctggtgtgtctgaagacagcaacagtgtactcatatacattaaacaaataaatatttcttaagaaccagccccctgtacaccatccccaattaagtgttcttctttataagggttgccttggtcatggtgtctcttcacagcaatgaaaaccctaagatacctcccccttcatttcaaaacaaaaaacaaaacaaacaaacaaaaaaacccaacaacaacaacaaaaaccaaaacaaaaaccctcttcctttattgattgctactaattgttccaagatcatacagtcaatgatgtattaagatggacaacatctccccaaaattcacaaccactggtacctcagaacatgatccactttgaaaatgcattcttgtgttgtgtcccttatccatgaggaaacaccctgagaaacctgctaagcaatgtcatcacgtcccaacatcacaggctatgatcccactgccttgtgcttgtagcatctaaattgaatctacaggacataggtcgggtgtctcacgttccagagtaggatataggtacacttgtaagttagatggaaatgcaggttcctgttagcgtttgggaatcggtacttattgcaaagaaaggacaggcttgtttgcttgaagctatgcctttatagtctggccctgtgacttagccgaaagggagggaaatgagtttgccaatggaggaatggtgatacattagaaactcaggattgagattcacaggccatgatcatgcacaagctgaagaaggcggatggcttgaacccagttcaacatttgcctgaaaacatagacattattcccaagaaaacaagaaggaagattgcttgacatttttttttttgtgatggtagtgagtattcatcacagtgccctatatctgggtggctggagaatgaaatcttccagctgtttctctgactcccatcctttcttctgcactctggtcttttcttgatagcaacagggagcctttcaaaacaaagtcaaacgccctggcctttctcacccagcctgctctcctctctctcactgctcccaatccagccaggcctctacctcctggggtctagattagagcagtagctggccagcttgcagaacagtgaaagcatagtttgcatatgtccctctgctcctctgaagcctgcagcggctttccttctgactcagagtaaacctgtatgactctgggcaaagtcagattaaactctgcccgtagcagagttcacctccccagccacccagcctctgcattgcagggctctccactgagagctctttttccctttttccctctgtccaacggctcctccctcacttcctgcacgtgggaaatgtatcctttatctccgtgtggtctccatctccaccttttccatttcccagcgtcgctttccctcttagtatttatgagattctagcatattaaacactttacacacgaaacttttcaaatgtctaccttttccacccccaaacaaatacgtgctttaatgtaaatttcacgaagaaacagatgttattgttgttttttctgtttgttggagccaggctcctactatatagcacaggttgtcccagtaatttactaagtagcccagaataaccttgaactttgacaatacttatgactgggtctattgttttttattttgagacaggatattcttatctgcagggttcaaacaaaaaaaaacctacatatccaaaatgtggggaaaaaatgcaaaaaggaaaaaaccctcctaatgttttaagtaagtttatgatttattcctgcttatagctgggtcagatgcaagcagttggttggccaacacagctagctagcttgtgccaccacaccctagctggaggacagaggtgtttgatttgctagaagaagatctgggtgtagttcagtagttgccattcaacagatggttgctacaggaaagagcaaatgattaagcaaattgggttataacaagacaacggatgactaaggacacaggaaaacactctagtatactagacatcagcgtaaaaaaagacctggcataatgtaaacaccaagattccagaactctgatcaaagctacagagatgtggctttaagcctctactggttcttttgttttagataaagattcctgttgcctttggtcctcttgacatttcagtctacacttgcagatttacttcatcgaccacataatcattttctgcctaggactctatgtggagcacctcatccactaggacacgttttgcacgggctacgagttaaaatatcgttctgaaaatagccatttggcctccaataaacaacttccccatcagagcatccctagaatttacttactgaacagagataaaggataacaataagagagtgtaactgtgtaccaagtagcttcagaaccttaaatatactcctagaggccctagctttttaaatttgtctctactgcatagattaataaggagaaatgcttctaatgaatagagacttaaaagtacccaaacactacctgtgctgctaaattgatgggattgcaggtaatttttaaatcttttaacagttttttttttttctttgtgttttgtcgttttgttttctgctctcaagatctccttgctcctgtctccctagttctaggtggtaaatggcagtggccccccagagcaggccctcaaacggaagttatgtgtgcgtgtatacatatacgtatgatcacgcaactgtaaaacctggctcagcacaacaggaaattgttccgcaacatctggaaaagagaagcaaaccaaaatgctctggccgactcagcccacactccacccaaacgaggagtctgcgaaggcggggagatcccgctaaactgagcggccagtgctccgcccacggaaacaaatccttcaggcgtccaatccgcaagcctatgtaaatgacaagggggcgtggttagagggacgcccgctgtgggcggagccactgcggaagcagagacgtaaccgagggtagtactgattggctggcacgtaggtgggtggggcctgcaggcagacccgcctcgccgaagggtggtgcctgagttaggaagaacgctgagcgcggcaccgctggccccaggggcggagccggaagtggggcgttgaggtctccacctcctcgtccgtgagccggccgttcccccgcttctgttcctagtccccccgaagtcacagcctgattcccggaggcccgagcccttagtctgggcggggtggcgcgggccggaaggacgccatcccggcctgggccatggaggctcccgcaccgtccctcacggaggaggatttgactgaagtgaagaaggacgtgagtagctccgccgggctgggcgcagcggggcgcagcggggcgggcgggcggaggaaagcggaaacccggagctgagcgacggggaacttcaggtcggaagagcgcggggtcctggcacagcacgacctgcctgcttcccgggagctggctggagacgatccaccagcgacccgggagtccgcggttaagcctgtcggtgggcttggatgtttccttgccatccgctcgtcgctggtggctttccatcctgccgatcccccatcccacgccaccgccgcgggagctgctagcctagggagccgccggagtgtgcccacagcgggctttggaccaggcatccccgggcgtagagcagatgggtgaaactggtctctatcgggggctgcggaaagctcgccagctgaacgcacgccctggaattccccgagtaatcagacgcccacgtatttaaatgaagggggtgtgcgtacttctcgctgagacttggttcccaggtaaacgttgaaaatactcccgactaaattggactcttctgcttagaccatgtagaacttcacagacacagtaatatttgaggaaatggctttaaccacaacgtgcttcgttttttttttccttccttttaacttcttttgccagaaaaaaaaaaaaaatcaaatgagcacaacttagataatatacatgaattcacattaaaaaccggtaactcgttcttacttagcaccaaaatgctgccgaaaaatcgtctttacgaacttaacctcaagttgttgaagatgtatgtgtgcttcagacccctttttctaccatacttaccccttgtaaagtttattgcgctgtgcccataattacaactgatagagctaagtaccaggagggaaaggtacggccaggataactgccatagtttccgtgttcagtggagttggtagggcacctgctgtatggaaagctacacattctacttgaaacaaggtctttgatacccactatagtccttaagaggacagtaaaccctaagtgtaaagtctgggagctctgttcccatgttccacagttttgaattttctcacaatcattaaagtacctataaggagagaattgcttttcattttatagctggcaaaacaagacaagacctgtctgtagataggggaggagagtgctgcaggcctttgtttctgctccggggttcattgacgtcatccatcctgacagttgcacgttagacctgtgtcagatgtccataaccttagagagactacagagaagcgtcagggtgtctataaaaatagtgttccttagatattcaccctattatttttgaaactgcttatgacaagcttaaacattcatccgcattatttgaatctcctttttttctcaactccaggactttatttccaagtctaccagaactcaaactataatttcatacatttggctgttgttttgtttctctgtaattctgactgtcctggcactcacctgtagaactagctggcctcaactcccttcctctgcctcccaagtgttgggattaaggcatgagccaccactgcctgctatgttcttatgttttcaaaacttgaacttttcattatccttcccccaaaactgcttggtgtcccttctgtattatctgtcttgataaatggtgggaagttgtttacatgaggctgtctgtctgtctcagggtttgctttctgtggcttctgttgcctgtgggtcagctatggtccaaaaatatttaattatttaatgggaatttgatacggttatagtgatacaaattgagcactcttctaagtaccgtgacaaaatcttgtgccatctcactgcatctagccagggacacgagtctcaccttttccccagtgtgtgtgttacctgcctgatatcctcttagtagtgagctgtcttggatattagattagtttttatggtggaaagcttgatatggggttggtaccatgaggttttgcacatccatagagagtcttggtccatgtcctcccatgttagtggggagcacaggcctactgctggtccccagggctgtacatcttcagcgctgctcctgttttcatctgtttatttaacacaccctcatcttgttagaacttgtttccttttaacaaatagaggtaactttatactctgaagttgataatgtaatactaacagttaaattaaggactaaggaactagagagatagctcagcagttaagagcgctgactgttctaacagaggtcctgagttcgattcccagcaaccacacggtggctcacaaccatctgaaataggatccaatgccctcttctgatgtgtctgaagagagagcaacagtgtactcacatacataatataaataatctttaaaaaaaagaactaagacaaaattctgttttttacaatagctcaatttcttgattgaagaaaagtaaccatgaactgataactttaaacattataataaagtttccatccatccaaagcactgcactctgaaatgcagagcacacagcggtggacagaatgtttgggggttgcctccttcaaacatgtaggccattaaaggtgaaaagtatgcatatcgtttatacacctgggcactgggaaatttgctcagtgctatgaagacaacaccagggcatcatacttgcaataggatggttagatgtgcttggttttgatctaaggttataacagagctggggaagcgcatttgagacagaatttgacaaggacctaagtcaggacctttgtaagttcagaatattgaaggatggcagatggtaacaaaatgaaattagggatgtgggctaagcaaactcttgaaggtcttaacacttttttctcttaggagtcatactaacgaattaatagggttttgtctgacttttaaagatctgcctgccttttctgtagaccaggaagatgaggaaaagtgggaaagggcatggaaggacttggatacactgaaaggcagtgatgatatggatcaaagtgaaggccgtagacatggatggaacacaagctcggggtgcatgctaagaacgtggacaggatgggagttgaaggaagagtaagaatgaagatcagaagagatttctgcactagaaatacaagcattctgttgaaaagatgagaaccagctccaagctctcgagctgcagccctcatcatctgagaacgggatgggaagcacagagagaagtttcatagagatcagaaacaatcaggacagtgccctgtatgctcagcaaggagaacgtgtctggaggaaggagtgatcagctgtgaccctgctctcagaagccaaatatgatgaaggtgggaaggacccgtcagtagaggaggtcctcggtgacttgggggagagcgtgggacacagtggaaacgcctggggatgaagtggggaatgtgatgaacaatggaagaggctggggctgcgagacaggcgtggccagctcatcctggatgttaaagtacggcttcccagcgatgaccagcaacctcaagcttcaaagatgaagggagctcagggtatgagaaggaaaactcaggcacatagcagcatgaaacagtgctagtcctcgattgtaagtggagcagaagtcctgccatagggtactgctgaatcaagctggagaggtggcctgctgtgggcttgcctgccatgagcttgcctgctgtggcccagtagtcactagtcattgggcctccactgtagaaggaactgggctgagccttcatgcacactatcccaattagtcttcctagatgggtttaattctttatccttattttgccaagatcctgaaggcccagtggtaccagtttgtaccagttctcacagaatgttacagattcagggttagcagaagtttgactcattgcacagccatgctgttcttaaggactttttagatttttttttttttaaatattggtattttgactgcatgagtgtatatataccatgtgtgttcctggtgtctacaaaggtcagaagatggtgtcaggtcctctggaactagagttgtggagtattgtgagccatcatgtgggtacttggaagcaaactcatatagtctgcaagaacaagtgctcatacccactgagctatctctctagcccagtgctctcaactactgtgctgtgttcaggactatccaataaatcatgagcagacactgtgttggtataatttatgtaatggttcagatttctattttctcttgaaaattgtaaaatctaatagatgcatgaaagatttgagaaagaggaggggattacaaaatgctatttttctgttagcagtccatgcaggctttacggaccatgcatgcccagagtggtgctgaagtcacggtgactggtcttctgataacttacatggtcttccgatgacagcccgtgtgtgctgtctattgcccggctaaaccaggagccctctgtatgcagtattaaaaccttgttcatcttttcatattcacactagaaatttatacatacgaagtttactgtataaataaataaatgtgtgtggaaatccagtagacaaaaacctgtcagacgctgagcggtacttggaaggtactgagcgtacgcctttaatcccagcactccggaggcagaggcaggtggatttctgagttcgaggccagcctggtctacagcctgagttccaggacagccagggctacacagagaaaccctgtctcaaaaaaacaaaaaaacctgtcagacgccttcacagggacagctttgcaggcattgttactaaggtggctctactgaagctcccaccgcctttacctcatcgctatgaatgtgagtctggttaaccaccatcattgccctaacgggatcagtcacggcgcaccgtgccgtttctaaacactctgcgcatgttaataatccctctcaactatcacatgaagatgcaaacacagttaatttgcctcaaatcccatgtctagtaaatacaggcacgaatatgcaatgactggcatcagattgtcaccacttattgagacaaacgtggacctgatttaaacagcacacagtgcatgcctgagaattaattacatggtacttcactaatatgtacacttttttatgtttcaattaaaactaatgaagttaaatacttaagactagcctgagctaagctttccttttcttagttttttttttgttttgttttgttttgttttgttttttttagaactctttggttctctctgttcctctctgtacttccctttcttctcccttccttccccgaggactgactcagcaatnnnnnnnnnnnnnnnnnnnnnnnnnnnnnnnnnnnnnnnnnnnnnnnnnnnnnnnnnnnnnnnnnnnnnnnnnnntccaggactgtctcagtgagttgtatcatttttctaactagcctcaaagcaaagacatatggcccttgggaggatttgggctttgtgtgtgttctaatggtttcgcattgaggtgatgtactaattaataatacacatgaaacagccgcagattgtgagactccacactaagttgtcctggtcctaattctgaaattctctacttgatagttactacaatttacagacatgtgtttttaatctttactcctgacctaggtgaccctctgcaggtccctcctcacagcagctgggtgttagttttcaggggtgaaggtgaagcagaacagggcgctctgaggactgtgggactggcttctgctgctgggcatcatctttctcagcatgcacttaaaggacccaggcctccctccctccctgagaatgttgtctcataccagttaagatgtgtaattactaaccagtcacctgcgattttcctccgtgttacagagtaacattgaagctttcttcttttttctcttaggctttagagaatttacgtgtttacctgtgtgagaaaatcatagctgagagacattttgatcatctacgtgcaaaaaaaatactaagtagagaagacacagaagaaatttcttgccgaacttcaagtagaaaacgggctgggaagttgttagactacttacaggagaaccccaggggcctggacaccctggtggaatccatccgcagggagaaaacacagagcttcctgattcagaagataacggatgaggtgctaaagcttcggaatataaaactggagcacctcaaaggtgagcagcgggagagagcagacagcgaggagagtggtgggtgggggagcagacagtgaggagagcagagagccaacagcgctcttaaaaccaccaccatttggtttccaaaggcttaagggtcagaattatattcaatttacattcttgccagatatattatcatgatgtaaactcatttggctctatttgtatttactttacaatagtgtttgtaaaagtttatttctaagatactcactcccattaacttaatctgctcaaaaagaagctcagaaaataccattgattacattttaagaagatgaaccatgtgacttatgcctgtattcctagacacaggaagctgagacagggggattgccacaagttcaaggccaacttgggttgcattgtgagtcccaggtcagcctggtctgtggagtgagaccctatctgtaccaacaactgaagagcagtccataggagaaggatgttcagttgaacgctgctcttgcatgtgttttctcgcaccagttggtcagaagcagtgactgacgagtgtgtaagaatcctgtataaagcgtacacacgtaaacctggaagcagtcagtttgtgagaggctgggaactgagatgggaaacgaggaacaagcccccttctgtttcgccctcggcccagcactctgatggggtgctgtgtagaactgtctgctcagcttgaatccccagtctgcccctcccaccctttccctcttctccagtgcactgagttacatgggtttagggtataactgtgccggccactcttgccgtctgaggtagatgaagagtctaaggatctacccatgagaaactgatgcctggtgtttcctctctgagcttcctgtagcatgtctgggtcaggtttggtggtacacaattacaattctagcacctggatgcttgagcaggggtgaggcaaacctggcctgtgctgtaagaccttgtctcaaaaaacaagcgagagaaaggtgacgtgcaaatttacttttagacttaattgattttacttataattttaacccaggggttcctgtacctgtacatggctacatggagtgtttactaagcagaacaaatagtgttggcgttcatcctgtagtcctggggccagctgttcattagaccctcaggatgtgatagaattgtacagtaggaataagcactgatgttaagtgttggatggagaaccagacagtctctattgactttagtttccactctgcacacagtcctggaacactagcctgctcacctggtcagtgactgctaactccccttaagttccagcaccttgttaccctgttactcaagaattagtaattgccattggttggtttgtgagatttgaggatatacctggttccattttcttcctccctccctcccctccctccctcccctctctccctccctctctttctttctttctttctttctttttgccagaatgctaaagaatttcttagctaaaaatggtagttgtaatcctagcactcaggaggctgaagcagaaataatcagagtttctagatcaatctgggttgcttagcaagtacagagctaacctaggctagaaggtgagaccccactctcaaggtaaaaaaattagctgtaaaacttagttagtttttgaaaacttacaggacctgcttttttcccccttaagatttatttttatgtggctgagtgttttgtctgcatgtgtgcctggtgcctgcaaaggccagcagagagcattgcgtccttggtactggagttacatatgtttgtgatccctgtgtggatgcctggaactgagccagggtcactgaaggaccagccagtgcccttaaccactaagccaccttttggcctcctgcctttttccccctaagatcactcagacattaactatggaattacacattaaatgtgaataatgtggcatttaattagctttcttgagacaagtgtcattagctggacatgtaaacagtagtagtcttattcagaaaaagaagtgagacttgaagtgggttatgacgacggcatttataaattgctgtggtggtgacaggagccagccttggctacatagtaggttcaaggccagtcggggatacatgagacccttctgcaaacaacacattgtagttgtcttataactagctgagaatccctgagaagttaggagtcgggagaggggtccatgtttggctcctctctcacttgcatctgcctgttctgttgtaggcctgaagtgcagcagctgtgagccctttgcagccggagccaccaacaacctctctaggtgcaattccgatgagagcaatctctctgagaaacagagagcatccactgtcatgtaccacccggagggagagtccagcacggctcccttcttctctatggcgtcgtccctgaacttgccagtcctggaagttggcaggactgaaaacagcagcttctcttcagccactcttcctcgacctggggaccctggggctccccctttgcccccagaccttcggttggaagaggggggaagttgtggaaactcaagtgagatgtttctccccttacggtcacgggctctttcacgccaatgatacatcaccgcctagttgttttactagtgatgcaaaatgctgtgaaggaggccatctttctatacaaaccacggtgacaggtcactcacattcgatgcgtgcctttaaaatcagtgtacacattctctgtaaataggatttgttagggtaaagaagcgctctggggcggcgtggtgtaaatcatggtggtcgtgacttttccataatgtcctttcttttttattatttttaggtgtttgcgtattttgaacttttcataagattaattttatcggaatatttctcaatttgagaaaacaacttgtggattgggaataatgtttttagcacatttatgctacaaattttcagtctgattgtttttcccactgatctggcagtatattttagcagtaagctgttgtgtttcaggaaagctggacacgggaaagctgccgacacactcagcagtgtcccactccttagttctgagaagccgtcgggttctgaggagacacctggtggcactgagcctggtgacctcagtgggccaaaatttgttttatactcaccctgccagcgtgagtgtcttactttcacaggccttgtgtcctcagtcttatcttaaaggatgttatcttggcagggcatcacttgtaattaatggatgatacttgtaattgactaaagtcctcgctctgagccgtttgttctggctccgagagcgctgacatgtgaagcatggtgagcagcgagggaactgacaggatgtggccgtggccagtgtggctttagtgtttgcatcaggcagccaccagctccatccgtgttcttactgctttacaaagtttgactaactttacacattttaaaaatgctgattgtcttcgtttaaattataattttacctatttcttgacatctaactcctattcatttctattatttaaaaattaagaaatgaaaatttgctattaacaataaagtttttttaatgtagtgatgtgtctgagtcagaaattcaaaatgtctgattttcaaatgtctaacgctttttaatatactggttttaaaaagaaaatatttcagagttaaatgtggttgtacatgtgtgtgagtctgcacttaggggttgaagccaaagcccatgagtttgcggccagccgtggttatggagtgagtccaggttggccagtgtctgagttagggtcttactgctgtgaacagacaccacgaccaaggcaactcttataaggacaacatttaattggggctggcttacaggttcagaggttcagcccattatcatcaaggcaggaacatggcagcatccaggcaggcatggggctggaggagctgagagttccacatcttcctctgaaggctgctagcagaatactgacttccaggcagctagggtgagggtcttaaagcccaccacacccacagtgacacacctactccaacaaggccacaccctgggccaagtttatataaaccttcacagccagagtacacagtcatcaagactgtctgtaaaagtggcagggagggaagagggagaacaggggagtatagagcgaggggctggcttgactcggtagcatataatttgttgtaagttagtggacccagtagttaaaaagtgacttttcaggaatatcagattaacacagcataaaaactccacagccgcttttgtattgcctttttctaaagtcctgctttttgtacgttgtgggcttaacagaaaaaccgagcgtaagtaattaagtaccagttccttacggtctcccgtacttctaatattgatgacaacttgttatagcctatgaaccaatgttgttattaaccaaagtccatattgggtcctccattacataacttgaaagttttagaaatgtataatactgcataaccaagtaacttattttcactgccttaaaaatataatctttcaacctccctcctgtctcaaccctagcaactcttctttagacattttctagaatgtctcattgttggggcataaagatggaggcctcctcaggcggtttctggggttcctctacgaagagggtcatccttagcatagtcctgcaaggtccaacaggccaggggagtggctgtcaggaagttaggttggctctttgttttgtttttttagtttttgtttacattttcacttgttttaataaataactctgtgtgtgtgtgtgtgtgtatgtctgtgtctgtgtctgtgtagtacatgtgtgagcatgttagtgtgtgtgcctatgtatggagtccagaggctgctgtctgttgtcttacttggttgctctccatcttactgtttgagacagtgacttgctcagcctagacttcaccatttggctagacgggcggctcctgggattccccctagctctgcgtccccaggccctagggtttcaaatgaaccactacaccaacttttatatgggtgttgggaacccacactcacaggggagtcctgtgtgtgcagtaggcaccttactgagccaccttgtagcccttgatgaaactttttgagtttaattttcttttcaaggtcagaacttttatttaagtcccatcactacagacaaccaaccagtttatcccagcccatgttacctttagttaatctgccctttattaataattaatacaggtccattgtagacagcttacatcttttatagtgggactttctcagatccaccaatagtataaataaggacatgagacttctaatatagcttaaagcttaggccttttcctagggcagtctcccgctagctcatctgacttaacctgacacttgccgacaacctgccacttggctcatgctgtgcccttctccctgtggtcccctttctgtacctactctgcagtctccagtctcctctcttacccttccttattctctctcgagtttagcttttgtaaaaaataaaaaatttttgttactttagtttttaggaacccattgctatttcttgccaaatattctttttgttttctttttaagatttatttattttaagccaggcagtagtgacacacacctttaaacccagcacttgggaggcagaggcaggtggattgctgagttcgaagccagcctggtctacagagtgagttccaggacagccaggactgcacagagaaaccctgtctcgaaaaaaaatatttattttatgtagatgagtataatgtagctgtcttcagacaccagaggagggtatcagatcccattgcagatggttgtgagccaccatgtggttgctgggaattgaactcaggacctctggaagagcagtcagtgctcttaacccctgagccatctctccagctctcaagtttaaatttttaatgctagagattctttaccccatctaagagccttctgccagcccagcatcttgatgctactctaaagtttcctggacatcctggggtttcacttgtccatgtaccttccctatggtttttccccaaactcattatataaacaagcacggccacgggtgtcggagccttgtacattcacccccatttccaccacgcgctgagattacaaatacacaccaccatgcccagtttatatgggtgctggtactggaacccagtaccaggcagcgagctctgcctcctgagctgcactgatttggttcatgtttccggagggtaaccggaagctctgaatgaggactcctctggaccgctcctcgcccatcttcccttggttggacttatgctatatttgctgcagtaaactgtagctatatacacgtggttactcagctttcagcgggttctacaattttgtcacattaccaggctggagggtgcgtgaggggaccctgaatttgctaatgatgtcagatctgaggatgatttgggtaacccaggactttgtactttgggaacaattgtatctctgtcaagtctaggtacttggacggaaggaagtttttctagaaacactcagacctattatctcagaaattacaacccagcgatattccttgatgtactccagggacggtcaccaaaataaatactaggaatataaacctgaacaaggcagtctagcccgttccattaccagacttcgtatttttctgtagaatttagcagataagaatcagaccaaatggcaagttattaatgactatgtcacctctgaccaggcatttttaactgggatctaaatatttacaatggtaccaacttggggtggggggctgtaaaatttcaccattgacctctagtttgtggcaatactccggtctcatcttctcaagtgctggggttagaagtgtgcgcccccaccccctgcttgcttgttcttactgtttggtagacaacgtctcctgcactgtattagctgttaagaaaggacttacatgcacctcgctggccctcaaatttgcctaggattataggtatgcatgtttggtttttctctgctttaaattacaagcccagagtgtgactgtggccactgatttccctccgggtatcctaaggctcccgctgctttttcccagagatccttaagaaaaaacaaataaataacttgcttgagggctgtggaatccccgcctccagcatccttccaatctccgcccatgagtaggagcgcggctccgccgctagggggcgcaaatggataactcgccagcctggggggcgggatcagccgtggcttccggcttccggcttccggccgagagagggtgggaacccgcggccgtcatggcagccgaagagaaggacccgttgagctacttcgcggcttacgggagcagcagctccgactcgtcggatgagaacagcgagccggaagacgcgggtcgcaaggaggcggccccggctccgacgacgggcggccgcgggaagcaggcggagaagcggctgcccggcccggacgagctgttccgcagcgtgacccgcccggccttcctctacaacccgctcaacaagcagatcgactgggagcggcatgtggtgaaagcgccggaggaggtgagatccccggccccgcggccgccccggggcccgacgcccgcttgcccctccgcccgctcgcccacccccggctcgcactcagcccgcgccgcgccgcgcgtccccacggccccgggagcccggggggtgtcagcccgggcccgcccctccgcgctcgggggtcccagccgggcgacgactaacggtggtgactccccgccccccgctgcagcttctccccgagaccccttccctttgacgccgaagtgcctgcgctgctgcctccaagacagcgtctctgctgcagcctcctgaaggggtcagcctggccgtagtatctgggactgcatcctcctttggtaactaaaagttattagctttatttatccagggaaccctttgactttttcacctaacagtgttgtgatgttgatggaaaaaaaaaagtgtcttttaagcctaaaggattttaaaaaagaaagaaagaggaaagtcagccagaatgatgagcagggaggtgcatgcgctcgtatccatcgcgggaacctcggttcgtcacagggtttcttaatgtgcttactcgacagcctccaaaggagttcaagatctggaagtccaactgcgtgccgcccccagagacctacactactgagaagaagccgccgccgccagagctggacatggcgatcaaatggtcgaatatctatgaagacaatggagacgatgccccacagaacgccaagaaagccaggcttctgcctgaaggggaggagacagtggaatcaggtaagagagaggagtgttgttgtttaagatttcagcactcagaaagaagaaaatccttccggacaaggtttacagcctagtgagttggaaggcttgcccagaaatggtctttggatgctaacggtctttcgatcgttcgggttttttgttttgttttggggggagacaaggtctatgtaacctgaatgttctcggaactcattatgtagaccagtctcttgagtgaggccagcccagcctgtctgtgcctcagtatctcagtgctaggactgaaggtgtgtgccagcaacccacgtttccgctccgtttgtaaggattctgcctgaaagtagtctcagaggtctctgggtatgatgccttattagagcggcgggtgtgaactcgctcgcgggtccttgtcctgcatttgtgacccactgaaggcttcgcttctgttgagaccgcagtgcttcagctaatcagggttgcagcgtgaagcagctgcgtaggagcaggcctggagtggtttgatttccttgccttgttggtaatctcgtttctgtcgtgcctagactgctgcagtaatctcttcctgcaaatctctgtctccaactgtagctagtagtgagcttctacagttgatatctgattgtgtaactggcttgcccccgaacctctacaaactgaagagagctggagagttgtgtgacccgttcggtccccctcaccaccgtcattttggggctccatcccagcatttttatcttgaaactcagacctgggtggaccacactgggatgggttcttgctttggtgggtattgccaatagtctggaccgaatgctttaaactcttggctggtaaagccattcatcttacagaaaccaaagtggaaatttttctagtatttcctctcctttacctgggatgtgctagtgctgctaacttagttgtgtgtggctgcttttcacaaggccttctgcaatacagtttgtcaggcagcaagctctgatctggtcctgtgtgtggcctaggttactctagtacattgtgagcactcagaggctggctgttagactgagctcagcgttttagactgtcgttctgaaagccgtttgcttttttgttaaacaaatttctgatcttccaatacaagggccaaccatagagagagatgtttaagagaagggctgctactggcaggagtctacacgcactcttttgatctgtttggcaaggcagcatctgacatagctgaagatgaccttgaacccctgttcccctgcctttacctccctggcactgggattataggtatatactatgtccaggtttgggctggtttttttttttaagatctttaataaagtgtgaattttaatacattattatatggtactttgattaaaagatatttttgaataaagtaatccttatagagtcctacaaaactagaacaggtaaatataaaaatgaaagcttaagacttacccaaggtcacagtaaatacttttaatattcttagcaaactgacacaatagttactcatagttgcttatcagtcttgcagattagaatacagtctgacatgaaggaatttgcctacgtgcacaccattaggaactgacaaattaagacttaagttcaaccttgaaataggatttgtgtcttgttaagctgaggttgcttcctccctgtttcactggttaagaactaaccattcttctccgggaccagagttgacatccgggttgtcgcagtctagtgctcttacatctctgtcccttgaggataaagaccaaggaagcaagaatcctctgtttttaatttttgggttcaattatcagaaattcaaataaatggcaaaagcacccatattaccatagcgagttctatccttttggttgaaaagtgaatgttagcagtggaaaaggacaaaaagaactcgtttttttctggtttaaagccacatggcatgactcaaaagtcacctgagtgaggctgaggatgtagcacagtcttacagggctgtcctcacacgcctgaggacctgggtttgatcccaggatctacctacaaatgctgatgtagtgatgcctgcttatcatcctgatcccagggaggcagaggcaggagaacctttggggcctgaaggccagcctgtctaacaattggtaaatgccagacagaagagaaaccttgtctcaggaagtaagtggggtttcaggggtggcacgcacattaaaaatagataaatattaaattgttaatttggacttgtgtgttggttactgaatataactcttgtaataaatagcccccctccttttttgaaattgggtctgacactatgtagccagatggccgtgaacttccgatcctcttgcccctgcctctcaaactgagatcacacgtctgtacctccctctattctgtgctcctagatgttgaacctagggttttctgtgtgctaggcgaacactcgacctactcagccacatcctcagccagtgcacactcccgtgccatatgaagttgctgaaaatattaatttgcctgacatttcctctttgtacacatgtgaacgtggagaccagaggaccaccctgggtgtcagccttatcttctaccttgtttgactttttctctgccattcatgtatgtatgccatgtcaggctggctttagagctgggaattctgtctctgccttccaccttgccatgtgagctttgagatgacagacatgagttaactgatcaggctttttgcaaaggctgtgagaattcaaattctgatctagagccatctctccaacccctgacattttttaacctatagtttgtaagtaattattaagctacctggcttttattttaccttcccatagtcttcttcctctggtcatttttgctacttatgttcagaatatagaggaggttaaatcaagccttgtccctcgctgcctaacagtgcttcttctttagcaactgtgaagtgttgataagtaaaactcgggtggccatagctttattaaccaatagctgtctgtcctgccctggtgtttaaggcagttcctaactgtgccactagagggtgtgagccctcgtgcttcagtcatgggaactcactttctcaattgtagtatgtggtttcagttttatctgtagacttacctgtagtgtcagaataaaagcagaaatgccccttactaatgtgtgttaatgtgtttcatggaagtcttcaaaaatgctttcaacttttcatactactgtttctgaaaataatttcaaggttaacttgataattaagctctagctaattgttttaatgggtatagtggctttacaccaatatccctaaacttaggaagtggaagcaggggtgtcagacattcatatccagcctaagttacagattttcttcacagaatttgtgctttaaccttagcagttaggttaaccttagcaattttaaatatgaaggcatcttaaaatcaaaatcgtttatatgtcaccatattatacctgttgggctttgggtatcatgttcatcaaaaagtaaacttaagccaacatggaggctcatgtctgtcaacttagtacctagaaggctcgaggcagggagattataaaatcaggcaagtctgcgtgacataggaaggaaggggatgggggataaagtcaaagacagctaagggtgtttagtatagagcggttgtctgaaaggcataggctagggtggatttagtccctgctctgtggaagtagggaagtcagaagttatgtttatgtatatagagttcttctgaggtgggatgcagttgctataaagcccaggctggccccaagctgatagcagttctcctgtctcatcctcctggatttgagacataccaccacccagctttggctgggattctttacagcacacattcattaagggagatgggaattagcagctaatccgctgcagctgcctgtgtttactgaaccacttaaataaagtgcttgggtttttgtttttaataggatgaaaaggtctgctttgtcagaattgacatttttattaatggaaattttctgtgtccgcagacaatgactgtgtggggcagtgggtgctgtttactgtatagttcagtagtcttccttcatccaactttcccttaacttgaaggtggagcctgcttattctgttgccattaggatgttctgacctcctaggaggactggtccagaattagagcagacacctgcgaggttgtctgaacctccacttgtgtggtgggttaataatcataagactggaggtgaaatctgagaggacaagtcacgctggtggttactcggcacggctagaagatgcatgctttgtagaaggagcagtgctctatgctgtgaagtatggactgtatctaaatggatgtactgtttgtgctggagagtttgcggagtgagtgtttcagaaaaagctgattttcaccaaaatatcttatgcgacgacattattaacttgcctctaaaaggtcagtttgcaaatattatattgctacaattaaaccattttatatgtaatttaatatccgtgttctaaaaattagtatttagtttttattagtatgcctttaaacgtccagtgagtaactgtttcggcataaagctgaatgtgtgttttgtgttgatttttagagaactaagaaagctctcttctttccctcttcaagatgatgacaaagatgagcgggcatctaagattcgcagagtggagccaggagaagcagccaagaagaagaagtagagaattgtgactcctgagatgtgtcgttgagtggagtgtttgcttttgtgcgttactatgacagacatctccatgaacgtatttatgttaacgaactaatgagtgtcgcctcaagactttccactgtagaattcactttttttatttaaaacctgtacgtatttacaactctaatggtgacctgtgattgtgaactgacagtacttggaagcattctggttatcacaaaattggtgacaggctttgagagtttgtcacatggacatgccaatgttctatgaaccttttataaaggaatatatttttaaagtaaatatattgtattgtactgtgaacttgtgggtgcttttcattagtatctgtacagtgtaaatagatgatcatggaaataaaattacttaatccaaccttgttat

SEQ ID NO: 1838 - DNA, 1760 bp, Mus musculus
cacagcctgattcccggaggcccgagcccttagtctgggcggggtggcgcgggccggaaggacgccatcccggcctgggccatggaggctcccgcaccgtccctcacggaggaggatttgactgaagtgaagaaggacgctttagagaatttacgtgtttacctgtgtgagaaaatcatagctgagagacattttgatcatctacgtgcaaaaaaaatactaagtagagaagacacagaagaaatttcttgccgaacttcaagtagaaaacgggctgggaagttgttagactacttacaggagaaccccaggggcctggacaccctggtggaatccatccgcagggagaaaacacagagcttcctgattcagaagataacggatgaggtgctaaagcttcggaatataaaactggagcacctcaaaggcctgaagtgcagcagctgtgagccctttgcagccggagccaccaacaacctctctaggtgcaattccgatgagagcaatctctctgagaaacagagagcatccactgtcatgtaccacccggagggagagtccagcacggctcccttcttctctatggcgtcgtccctgaacttgccagtcctggaagttggcaggactgaaaacagcagcttctcttcagccactcttcctcgacctggggaccctggggctccccctttgcccccagaccttcggttggaagaggggggaagttgtggaaactcaagtgagatgtttctccccttacggtcacgggctctttcacgccaatgatacatcaccgcctagttgttttactagtgatgcaaaatgctgtgaaggaggccatctttctatacaaaccacggtgacaggtcactcacattcgatgcgtgcctttaaaatcagtgtacacattctctgtaaataggatttgttagggtaaagaagcgctctggggcggcgtggtgtaaatcatggtggtcgtgacttttccataatgtcctttcttttttattatttttaggtgtttgcgtattttgaacttttcataagattaattttatcggaatatttctcaatttgagaaaacaacttgtggattgggaataatgtttttagcacatttatgctacaaattttcagtctgattgtttttcccactgatctggcagtatattttagcagtaagctgttgtgtttcaggaaagctggacacgggaaagctgccgacacactcagcagtgtcccactccttagttctgagaagccgtcgggttctgaggagacacctggtggcactgagcctggtgacctcagtgggccaaaatttgttttatactcaccctgccagcgtgagtgtcttactttcacaggccttgtgtcctcagtcttatcttaaaggatgttatcttggcagggcatcacttgtaattaatggatgatacttgtaattgactaaagtcctcgctctgagccgtttgttctggctccgagagcgctgacatgtgaagcatggtgagcagcgagggaactgacaggatgtggccgtggccagtgtggctttagtgtttgcatcaggcagccaccagctccatccgtgttcttactgctttacaaagtttgactaactttacacattttaaaaatgctgattgtcttcgtttaaattataattttacctatttcttgacatctaactcctattcatttctattatttaaaaattaagaaatgaaaatttgctattaacaataaagtttttttaatgt

SEQ ID NO: 1839 - protein, 249 aa, Mus musculus
SGRGGAGRKDAIPAWAMEAPAPSLTEEDLTEVKKDALENLRVYLCEKIIAERHFDHLRAKKILSREDTEEISCRTSSRKRAGKLLDYLQENPRGLDTLVESIRREKTQSFLIQKITDEVLKLRNIKLEHLKGLKCSSCEPFAAGATNNLSRCNSDESNLSEKQRASTVMYHPEGESSTAPFFSMASSLNLPVLEVGRTENSSFSSATLPRPGDPGAPPLPPDLRLEEGGSCGNSSEMFLPLRSRALSRQ

SEQ ID NO: 1840 - DNA, 30744 bp, Homo sapiens
  misc_feature (1)...(30744): n = A,T,C or G
taaaattaattttttaaaaatcattttatattttcagtttggggttatccacaaattaataaaaatactttctggataagtggctttcaaacaatgctctataaagcccttggtgctttgaggaaggactcagaagtagtggggcagggtgggtgggcaagacagaaaacttctacagacccggtagacagagccttgagtttagtttccacagagaattttattggaagaaagggttgcacagttagaaaaacatttgaaaacccctgttccagatattcatcccacaagtcattattataaatgttgaatcaaatagaggtgagagcagagcattaagatacatttccctgcatactgatggcaatcactgtgtcttgggtatggcaggaaagccagttgcgaaccaatctcattgttccacatggacccccaaggcttaagaaggaccctgtaaatgtctccctgaagctgtcaagagtgtgcgtttctgagtttcaccattcgttgagatcactgcttttcagccctggatctgcattagaatcaactgggaagttttaaaactaccactgctcctcgagaaattaaatatcgttaccacgcgacccagtcatttcactcctaggtatatacccaagagaaatgaagacccaagttcaaatgtctgaaggccacatccctatataccagctggcgaatactgggggaggaactagatgtcccaatttgcaaatgaatttttataatattattcataacagccatatagccatatgaatagcattattcataatggccaaaaatatgtggaattaatccaaatctctctcaattgatgattgcataaacaaaatgtgacatatttatacaatggaatattattcagccataaaaagaaatgaagtactgatttgtgctacagcatggatgaaccttgaaaacattgttaagtgaaagaagccagacacaaaaggccatatattgttatcattccatttatattaaatgttcagtatggcaaatctatagcaatagaaagtagactaatggttgtctagggataagaaagatgagaggattaggggtggtggctacagatacaactatctttttggagtgatgaaatattctgaaattgattgtggtgatggttgtagaactctgtgaatatacttaaaaccactgaattgtatactttaaattgtatatgtataaacgtatacttaaattgtatggtatgtatattatatctcaataaaactgttatcacaaagataataactaccactgctttggcttccacagaatttttgttaggtaaaatattttattaaagaacaatttaaatatatataaaacaagtgttatggtttgaatgggtatcttcaaaattcaggtgttgccaatatgacagtattaagaggtggggcttttaaaaagtgattatgccatgagggcccctcccttaggaatagaattagtgcttttataaaatggcttcatgtaacgaattcattcctcttgctctttttctaccttccaccatatgaaaacttagcatttctcctctctgaagaatgcagcaataaggcatcatcttggaagcagagcgcagccctcaccagacaccaaatgccggtgctttgatcttggactttcagcctccagaactgcttgaagaaattttctctgaccccacacccttggggctagtctggaatacaggcctttccttcatatttccaagacatagctctgtttgcttctgtgatctttgagagtgaaggcacctcttcttattcatattccattcttggtctttctatatacagtgtccccttagcagcaaatacctcctttaaatggaggaaattctctggcacatacactaaaaccatggcttctccccagtgagagggctgggctttggaaagcaatagagacgatggtggaagtaacagctcagtacttatagctagcaggcacacatcctcctcccttcactttggatttttccaaagaattttttaaattgatctaggtgggacttggatgtccattcccaagtgattctattaaatagcctagactgagaaccactgactccagtcatgggaatgggaagggaaatgattgattttgagggatgtcaccctcaaagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccggcctgggcgacagagcgagactccgtctcaaaaaaaaaaaaaaaaaaaaaaaaaaaagaacactggccttattatcaaggctgaactggaatcccggttctgctacttggtgggagaatgaccttgagcaaatcatgtttctaagcctcggatttctcatctctaaagtgaggataataaagcctacctgtaaggactgttataggcattaaattcccaccacagatgtaaagtgcttggctcagagtgaatgtgaaataaactgctagtgattatttcttcccagggagttgtaagactgggagatctagcccctcctccaatatccccctgctggcatataggtatgcaacctccaaacattcaggactcatagcaggtgcctgcctgcactcttcaaaccagtcctctagggggaagacaaagggaatgatcccttatctctggttccctcatcagccccagcaatgtcctagtcttggggtacactagcaaatattgtcagagcattttctcaggtccacgcccaccaccctacactttcctggtctttccttcctaagccaagagccattcctagagacaggacccccaggagtcttcacaaagtccctgtgctgaaacatctgaatttcaccacatagtatcttgtcattaaaacctaagagtgtctgtctcagaattggccagttttttcttccaaccatttacagagaatgtataatccacaatttataattccacaaccacctggaatagtatttgttgctcaatacacatctgacatctgacaggaagtatggaataaataaccaagaagcagttaaagctccccattaaaatcctcccacccagcttaaatactgggtgaactcctctttcatgttgttttatcgatcagaatggtttcctcttccctacctctgaattcttattatcactatctttattgcatacttactaattgatccaagatcctacagctaataattggcaaatctagaattcagctgtactgacttgaatagcatctccccaaaattcacatctactggaacttggaatgtgaacttatttcaaaatagtgtctttggctggcatggtggcttatgcctgtaatcccagtaatttgggaggctgaggcaggaggatcatttgagcccaggagttggaaaccagcctggtcaacataacaagacactgtctctacaaaagtaaaaaataaaaaaataaaaaaatagctgagcgtggtggcacatgtctgtattctcagctacttgggaggctaaggaggaaaattgcttgagcccaggaatttgaggctgccataagccatgactgtgccattgtactccagcgtgggtgacagagaaagaccctgtctcaaaagaaaaaaaaaatgtgtctttacagatgtaatcaagttaagataaagtcatactgaattagggtgggccctaaatccagtgactggtgtccttaaaaagaaggaaatgtggacacagaaacacaggaggagacacagagaggaaggtcatgtgaagatggaggctggggtgggagtgatgccgccacaagctgaggaatgccaaggattgccagaagtcaccagaaccaagcaagaggcaatgaaagaatcctccctcgcggcttcagagagagcatggcactgccaattttggacttctaccctccagaactgtgagagactaaatatctgttaagctaccttgtttttggtaatttggtatgatggccctaggaaactaatacactgtctgtcagatatcagacatcctcattcttaatgatatctcatctgtaccatgatgttatgcagccttatgattgtagcacctaaaccgtatccctcatggcacatttctcaggtgccttctatttcacagtaggaggcagatggagcacctggaagttgagggggtatggaggctgtgttaagggatgaggaagaagtaggattattgcaaggtagtggatgggtggggctgttttcttgaaactatgcccaaacttcattgttagccagaccctgtgatttagcagaaagaggaaaattagtttactaatgaaagaattatgatgcattagaaagcaagaaggactgggagttgcaaagcctgccacaaacgagctctgtgattaagcacgtggtattcagatgtggctttttaagctaggcaattcatcttgggaacattgacacatggtctgaaaagcaaaatattactctttcagctataaaaaaactcccggaatcctcattcagtcccgcccaatccctgatccttattctgtaactcccaattctaacatagggcagacacttaactttttagttgactaaataaataagggaatgaatactgaggatagaaaagggttggaggtgtcagaaatgaaatgatggtcaaggaaagagaaagactcagatgtatagggcatggaagaatgttcaagaatcaaagatgtctgccactaacatttggtaatcaaaagccatgacaagcaaatgtggcaatatatcagtatctgctcaatcttggtagtgagcgtagggtgtttgtaatattctttatagtttggtgggtttaaaatgtttcctttaaaaagaacaacagtgcagtagcaatctcaaaatggccaaatcaaaatgagtgcattaaattggcagcattcaattcacttgctttgatgggtgaatcctccccttcatcagcagaactgatttgactgtggtaaaaacagttcattcccacacacagatagaccaacacagcccttttggagagcacccatatataagaaaagccataaaatattcatttccttgggctttgtactcctggttctgggaatttatgcaaaggcaatgataatttgaaaggaaaaaggatgaaaatatgtaaattctatgacaattttttaataacaatgaacacttgggaaggatttaaggtgtcagtggggagtgctcaccactgcccccaccctggtcaagccatcctaagctgtgcctggatggctgtgtgtaaggaacatggctgtgctttggtcaaggataggacgaggtaaacatccacagggactcagcgagtttagagcgcaggcatataactccacttgttatcacagctatgtagccataacatgggaaggccatcccttggctctaagccactattgtctgtaaaaggtataattgccctgttgacatcgtgcaggcgtgctgacacccagagagagagagagagagccagagttgaccctcttggagactgacagtggggagccaggacacagctcggcttgctcatgcccagagagaggaagagttaagctgctgaccccgaaggcaagggagagtcggccatgcagctgtgtgggggagccgccagactaagcacctgagacagggcagacagtgtagagagctagtgtaagaaagctgttgatgagagctgctgctgagtaaaatcatcttttacctgcctacggtcccctgagtgttctttctgctcatccacccactccccttggacctcagcatgggctagaacctgaccccaagcatgacatttggctcagtcgtgaacctgacattgtggtagcctccacgtagtctctgcttcttgcccttgcccctgccatctactctccacttagcagccagagtgatcctttcaaaatgaaatcaaactgcttccttgcttcatttcaaaatgctcccaccaccctcactgctccaccctggtctgaaccacaacctcctggggcctggatatagcaatacctccctaaatggttttccctcttccatcttctttccccttagcacagaagtgaaagtgcttcttttcaaatcacaaatcagatcatgtcactctgctcagaaccttccagtggcttcccgtctgactcagcacacccatatgactcaacacacaaggagatcatctccttccagttacactgagcatttttattggttgctgactgtactcataatgctctctccttatatccacacggttcactccctcacttcctttaagcataaatcaaatcccttatcttggtattgacaagacaaggacagactcctccaaagtgagcagggaggtcatgaccaccctagcttaaattttaccaatccatacagcctcatcctacttccctgttttattttttcctcttagcatttatcatcttctaataaattaaataacttagatatagccaggcgtgggggatcatgcctgtaatcccagcactttgggaggttgaggtgggcagatcacctgaggtcaggagttcgaaaccaacctggccaatgtggtgaaaccttgtctctactaaaagtacaaaaattagctgggcgtggtggtgtgtgcctgtagtcccagctactcaggaggctgaagcaggagaatcgctcgaacccgggaggcagaagttgcagtaagctgagatggtgccattgcactccagcctgggaaacagagtgagactccgtctcaaaaaaataaattaattaattatttttttaaaataacttagatatagccgggtgtggtggcatgcgcctgtaatcccagctactggggaggctgaggcaggagaatcacttgaacctgggaggaggaggttgcagtgagcagagatcgtgccactgcactccagcctgcgtgacagagcgagattctgtctccaaataaataaataaataaacttagataaaatttttcaagtgcctacctcgtctgccccaaacacaaataaactagaatataaattccatgaggaaagagatttttattggttttgttcacagctgttttcctagcacctagaacagtgtctggcacatagtggacattcaaaacacatttgttaaatgaaaggattcatcctaaagttaaggatggttaagtaaatcggatggaagatgatgaaaaattaagcaattagaaaaaaactgtccttgtgtaatgtgtcaacatggaaacaggacataatgtaaacatcagaatcccttgctgtgattctggtttttgtggctctggttacattgtttttttgtgtgttttttttttttttttgctttcccgtttcttaaacattggcgttcccaagtttctccttggtcctcctgtcatttttatctactctcgtagcttcaaataccatctagtttatagtttatttagcatgttgtccaagccaccgtcttgggcccagggctctacctgtagcttttcatccacacttctcaggttgcttcttacacagcgccatagtagttaaaatacggtctggggatagtcgtctcttcatcagtctccccctataaaatggaggactcatagtataagttgcctagaacatattagtaaggactcaataaatgtttgagtaggatgagctgggtggctcatgcctgtagtccctgcactttgggaagccgaggcgggtggatggcttgagcccaggagtttgagaccagcctgggcaacatggcgaaactccatctctataaaaaatacaaaaaaactagctggactcccagctgcttggtggctgaggtggaaggatcgcctgagccctggaggtggaagctgcagtgagccgagaatcgcaccactgcactccagcctgggcgacagagtgagatcctgtctcaataaataaataaataatcagttgagtgcatactgtgtgcccaactacctttaagaactttacatatgatcccggcagccctaaaaggtaagcatatctatctccattacacagattaactaatgaggaaaagctatgtttataatgaacagtgaccaaaaagtatgcaaacgttaaatgaggtgttaaagtggtgggattgtaggtggtttctttttttctttcaaaaatttgtttagtattgtagttaggctgtttgtgtgtatgcatgtgtatgtgtgtatgagtgcgtttgtgtgtgaccaaaacagtaactggcaaacgtaacaacaggaaattgtagggcagggtctgggaaaaggggaggaacccaaggtactgacaagcccagaccggactcccccgaagtgagcaggcagcaaaggctgagagtgccagctgcctgggcactgacggaccccacccacggaaacgatgccttatgaggaagctaacccgggccacttaccgacgacctgcgcaggcgtggcttgaggaaacgcccgctgtgggcggagccacccgaaaggctccggtcgggggcgggaacaggatcggcccgcgggctggcgtcgataggctgccgcagagacagggcgggctctgctaagggacgcgcctcgccgtggggcggtgcctgcgcctgagcctctacgagagggaaggaacgctgctccgagctccgcgtcgcgtcgcgtagattcgcgtcgccgtcgacctcagaggcggggccggaagcgctacggtttgacccccgagtccctctgttcccgaaggggcggccgtctttctcccgacccgctccgcctcctctccttcttccccattacccggaggccgaagcccccagccagggcggggcggcgcagcccgagctcccggacccggaagaagcgccatctcccgcctccaccatggagcccaccgcaccgtccctcaccgaggaggacctcactgaagtgaagaaggacgtgagtaacgcagctgtgcccagggcgggcgggggcgggctgcagcccagcgggagaggaaagcggaagcctggagtccgaggacaaggaggatcctccaggtcggaggagcggaaagtcctagcacaggaggactgtggcgagccctgcatccgagggaccttggtggcagtgatcctccagtgatctgtcaatccaggttttacatcgctaaacgcagagcttgggctttgttgccaagtggtgttttgattcttgcccactcctcacccatctcctcatgctttccccccaactgggttcttggagatgcttcgttagggactggcggctcagattcatccttaagtcaggctgcctaggctgctcactcagcctagagcgaaggctgtaccaggtgaaggatcccaagcagtggaccaaaaatgtgaagctcttttgcataagggggcttgaggaagctcaacagctgaaagcacaacctggaattcccctagtaagcagacgcccacatatttaaattggggttgggggagtgaatacacgtagctgagaattaatgtacaggtaaacgtcgaaaatattcagtagctaaattatgctcttctcggatggtgcagaaccacataaaccttcatatttattcgtaacgaatggctttgttgagatatgacattctttttcctttgcgtttacttgttttgtcagatgagacctatatgagtatcactaaaatactttatctgaagtcaaatgaaaaacagaaactcaacatgaaacgtgttcttattgaacactgcagtacttttacaaagtcattttgatgaactggacaggatggcaactttttaaatgttcatccacttcaaatcccttcctcttccctgtaaggtttattacactgtactcacaattggtgtgactcaccagcagaaggaaactggatatgactgggagttgtgcttagtttcctcattcaacagagatttatggagcacttgctatatggaaagcactggccttgggtctggaaggatacaaaaaaatgaagatcagtttcctgctttacattctagttgagataagaatggaacataaataactactgtagaataaatgttgtcttattcatggtgagtgccagtaaaaccttgaacttccaagagctaggcctcctatgttccagatgctgtgtcacacagtttacaatgttcccacttaaccttcgcaacaacctctaaagaagataattgccattcccattttacagctaataaaacaggaactgagaaattacaagtggaaggaaataagatctgtatacaagtacagatgtgaagagtggcttccaggtctttgttcttctctgtcaattcattgatgttatctgtcttcaggatttcattttacgcctatatcagaaataaataaccttgaggaaaccatggatgggtttcaaaaggtctatgaaagaaactatgtgcatgcttttttcttagaggtttttttcatgatattttcaaaatgtcttctgatcttagagagttttaaaattatccacatatttggacttttctctccactctaggtccttatttccaaatgtctactggaaatctacttttatatcctacagattgctcaccttgtcaaatattgaacttttactatccttttcccaaagttgcttactgttgctgctgtattgcctttcttgatgaatggtgtgctaccaccctttgtcttgggacctcccacttctttagtgtctccccctcctcctatctagttatttgcctcattgtgttagttggatttagtacagtttaataaatatggattacatgctactgtgaggctgatactgtggttggttctaacagttcaaaaattaaaaatgaaaacacaatcctaacttgaaaagagctcaatttcttgagggggattgttttaaatcacaaaataagtgcagtgagttttgcattcaactgaaacattaactacttggtgccctagtaagtgcaggatatacagtgttggctaaaacatacctcgtagctgcctgcttcaaacagagacgttagtttaaaacaaataaataaattttgttttcattattgcaattactatgaaggaatcaaacagtgccaagacaataataggggaaatcgacttgagataggatggtcaggagaggttatatttaaactgattcctgaaagatttgacagaactgagggaagagcattctgggcagaatagaatttgtcaaggacctaaaataggcaagaccctggtgacttggggaaatcggaggaaggcagagggtaatctgaagtgaagttaggaaggtgggctagagccattttcatgaagagccttttagtaaagtatctggggtttttttccccccaagtatagtagggacttgttgaagaattgtatagtttaaagatccctctgcctgtttcatggactgaggagaacaagaataagaacagggaagccagtgagcaggctcttggaatctatagagatgaatgaggatggtgatttggatcagggtgaaggcagtggagatgaatggagcagaattccagatgcagtttttgaaatagaaatgatatgacctggtgatggattgaacatgggagttgaggaagaggatgtaattagattagtacatggaaatgtcagatcagcaattacatctgcaaagtcaaagatcagaagagagatctgagctagaaatgtaagtgtggaattgaatgattttacctagaaagctgtgagctagaagagaaaaatggtgtaaaaccctttaaagagaagaattttaaaaagtgaattgttagcttgaaagtagggtaacaacaacaacaagaaaatgattgaaaagttgtatccacagggatgggaagaaaaccaggagagtgtggtattcatgtaacaattttcttgtttcagggagggagtagtcaactgtgtttatgcagctgaaaaatgaaatgaagactgaaaatatttggcaataagggggtcattggtgacttcgagaagaatactggggcaggatggaaatgtctgggaatgaattgggaaatgaggtgaaagaagtggagtcctggtgtatagaaagatgaagtgtatacacaaggtgctacaaggacagaggacggggtgcctaactcattctggggagttaggtaaacctttccaaagaagatgaccactgacctaaatcttaaaggacgaataggggctttagggtctgataaaagcagacaaaaaatacgtaaggaaatgtagagagacagatagttttaggtagagcataaattttcaggacaaaggtagtgatagattaagctggagaggtaggtaggagccatattatcaatgaaccttgtcttccataattagttattattgagtacttactgtgtacagagactatgcgtggccttcatatatagtattcccatttagtcctccttgatgtcctgtgagttaagtttttaatccttattttatcaataacatacctgaagcttggagtggtgaagtaacttggcccagctctcacaagggtgagtactagattcaagatttgcactgaggttgatccaactttagagccatgcccttaacttttctactcttctgccacgtaaaggaactttatcctttaagacagggcagaacattgtttttaattttttttctaaattaacaaaatttcaatattagaatttgctgggcacagtggcccacacctataatcccaacaactcaggaggataaggtgggaggatcacttaaggccaggagttcaagaccagcctaggtaatgtagcaaagatcccttctctacaaaaaaaaaaaaaaaaaattaaaaattagccgggcatggtggctcacacctgtagtcctagctactcaagaggctaagatggggatcacttgagtctagggattccaggctgcagtgagctatgatcaagccactgcactccagcctaggtgacagagtgagatccttaaaaaaaatttagtaaaattcatataatactccagatttccattttctcctgaaggagaaatgttgaggagggggaaggaagtagtaagtgcagctaggtttctattgttaatagtccatgccagatatgataaggaccaggtcctggacatagttatttgctcactctgtgcttttcctgtatttgacctataatcttttttttctgggcccgatcacattgttttataattattacctgtgatatgtattcccagctagaccatgagccctttgcatgtaggattcaaatcttgttcatctttgtatactcagtgctcagcactcggcatattaggaatttagatttgtaaaatacttgtcatgtgaataaacaagtaaatgtggaacttcgtagaccaagaaccacaggaacccttcacctagcctactttcctgccattacctttgtcattattactaacatatattgatcacttactatgtaccaagcgcttttctaagcactttgcatatctttattcctcatataacagtcagctgaggaaacaagcacagaggagttaattacttgcccaagatcatatatctagtaaatagaggagctaaaatacagtcaccggtaccaaattattaatgccatttattgagatcaacatggattttctactaattaagctcttaggcacttctcaaatctaggtttgcttttttgtggtgtcctttttctttatttctttcatttttcgaacactccctattccccacacatctttccatctcccttccaccaagactgattcactgagttagagtgtagtctttccagctgaccccaaagacagatacattatgggctctttcagtttagggttttgttttttgtctttaacagtttaaggaaatggagtaattaataacaaacatgagaaagttacagactgtgagacctctcactaagttattggtcctgactaattctgcattccttgccaactgatagctaaaatgtacagtagtgtttgccctcatctttactcccgaagatggccctcaacagacctccctgtttccaaggacccaggccctctagattcagctggtccctcttcacaacagcctggtcttggtttttaggtttgaaggtgagatcaaagcagtgaggaatgtctaggacctacttgtgtctacttggactttcatcttaattagcatgcattttagaaggcctgagcctcctgactttagaacattgtctcacaccagctaagactgccaactaatagtcacgtatgtgattttcttagatgttaaaaataacattgaaccatattttatgtcttttaggccttagaaaatttacgtgtatacctgtgtgagaaaatcatagctgagagacattttgatcatctacgtgcaaaaaaaatactcagtagagaagacactgaagaaatttcttgtcgaacatcaagtagaaaaagggctggaaaattgttagactacttacaggaaaacccaaaaggtctggacacccttgttgaatctattcggcgagaaaaaacacagaacttcctgatacagaagattacagatgaagtgctgaaacttagaaatataaaactagaacatctgaaaggtaagatatcttaattatctaagagctaatttaaatgtaataatgcttttaaaaaatgcagagcaggccaggtgcctgcactttaggaggccaaggcaggaggattgcttgaggtcaggagttttgagaccagcctgggcaacatagcgagactttgtctctacaaaaaattaaaaaattagccaggcatgatggtgcatacctgtgtttccagctactcaggaggctgaggtgggaggatcacttaagcctgggacattgaggctatagtgagccatgattgtgctactgcactccagtctgggcaacagagcaagaccctgtctcagaaaagcaaaacaaaaacagaaatgatcattttgctttcaaaaagtttaaacttcaaaattatattcaatttgcacttattttaccttatttgacactattacattgaaaaagtggaatatctctcaatatcctgtatttgtattcatttaataccatttatagaaaactattatgaaatccctgcatacataaggatttgtttctaaagtcagtagaatgtaaagttaatctattcaagagtaagctctgaaaatactgtacatcacacataaagaacagtatttaggcaaagtattgtaaaagtccaactctgctagtttttcttatgatcaccagttgatcacaagatgaagtaattggcatatgtttataggaatcacgttgcataaaatattcatgactttaaactagtctggcaagatgtgaaagcatggaaacagattaagagaatagcagattcacctgtcccatttcactctcactccagaatatacactcactgattggaatattgtgtggaattgcctacacaatttaaatccccaaccccctcctgcctctgttcctcactgtctctctccagagcacataaatgtgcatgtgatgttctacagctcttctaggcattagggatacagaaaagaataatttagggctctgcccttaaggaactcatagtctataagtgtccccttgctgggacacattacaagttttcccttttgagccatatctaagaaagtagtttgtatagcatggaatagacatgctgactgtactgtgaggttgaaaaactagtggaagaagtgacatgtaagtgccctttatagactatgcaggttttgcctaaaaattgtcaactcagggtttctgtgcctgtaggttgaatatttgctaagcctaacagaagggtaaattgtgtttgtgtttattctttcaatcctctggataatggttaactataccctttggatatcataaaattctttgatggtatctaagttgttttctgctgtagcaatacctgagactgggtaacttttaaagaaaagaaatgtattcatttcttacagttctggaggctggttaagtccaagaccatggcgccagcatctggcaagggtcatgcatggtggaagggcagaagatggaagagcaagggagggcaagagtgtgaaagagaagaaaaaggagtcgaactcccaaaataactaacccattcccgtgataatggcattagtccagggcagagccctcatgaccctgttgcctcccaaaggcctcagctcctaacactgctgcagtggcaaccaagtttccaacatgtgaacttttggcggatacattcgtaccacagctaatgggaacaaccactgtcatttgagtaaactgtgaggttgagaaacaggacattatctattgaattgtagttctcactttcccacaaagtagtcctggaatgttggacatgacttaactgtcctgtgccttttttttctctttttttttttttttttttgagacggagtcttgctcttgtcacccaggctggagtgcaatggcatgatctcagctcactgcaacctctgcctcccaggttcaagcgattctcctacttcagcctcctgagtagctgcgattgcaggcacctgccaccacgcctggctaatttctgtatttttagtagagatggggtttcgccatgttggccaggctgatctcaaactcctgacctcatgatctgcccacttcggcctcccaaagtgctgggattacaggcgtgagccaccatgccccgcccttttttctcgtctttaataataagagactatcctaggtgacctctaaaattccttttagttctaatatcctattattcaagaattagccattgtcattgatcaacagatagaattttagcatctgccgtttacatttttttattagctaatattttttgtaccagaatactaaagaatatttattgtgaaagctatttcttattttataaaaaattttaggtggttaagtttatatgtacactgtaccttaaatgagaattacagcatgtcgtttaacttccacgagactattttgttatatagaaaatgcaaataatagtatacttcatggttgttgagaaaagcaaattagatttgaaatagattatgacggaaattacaagttgctatttaaattttgattgtggggtaactagcttgtaatctttaacaagtcacaagatggacagtgactccatttttttagttactttttcatttacatctgaataattttattgtaggactaaaatgtagcagttgtgaaccttttccagatggagccacgaacaacctctccagatcaaattcagatgagagtaatttctctgaaaaactgagggcatccactgtcatgtaccatccagaaggagaatccagcacgacgccctttttttctactaattcttctctgaatttgcctgttctagaagtaggcagaactgaaaataccatcttctcttcaactacacttcccagacctggggacccaggggctcctcctttgccaccagatctacagttagaagaagaaggaacttgtgcaaactctagtgagatgtttcttcccttaagatcacgtactgtttcacgacaatgacactttattgccttttaatttttaatgatgacaaaaaatgttttaaagaatatgactttttataaaatggctgtaatcatttgtttacatttgatgcatgtcttttaaaatgcaatgtaagcatactttgtaaataggatttttagaattaaaaaagcatacttctaggatagctaactgtaaatcatgttgatcatgtactttttagtaatttctttttttcctttttaaggtctttcagtacttttttaaatattttctattttaagactgattttaatagggaatatatctctatttgagaatagacccttactaggaagaacgttttttcctcagtgcatttgtgctagaaattttcaagagtctaatagtctttgccagtcattcagcagcaaattttcagcattaagctgttcctgttcagtaataaaaccggtcactgatgggaaaactgccaatatagaaaaataaaaatctcttttccactccattgtcgtataggcatgtaaacagcctctttttgatactggaggaacacttgatggagtgtgagccacctaagatctcggtttgccaaaattcatttctaattaaccttactaattatactactttgttaggattttcacattcttggcttaatcattttcattcctaaagaaaaatatcttggcctaaacctcagttattacatgtaatttgatgaggtattttttccttttttcttttttttttttttttttttttgagacagtcttgctctatcgcccaggctggagtgcagtggcgcattctaggctcactgcaacttctgcctcccatgcttacgtgatcctctcacctcagcctctcaagtaatatagctgagactacaagtgtgtgccaccatgcctcactaatttttgtattatttttgtagagacggtgttttgccatgttggccaggctggtcttgaactcctggactcaagcaacctacccagcgtggcctcccaaagtgctgggattacagacacgagccacctcacctagcctgatgagatttttaaaaaatattttctctgtacttttcattctcttttaatgaggaccaatgtacagttgaaataactggaacaaattatttttggtgtgtgtgacaattctgtttttaatgctatttgaacaagtgggccattagccagatttgtctttttgttgtaaaacaaaatttgactaattttacatgtttataaatcttacgctctcactgtttgtttttatttaaattacaattttatctgtttcctgacattgtctcctatatatttctattattaattgcaaaaacatagaaatggaaattttgctatcaacaataaaatttttttaaagtagtgagtgctattttggagttccaaattttcagtaggaagtatctaaaactttttttaatacgtgccattatctatagaaaacattacttcaggttgtgagattgagttgcatttctggatggactgatgaatttatccgacatgaagaagattggcatattagctttaaaaatttttaaagattggattttttttagtataagcactttctaaggattatagagaaatgtttcacctccaatgcatagcaaaaatagtggtgttagaaagaaaataggttacatttaaggaaggtgctttaaaaagcagaagcagactttaaaattaaatttgtggacacctttttaaaaattgaatcaaagattataatttagatatacaataacacctatatatagataagttttaacactgagttttctttcagactgttttctaactacatagacaataaaattaagctttgcataaagctaggtttgtgggtttttgacttctacaaagtcattttttttccttttagccctgaaaactagccattgccaaaagtgtgtaatttaggatgacttgacaggatgcaatttgttaactaagttcattaatgcagcagtgaaaaagttacttttcagggataccatattatcataatacaaaaacacgttagttcatttttatgtatatgtatatatttttaatactttatttttggagcagttgtaggtttacaaaaaagcagaaaatacagagtgtttccaaatacccccttctccctcagtttcccatactatcttgcactgatgtggcacattggttataattgagtcaatgttttgttttgtttggggttttgttttttgttttttgttttgtttgtttgttttttgagacagagtctcgctctgtcacccaggctggagtgcagtggcgcgatctcagctcactgcaagctccgcctcccaggttcatgccgttctcctgcctcagccttccgagtagctgggactacaggcgcccaccaccgtgcccggctaattttttgtatttttagtggagacggggtttcactgtgttagccaggatggtctcaatctcctgacctagtgatctgcccaccttggcctcccaaagtgctgggattacaggcatgagccaccacacccggccaatcttttttttttttttttttttttttttgagatggagtctggctctgtcacccaggctggagtgcagtggtgcaatgtcggctcactgcaacctccacctcccaggtacaagcgattctcctgcctcagcctccaaagtagctgggattataggcgtgtgcccccacgcctggctaatttttgtattcttagtggagacagggtttcaccatgttggccaggctggtcttgaactccagacctcaggtgatccacctgcctcagcctcccaaagtgctaggattacaggtgtgtgccaccacacccagcctgatgagtgaatcttgatactattattaatccaaagtccgttgttcacgttagggttcactttttgtgttatacagtcctgtgggttttgacaaatgtgtaatgtcatgtatctgccattatgcagaataatttcactgccttcaaaagctcatgtgctctacctattcataccttcctccctctcatctcactcccaaccctggcaaccactgatctttttattgtctctgtagtttcatctttcccagaatgttatacagttggaatcatagtatgtagcttttttcagactggcttctttctcttatcaatatgcatcagaattcttccaggtcttttcatgatgagttcactttgtttacttttaaaaacttgccaagttcactagtgagagggggagaaagagtagagcaaggagttctgtctgtgactgaacaatcaattgagataattcactacttgctggagagcgagagttcacttttgaagaggtgattcgtctttagtcagcatgtcactcattgtgtgcaatgtcaaacactggtaaaataggggcaggccaggataatggcagttttttgtttatttgttttcataaatagttttttattttaaatccaatttatcacattttttctcatggctagtgatttttgtctcttgtttaagaaatttttcccatctcaacatcctgatgatattctatgctttcttctagaagttgttttagttcctcatttagctctatgatccatttcaaagtaatttttgtgtatggtatgaggtagaaatcaagtcttacagctaccatctttttacctaagcaatgtaaaaaggaggtggaagtttcacactctagtcttatattgtatcactggataaatatgtccactgttgactttggagaaaaagcaaaccaagaagcaaactgatctaaagtttttaaatgtaatcttatgagggctttctgaaaggagagctgaacttaaggatagataatatataaaaaaacttgagtgctgctgctaaaatcatgctgaacttgccatactatttaattaccagaaatagttctttattgcaatggttcccaaattttgctgtccattttacaatcaactggggagtgcttaaagatccctatctccaggctgtaccccatacccaataaatcacaatgtttggttgtggaagccaggcatcagatttccaggtgattttcagtggcaacaaaatttggaatccacagccttactagatgccaaataatgagtttagtgtttccgcatgtgtgatcttgtttcttgttttttaatcctaataaccctgcaaggaaggttttattgtcacttttttttttttacagttgagaaacaaaactcaaaataaagtcaatgatttaaaatcacacagctctttaggattaaaatccagggctgtttgattcttaagcctgtgttctcatacaactcatgttttcattgtgggagagagtccaaaaataaagaaaactaagataattctagttaccatggagacaaaataaggcatgagttaaaaagtaacttgaaagatacttgatagtattattgtagaaggcttctcagagcaggtgaggctttgagcagagacctaactcataaaaaaggagccagccatgggaagttctagagggaagagttccaggcagaagtaacattgaggtcagaagccctgaggtgggaatgaattagtgagagaacctggaaacattaacaccttattagcaatgagctcacctagcaccgagaccttggcttctaaatacccattctccattaaaaggaatcaaagttccttggaaatggctaattccaaggcaaagtataagatgagcctgaaacatcttgttccaggaagcagacaagtgatcaaagaatcttgaggaggacatgtccaaaggacacagaagcctgcttgaaggggctcccattggccaaatcagagacaatttcaacatcaaaataaataataatggattataactcatttgataagccatgggtcaatgctaatataaataaatgaacagtctaggcatgatggctcacgcatgtgatcccaacgctttgggaggccaaggtgggcagatcacttgagcccaggagtttgagaccagcttggccaacatggggaaaccctgtctactaaaaatacaaaaattagccaggcacagtggcaggtgccttaatctcagctactcaggaggctgaggcacaagaatcatttgaacctgggaagtggaggttgcagtgagctgagatgactccagctgagtgatggagcgagactctgtctcaagcaaaatgaataaataaacaaataatttgaagcagaatgtgatgttgacatggtctttaaatacctccttacaaaaatacttatttacaaaggaggaaaaaagtaactacagtggagaagcctggcagatacaaccttaaacaagaaatcaaaggtaaaatcatcagtgccacgacaaactgaaatcatgtgccttctgatagaagacaatgagaagactgtaataccactttcataatattcttgccaaagattcataacctgactcaaatcattaggaaacatgagacaagaggaattattggcagcatctttgtagacaatctgctacaaaaatgctaagtttgaggagcttctgagacattgaagtaggaaattgcatgcaggagtttggtgttcaggaagacttgtggaccagttacgtaaatgtgggagttattagcataaactaatatttaaaaccttggaacttggtgagtttgccttgaaatggagggtagacaaaaaagagaggaaggctcagaactgagcctgaggtgcttctgcatctagaggtgatacagagaagacaacagagaaaactgaaaagggccctgtgaaataggaagagaactaaagtgtatgatctagtgaaaggcaagagaaaagcatttcaagaaggcacctatcttgttgaaaggtcaagtaagaagtggtctttggaccaagtctcacagagaccactgatggtttgataacaagaactcatgttgctcaaactgagtacctcaatctccgaggcattcaacagtgagcccattttaaaagtcactcagagtgtcagttttactcagtaataagtaagtctaaatatttttgtctattaaaagagctttattaaacacaaccatgcaaaatttccatacattttcaagatcttatattaagaaaaataaatatgtatgcccatgggactttgggtcacaatgtatcagctcagcttctggaggaactggagactgaggtcactcgtgggcaattaactgtgcctatatggccaagccccaataaaaactctggacaacaaggctcaggtgagtttctctggatggcagtattccatgcatactgtcacgtgtctctgccacgagaagttcatactgttcacaattccactaggagaggacaactggaagctttgaatgtggaactctgcaccatgtgcctcttcccttggctgtttggttttttccccccgcctgtattattttgctgtaataaactgtaaccatgagtataatgacttgcagtgagttctgtgagtccttctagtaaattatcaaaccaacctgagggcagtctgaactttgcaaaacctgaaattggtgtcaggagtgaggatggttttggggactcccaaactttgcactttgagaccatcattttcctctgccaacataggaacctggatgggaaaactcgagaaacacttatctagacccataccatcataaattattataatccaaaaatatttattaaccatctgctctgtgacaagcactgcgctgggtagtaggaatctaaaaatgagcaaagcacagtccagctcctcccctcaaggagctcatagacatcgtaccacagcaaagagggagtgaacaagatagttatataactctgccctggagcctacttccagggaggaatggcaagttatgtgtgagtgtgagtatcatctaaacgagcaggcatccttaagtgaaatctaaatacactgataacaacttcatttgggtgtcattcccatttagttcaccagaaggaatcaaagagttctagtttccctgaatactaggcatatggttacaccatttaccaaaagaaggaacaaaaatgcagagaaaaattatatgaaaagacagattacggttccaataggtgggtgtttgaggccccagaaggataccatatggaaaatgtaagatccaggtggtggtcgggtctagagtttgggtggaaagattgggattagacacccagatttgggaatcatagcataaagtagttaatgcggtggaaagggatgggctgacttgcaactttgtaatgccctttaaaatgttagaagcatcactgaaagatagtacaatatgttgggaaacaccaacatttaagggccatatggagcaaagcaggcggagaagaggctgacaatgagaagccagagagtttggacgacccgagtggtaggctatgatccaagaggagttttgtcaaagctattcagagcgcacttgaatgaggtcaagcaggaaatgatttggttcttggcttgggaagtccaccacccctagaggtcttccatgacaacctagggaaacacactgagagtaatttttatttggaagacgagatgcagtggatcaggaaaaaatcctaccctctctgggcaagggctaaagtggagtgacagcgaaaagacaaaattcttaggtcttctatgcctttggtaaatgctatcgaatgcaggaagtttggctgggatccctggctcagaacttcgtctcttctcagagctcctcagaaatgagcaaaagcagcccccccgcccctgcttgggaacgtgccgggcccgcctccagcctcagcccctccgagggggagcaggagcgtggcgcaaccgccagggggcgcagactgcaggcttatttgtaagagttggggcggggccacgcgaggggcgggccctggggtggcttccggtttccggtttccggcttccggcggagtgctgggttgtcgctcgcagccgtcatggcagcggaggagaaggaccctctgagctattttgcggcatacgggagcagcagctcaggctcctcggacgaggaggataacatcgagccggaggagacgagtcgcagaaccccggatccggcgaagtcggcgggcggctgtaggaacaaggcggagaagcggctcccgggacctgacgagctgtttaggagcgtgactcgcccggcctttctctacaatccgctcaacaaacagatagactgggagaggcacgtcgtcaaggcgcctgaggaggtgaggtccccgaccccgtttctcggtctcggccccggcctgcgccccctttctcctgagccccctgctggggacctgctgtccatccccccacacgcagtcacccccgcgggatgccgcaccaccccctcccacctcaagccctgggaaacctggccccctctccccgcctggtgggtgttagaccggacccgcagccccgccccttgtgaggagacccaaacctccgcgctcggtgccccgaccccgcgcggcgaggactaacagtggtgactcccccgccccccccgctgcagcttctccctgagaccccttccctttgacgccgaagtgcctgcggtgctgcctccaagacagtgtctgctgcagcctcctgaaggggtcagccttggcgtagtatctctgagactggattcttctttggtaactaaaagttattagctttattcatatagggaaccctttggcttttcacttaacagtattgtgattttgatggaaaaatgtgtctttcaaccttaaagaaaaaaaaagtcagcctgaacgataagcgaacggcagggagttgcatgtgcccacgtccatcgtaggaacctcggttcgtcacagtgcttcttaatgtgcttgcttaacagcctccaaaggaattcaaaatatggaagtcaaattatgtaccacctcctgagacctacaccactgagaagaagcctccgcctccagagcttgacatggcaataaaatggtctaacatatatgaggacaatggtgatgatgctccacagaatgctaagaaagctaggcttctaccagaaggggaggagacgttggaatcaggtaaggaaagtcagaatccgatggtggtctattttgatccccgtgatgggcttaaaaagaatgagatatttaatgaatgaaaattaaatctagcgaattgacaaactaatttgatggtctttggatacttactgctctgcttttgagaaagatcatacatatttggctttaacatgaagtctctgatagctcagctagtagtagttgctgtattttagtgaaagatcataaattattcaggctttaaagtaaaatatctgatatctcatccagtggtcagatttatgatgcattattagaacaacacaaatcaattcatggtttcttgtgactgtagctacaaagtactgaaggcttaattttcttttttttcttctttttctttttttttttctttttttttgagacagcatttcgctcttgttgcccaggctggagtgcaatggcgccatctcagctcactgcgaacctccacctcccaggttcaagcgattatcctgcctcagcctccaagtagctgggattacaggcgcctgccaccacgccgggctagttttgttttttttgttttttttgtttttgtagaggtggggtttcaccatgttggtcaggctggtcttgaactcctgacctcaggtgatccacctgcctcggcctcccaaagtgttgggatttacaggcgtgagccaccgctcccggccgaaggcttcattttctattaaagcagttgtgcttcagagctaaaattagtatgacaaaatgaatttaactgagcattactacatagtaataggaagataatgactgagttgttttactttagttcataatagcataatttcgtctcttacttggactgtcacagtaatctttgcctacacattcttatccaatctgtaccatccttcactgcagctagtgttgagtttctaaaagtcgtatctgattatataacttgcctgcttaaaacccttcaacgggataaagtcaaggccttgtattaataggccctttctccctgtccacagtcatttttaatggcccctttctagcacttgaagatcttgaaatccagaactgaattgtatggttccctgcctttcagtatacgttgcaccttattctttagtgttctttcttatctctggctagtaaactaattcatccttcaaaatccaaatcaaaagaagaaatctcaggtatcacctctaataattatttgctcctttgtaccttgtttatgctaatgctgttgattgccctcatcacttgtatgtgatttttttaaaagtctgtctgctttatgatgagttcctcaaacagcaggatttgaagtgtttgtatcgagtacattgtaagtattcagtaattgttgaattgaa

SEQ ID NO: 1841 - DNA, 1877 bp, Homo sapiens
gctttcccgtttcttaaacattggcgttcccaagtttctccttggtcctcctgtcatttttatctactctcgtagcttcaaataccatctagtttatagtttatttagcatgttgtccaagccaccgtcttgggcccagggctctacctgtagcttttcatccacacttctcaggttgcttcttacacagcgccatagtagttaaaatacggtctggggatagtcgtctcttcatcagtctcccccgacgacctgcgcaggcgtggcttgaggaaacgcccgctgtgggcggagccacccgaaaggctccggtcgggggcgggaacaggatcggcccgcgggctggcgtcgataggctgccgcagagacagggcgggctctgctaagggacgcgcctcgccgtggggcggtgcctgcgcctgagcctctacgagagggaaggaacgctgctccgagctccgcgtcgcgtcgcgtagattcgcgtcgccgtcgacctcagaggcggggccggaagcgctacggtttgacccccgagtccctctgttcccgaaggggcggccgtctttctcccgacccgctccgcctcctctccttcttccccattacccggaggccgaagcccccagccagggcggggcggcgcagcccgagctcccggacccggaagaagcgccatctcccgcctccaccatggagcccaccgcaccgtccctcaccgaggaggacctcactgaagtgaagaaggacgccttagaaaatttacgtgtatacctgtgtgagaaaatcatagctgagagacattttgatcatctacgtgcaaaaaaaatactcagtagagaagacactgaagaaatttcttgtcgaacatcaagtagaaaaagggctggaaaattgttagactacttacaggaaaacccaaaaggtctggacacccttgttgaatctattcggcgagaaaaaacacagaacttcctgatacagaagattacagatgaagtgctgaaacttagaaatataaaactagaacatctgaaaggactaaaatgtagcagttgtgaaccttttccagatggagccacgaacaacctctccagatcaaattcagatgagagtaatttctctgaaaaactgagggcatccactgtcatgtaccatccagaaggagaatccagcacgacgccctttttttctactaattcttctctgaatttgcctgttctagaagtaggcagaactgaaaataccatcttctcttcaactacacttcccagacctggggacccaggggctcctcctttgccaccagatctacagttagaagaagaaggaacttgtgcaaactctagtgagatgtttcttcccttaagatcacgtactgtttcacgacaatgacactttattgccttttaatttttaatgatgacaaaaaatgttttaaagaatatgactttttataaaatggctgtaatcatttgtttacatttgatgcatgtcttttaaaatgcaatgtaagcatactttgtaaataggatttttagaattaaaaaagcatacttctaggatagctaactgtaaatcatgttgatcatgtactttttagtaatttctttttttcctttttaaggtctttcagtacttttttaaatattttctattttaagactgattttaatagggaatatatctctatttgagaatagacccttactaggaagaacgttttttcctcagtgcatttgtgctagaaattttcaagagtctaatagtctttgccagtcattcagcagcaaattttcagcattaagctgttcctgttcagtaataaaaccggtcactgatgggaaaactgccaatatagaaaaataaaaatctctttt

SEQ ID NO: 1842 - protein, 233 aa, Homo sapiens
MEPTAPSLTEEDLTEVKKDALENLRVYLCEKIIAERHFDHLRAKKILSREDTEEISCRTSSRKRAGKLLDYLQENPKGLDTLVESIRREKTQNFLIQKITDEVLKLRNIKLEHLKGLKCSSCEPFPDGATNNLSRSNSDESNFSEKLRASTVMYHPEGESSTTPFFSTNSSLNLPVLEVGRTENTIFSSTTLPRPGDPGAPPLPPDLQLEEEGTCANSSEMFLPLRSRTVSRQ

SEQ ID NO: 1843 - DNA, 32021 bp, Mus musculus
  misc_feature (1)...(32021): n = A,T,C or G
tcagagagccacccagtcgtctgttgctgctctctgtgcccaccatccagacctgacgtttcaggtgtgtgagcacatgatcgggagccacttggctgaagtactaactttgcaggaggtggaagtgaacagactttcaaagatgctcagggctctggctgaggtttgggtagaatggaggtctggagggcacacagctgcaagtcctgtggcacccagggctgcctctctgacatgattcccatcaagaaagatgccaatccctcttttctccgacttgtgctctgtgactctgtagaacaccggcgtagtagaaggggtgctgtggcctccagaggctaagtcacaaagtgccagacagctcagctgcttctcttaggtggctcatctgtctggctgcctgtgttctagacacttcttctgaggggaatgccccaccctggggagccacaaaccagacagaggccttgtgggatgtgccaatcaagcttccaggtgcaggcattaggcacatcagtgaagccaccatcctccatgctcaacatcccgccatctgtagcagcccaggcacctagtgcctcccctagcaggacagtgagaagccaggactccagaagtatccggtgcagctgtgtcaggtggctgtgtggtgacttgccccataggataggtagcccgaacacaaagtgtgaccagtgtgtcttctgaaagccacgtttccaagtccctgacccctgtacttcctgaaactactaggtttccagggttagaccatgagcccagttttcttttcaatgttaaaccctatagaaagaaccggacttcatagtaacaccctctgagttgcccctgtcatgaacaaggcctcttgggagccctcctcttccacctgcctgtccctcagttgctttctgacccctccttctactctgtctgcacttctcagcaatgatggagtctcctttggtttgaagatacacccaacacgacctcctgccttacttactattctcctgaaggcctgtcactaaatatggtgttaattcatgttgcttattataagcccccactagaacgtgaattcaagtattggtagggctacttcccaggggtctaaaagagtcaggcaccagagtactaggtggtcagtaaatattcactgcaaaaagaaaagaaaaccacatcacaatatctgttatcttacaacacgatcgtgtgcttagctctaaaaaaccgcttgccaaatgccccgtgaaagatgtaaacaatgaaggcttctcagtgcctttagaaaggagcacacgacttcctggaccttcagcctccctctgcggcttgcctgcctctttcctccgttgatgggagcgtgtgtccctccctctcttcgacagggctcctttgcctaggatgctggagctggctcaggcgcagcactcttagcttcagtattttatgtctaggtccactgatcacactccccaggtccccaggtccccgggtgcctgcctcacctctttcctcagtctggaaagcagaaggatgtgtgccttggtgtctctgctactcctggcttatagctggctgctgtaggtacaggtgggtatggggagtttgaggaatggggtgcaggggttgggggacatatcaggtggttggattctgttgattttgagaactagttctaagagcggtaggatgaatgcatacacccctgagactggagagaacatagaccacagaaacagaaagtagagccaggacaggcctcctggctatatctctgcacaatgcactcagcgtttccaagctgagtgtcttctttatctgcaaaactgtttagccaatgctgggctcgaactcctgttcttcctgtttccttttccctattacaagggtgatgatattttgccagtggtcagatatatatatatatattttaatggcagggtcttgtcttgctgtgtagcccaggatatatcttcacattattaatcctcttgtttcagctggaaagtgccgggattgtgcatgtgccaccataaccagcaaaaacatgctttttaaagggagaggaaagtagactgaaaaaccgcaattcaaatacaagtttgagtgttttaactccgggcaaggaaattagcaagggtgcaattcaggttgttgccagagggtggcagcaggagacaggggcttagcctgaaggtcttttgcaacaaagcggtcctgaaagccgctggagcgagctagaaggaatgtggttgctggagatttgcgctcagctctgccttctctcctgccggggaatcaggcctcttctgagccaagccaaacctagacgcttccctcttcagcgagtttctctcctattttttttttttttttactttattgattctttgtgaatgtcacatcacggacctcagtcccactcatcaacctgtctccacccttgcaacctctctccaaaataaaaataaaatacaacaacaaaatccaaccaaaccaaaaaaaaaaaaaaccgcatctggttgtggaagctgtagtgcgtcacagtgcgtctgcttcacttgcaaatgttcactgtgtgagtcattggtctgcttcaggcctttggcttctgctatcactactggatcctcaccaggactcctcttggatatcctgttgttgccctgtgtcatggggttcctgcagctttggatctgcaggacctgccctttctcacgcttcagcagttcgtagatgaggtagattttgggggtagaccaactcaaagtcctgagtgcaactcaaagtctgggactggtgagcctgccacctctccagcactgccctgaccaggctagctcatgcaaagtcaaggctggtgaggggtggggtcagctctccattgctcatggctgggggtgggggtgagcctcagggaacacacacacacaaacacacacacacacacacacacacacacacacaccagggacagttctattgtgctgcccaggcaaggcacagggtctaccagctctgcatagcccttagacattaacaccggctcaagcaggaacctagaccatggatgtccacaaggccttttgtgataatatgagccaccaaccaccaacatcaacaccgatccctgctgcggcatggccatagacccagacatggccctcagtgcagcactggtccagacttcactatggctgggcaggctacttacatcaggctatcctgcatcaggcatgccatgcagtggacagcgggccatactgtggttaggtcatgcatcaggccagcctctgggtgaagcatccttttcattcttgcccttaacctcgccatattgtttgacaatttctggtgatttgttgttgttactgctattttttaaaattgttttgtttcatttttaatttaatacttttattcgttctttgagaatcccatacaagcatgcagccttccgatgtttgcctttgagacagggtctctctgtgtagcgtgcgactcaactctttgggtgctgggtcatgcgtgtgcatctcaggccgtagcgacctcacctagccattaccataaacttcagagacaaattgagcaggtagaattgtttcctcttttgatcacctcagcgctttaatcatgaggaaacagaggcacagagagactgcttccatgatcagagagacagcaggcaggaaatgtgaatcccatccacggagcctgcggcttctaacttggagccgttctgttcagcagtggctcctgctgttcactgaaggtctgcatggacttccagcattctggtcactgtggtcaccttggctagccggtgccagcatccctttcccttctgtcagaagcctcagcctacttccctctacccacacagcagtagcacccactccgtgagctgcttccaagttagctgttgcgaaacaccctgtgtctctgtgtcatgtatgtcttgggctttcagctcacaaactcacaggctctgctggttttacgttgagcaattctgagatatcaccaggaggaaacaagaagcaaggaaaagttacacgtacccaagtagtctttaaagcttcttggtttacttaaggagctaggctggatcccagggttcccaacggccaggctgaggctccacagctgagccataggtgcttccccgcctaccctcaggataaagagctcagtgtcccccattaccacactcttaaacagcacctcccagcccctgcttctctggggtttccctcttcacagtttcagttacacagttcaaaaacctaacatggaaacttccagaagtaatgaatttatacactgcccataactgttctcatgccttattgccactgttgttcaattttgtcattagtccttattaatctcctatggtacctaattttgtaaacaaaactcaattaccaaaaattaatcatggtatgtgaagggtcagcagttcccagacccagtgggggtctgggggaggtatcacttatataaggggactatgggaggcctctccaccaggaacacagaggcaaggggaaagcaaagttgacagacatcaaagctgtcttagggtctagacgatgtgggacatgtcacctcatctgaccttcacaatgagctggaggaactaaggctcaaggacacccccaccccgtgtctggagtcacacatctagtgtatgatgtggaggggagggtgtgttctccaccacgcatgactgcctattcagctgaagatggacaaatttgtccttcttgcagagtcatttaccctgaaggggcttccaggtttggtgaatctggccttggtacgtgaagtgacctacaggtggcaactgcaggaggaagaagaagcgccattgtttttactcagggaagcaggctaggtggagggcacatctgcaggcaggaggtggtccacagagaatgaacgcctcacctgtcacaggatgtatgttgctggccaagcacacccaaacacattgcctggcgacaacagtccctgtgaatgggatgcagctgtggctactgacagatggggccagccagatgtgacctagctaaacatcatccaaaacctggccacaagcagccaggcggtgtggcttcttgggctgatcattgcagaagccatggtgattgtaagttttcagtaaacaatgtttgggcgcttggctcctggtttgggttttttgcctgagtgagaaagtgtgaccagggcttggctggtgggagggacccgagcctcccttaggaagcttgggaaacagcacccagtgatagccttaggacaggaggaagcaggaagctcccagagtttagagcccagcttccgggaactgaaaaccagataatggcgtcacccaacaaggcagatagaatccagaaactccctggatttagaaccctcaactgagtagccaagcgaagaccagattctctctctctctctttttttaaagatttatttattcattatatttaagtacactgtagctgtcttcagacactccagaagagggagtcagatctcattagagatggttgtgagccaccatgtggttgctgggatttgaactctggacctttggaagagcagtcgggtgctcttacccactgagccatctcaccagccccagattctctcttgagttcctctaaaatcccacagatcaaacaatccggtaggatatgagttgtgaaacattgtctctgtcacaaaggtcagctcaacctgagccttgtctggctcttccttgtctcacagtgaaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaactcagccgagccccccccacccccatccccgggaacgtgttctctctcctcctccgtttcatcttctcgtcctgttaatttacctcccaggagccttagtttgagcaagaaaaaggagtggagagagctcaggagatcagcattggactgtagggcatgttgcacatggagaagccggagggagaacccaccagctgtgtcctggaaacccacacagccaaggtggaggctgcaaccttggagctgtaagaagggacgggccacccttaggatgaagactcgatcgatcaaaagcaatgcgtgtccaaggtaagagtattaaatagcagctacaagcagaatagcagccactgtcccctaacagagactcttctctagggcaccccatgtctttttatgaaataagatgagcttatgtgttttgttttgttttgttttttgtcataaagggtatcaaaatatgcatcccaaattgtgcctctttggaacgcagattattttatgccaaatgctgttgagaactctcagagacaaagaaagaaccacaaataggatgcaaggtttcctttgaaagggatattagcatgtatagaggaagtatctatttgtaaaaggtgtttccttttcctctaggaggaaggctggaagaggaggtcccagagcgctgaactcctgcagaccgaccttagtgtgcaaactctgctcccgctccgccactcaaggacagtacctgccttggtcaccttgggaccagctgtccgcatctgagagctttaacctccctcccctttgctgacactaaggcagatgaagccaaggtctaccccacccaccgagtggcttactgtagtgagaattttggtttcttttaaaccccagttatgttctgtgaatatgtttttgatttattcccaggtgtggggtatgaggctgcttcagtgtgtccacagccatcaactatgattgtcttgggctctaggaggagtgtgatttctgccagctgcagagagtttaattctggggactccggagagggaataaatgctagagccatgacgagaggcataagagggaccctggaggaggaggaggaggaggaagaggaggaggaggaggaggaagaggaaggaggaggaggctgctcctggtgttgtttttgaggtttgtcacgtggctgtgagcagaagtgttgcgcgcgctcaactggccaggaagaacgacgctgctacaggatcatatgacttagctgcagtccctggcgcctttgggactgccgccacacccgctccccacacagaagagacaagaagttggagatgtccttactacaatgaagagtggactaaccccaagaagctcagtgccccgaatcaacaggaattagtctacagaggtctatgcccccttcatcctccatcctttctctcttgcctagtgttgggggggtggggttggattagttggagaccagtgtggaacaagtgttggaagggaggtagaactataagatcctggtaaaataataaaaaacaaactgataaaataataaatcaaacatgccaacggcttgtaactgaattcttccttgcacaggctgaccctctttcaatcttgttctttcattttatgtgtctgagtgttttacctgcatgtctgtgaccgtgtgcagtacctgttcaagtgctgaattgtgttgtcacgtagatgctgggaatcgaacccaggacctctgggagagcagccagagctcttaactgtcgagccattcctccaagtcaccgggccatcgctctctcctctgaactgtaaccgtagctccactctcactttctaaatgaatactgtctctctgtcaagacagtgtctccttattggtgactacctttcaccatccacttcacctttactattaactacccattcacagatttgccatttaactggatctctccctttgtgagtcattcttttaagaaccttgacccattttatagctgtccctttttcctaatttttataaaaaattaattttaagggtattaacttttgtcatggatgttgtcggtaatttgccttttttattacctagcttttcaattttttaatatgtgtgtgtgtgtgtgtgtgtgtgtgtgtgtgtgtatgtatatatatatattacctaggaaagttttacgtcctacagagtcagacctgtccgccctcctcctccatggtccccctttgaagctgactcctccttcagaactgaagtggatgcagaaagggcagtgttagccttgcaaatcaggggaggagagcaaggctcctgagagcatggggattacaggagagtgagaggaagagggggcaagactggcccaaagcagaggctggtgtgtgctttctctccccagggctggcagccaggtggccagtgactagaacttagcagcagagacagctgcatgctgtttctcagaaagggatgtcttaggcatcctttatgcaaacaaggttttcgttttaaaagcaatgtgatccatgttggggtgaatacacatgtacacacatgcacacgcacacgcacacacacatgcatgttaacacacacacagtatttctttgttaaatcaataattttcccccatttttaaaatggttttgttagtgattgattaaaaactatgtatacctttgactgtggatgtagctcagtggttgagtgcctgcctagcatgttcaagtttccatcctcaacaccccaaagggaagacaagaaatgatgctgacatcttagatagtaacagtttgcacacattgcaaatatcttggcttgacttctcacacatttaatagctctttgtacatgcatagattctagatttttatgtggcctctaacgtccatctttactatttctgaattgtgcaatacatataggaagattttccatactcaagaataggaattcttttatgtttcctgttaagtcttatttcacttggatttttccccccttggaattaatattttaactcaactgaaatgcactgttgtggctgttgttaagcatctgaaatggaaaaaccgtgattttgaagaccttttctcactgaattctaaagaatcaaaagactatatgttcactgtatctcttgctcacgtgacctctctgttgtctttttagggacattagtccttgtatccctgttcactatttttttatagtcttaggacaagagagatatcttggtacttaagagctcaggctgctcttccggaagacccaggttttattcccagcacccacgaggcagctcacaaccatctgtaacttaaattccaggagatcgatggactcctctggcctcttcaggcatggcgttcatgggtgttgcagtcacttttcaatggctgtgacaaaccatcatgaccaaggcaacttagagaaggaagaatctactgtgctcttacaggtccatggccagcatggccgggagtatggcagcaggcatgaagcatagcgctggagcagtagctgggggggttttacattcctatccacagcaggagacagacagatagacagagtggggaaggggagagggaagagagagagagagagagagagagagctaacaggaccacaagggctttaaagatttctaagcctaccctcagtgacgcacctccaacaaggccacgcctcccaatccttcccaaatatacatatctgaattctattcctatgaccttttgccggtgagtctacttggtcctgttgaaggcagcacagctgagtggccagctatgtttaagcccttgtttacaaaagggtagctatggcaactgacctcccagttcctcttcttcctctggtggggtgctaaaacccaacaccctaagctgtttttgtaaagattaaaatgtgacacagacacctatttcggttaaggagggcagcaaatgcatgagtcgttttgatagggtctctgtctctctctctctccttccccatctctacctctccctctccccctccccctcccctactgtgaacagcaggcatgaaagacacgtggttcaggttgctgggtgtggcttctgccagcctcaccacagtcctgacagaaagaactcagagtcacccctgggaaaagaactctaaagatgaaatgtaaattcctgggtagcttctttctgctcttcagcctttccggcaaaggtaagcattcgcgtggagctcttccggagaccttggagtggacattagaggcgaagagggagatcctccgtagtcccgagacctcagaaaccatcttacttttttacaggggcggactgcagagacaatgagaccatctggggtgtcttgggtcatggcatcaccctgaacatccccaactttcaaatgactgatgatattgatgaggtgcgatgggtaaggaggggcaccctggtcgcagagtttaaaaggaagaagccaccttttttgatatcagaaacgtatgaggtcttagcaaacggatccctgaagataaagaagccgatgatgagaaacgacagtggcacctataatgtaatggtgtatggcacaaatgggatgactaggctggagaaggacctggacgtgaggattctgggtaagtctccattccctaaaggttttcattttaggacggctgctatgtagaaagttggggagcagcctttctgtagcatccccatccaatgttacctgtgtggcccacaatgaagactccagtgggtgagggtggctctaaagcctgtctgcctttcattctctctttgggtggctgtggggttgtacaaagactcccaggtgacagacaggcattaatcagaaagaagacaggttagcagagaaaagacatggacatccttggtggccgatgaagctgtagctagacaggatgtcagagggtgcctaggagcagtgagcctcttgtctggagagctatgtttaagccagggtatgatgagagggcatgatactgaagagcaacaggagaagaccaaccaggagtcctctcctgtcatccaagcgaagccaagcaggtggtcttagtcttggtgagaaccagcaagtgagctgtaagaagtgactcatgcccaggctcctggcagcatggagtatgtgtgccagtgggatctatagcgttccaagagcttctagtgagaagagttgtcattgatagtcattggcctggagtaaagggtgccagggagatgaggaagggtgcaaacatgccgggtgtgggggtgaggaggaagtgaagaagcttgggtgggtgagaaagaagaaaacgaagcctgggatgctgtcgaagctgaaagtccagggacaaactggcagctcacaccaatgggtgagaggagaaagcctgcccttggcttgcggagaaagctgagaatgccttgtgcagaatagatcagccattcagggagcacacaaacattctgagcttcacacaggaaatgtcactatagaaagggctcccctcatccccccgtgggtgtccttcctgtccaatactcagcacctgggcctaacaccaacctctctccagggccccctgttagctcctctgtgcacaactcttcccagacccaaatcctgtaactttatctagagagaatgtcccagaaacggggtgggaatgagaacgaccactcatcgtatcgaaccctgtatagcctattcatgtactctgtcactgcggtgaccatggctactggagagaagtcaggtgcttgttaggtagcctggttttctttggcaatcctgagaactttaaattacaagcttctatccacctataaggaaacgggcctggccagaagtggccgtgttctcactgttagacaggaacaaggtcaggccttcccttgacaaggatggtgatatcccaaacaagctcattggtatacaattcacataccacacagtttgcccgtttgccgtgcgcagttcaacagctttctgcatagtcacagagttacgcggttaccaccataggcaacattttccctacccccctcaaaggaaacccataccctccgactaacagcggtggcttcactactgtatgcaaatgccaaggtcacacaatacgctgactcaacttgaggacctgtccccactatatacgactatatattacgcagcattggaaaattgtcctctgacccaccccaagcctgattacccagtgcaggttgtgtatcacttacttaatgagtttgagattagaagtgtttaggattggggcttttggaagatttcaaaatgtgtgtgtgtgtgtgtgtgtgtgtgtgtgtgtgtgtgtgtgtgtgtgtgtgtgtgtgttcttggagatgggacctaaatgtaaacacaacattcatccatgcattatatacacacgtcatacacactattcaagactaattttaaatagtattatgtaggaaacaaggtctcacagcatgagaatttccatgtgtggtactgagttgtggcttgacagatttcggaacatatcagatttgtctactaggatgttcatgaggcctatactatccaatgaggtgtgtcatgagttgtgagtgtaacggtgtcctatgtgttcctagattttaccttcccttattgggcagaacagttcagggtccctagactcctgtgggggagagaagcccaagattaaggagtcatatctagccggaaagtactggtccatgcctttaatcttagctcttgagaggcaaaggcattcggatctctgtgagttagggtccagcctggtctacagagctagctccaggacagccagggttacccagagaaactctgtcttgaaaaaccaaagggggtgggggacaaaggcatatctaagatcgaccctctcaagcagtccaggtcactttcagaaagccattttacagggaaaatatctacagaaggatgctggttactgtgtctgcatgagttaagtacaagcgtgcatttgaaagctttagcagcttaagtaggattgccacttaaaaccttgacagagatgtacatgtcctggtgcccatgaaagggggccataatggtacaatttcagagtaaaggattgaaggtgggttatgaagtcacgtgatccaggggctggggacatagtgcagtggtagagcttttgccttaatgcctgagttatggattcaaccctcagcgagcgcagctctctgactcccaggttcataatccagttttaatttgaaaaaatatattatgggtttatgcatagaaaatatccgataaagatatgcctcaaagtgttaatagtcccgaataacagaactgtaggtgatctccaactgcctttaaagccttttaaaatttgatcagtgtttcttgaaataattggatcttactacgaagaaggtttttcactctagaaagacaggcagtttcttgccaggcagccctgagactacctgatgtgctctgctggatggtgatgcatccatcatctccttattctgagatacacagaatctcaggatggaaaggaaactgcatttctgcatgcttgtaggttgggcggaaatggaattagactcgggaggcctatggggaagacactgtggtctgaaagctagagagaagggaaataggaaaaattcactgttgccctgcgtgacgaattcaggtcttcaggtggagtatggggagctgggcactaggtctaatctcactaacgccaagggtggcgatatttccccctgggctgttaagcaggaggggtgtggagtttgcagtgagagtctgagactggtgacttgtccagggcttggtcacaggttgtctggtttgagacaggtagggagccattttctcatttcttaaagttggagtccttcaaggccagaaattaactcagaaccttggggctaggaagggcagcgtcctttctggctcccccccgcccccaacccccacgtgaaaacgcaggagggcagagatgctgtataaacacacgtcaccatgcctattttactcatatcctgtgtctatttaccagaaatggttctgttcaagatactctgtcaattcaatacagttatcaaaagaacttcaatataatgtgtcgtagttggtaggatgcttgcctactatgcaggaaaacctgggtttgatccatagcaccacatgaaacctggcatgctggcacatacctgtgtcctagcccctggaggtggagtgggggaggatcagaattccaaaggccatcctcaactactgagtttgagaccagcctgagctatgttgaaacattgtctcaaaacaaaaacaaaaacaaaccaagccagggctggagaaatggctccatggttaagagcgctggctgctctttcagaggtcctgacttcagtccccagcaaccatatggtggttcacaaccggctaaaaacgtgatctgatgccctcttctggcatgcaggtgtacgtgcagatagagcactcacataaaataaataaatctttataaaagaaaaaccaaaataaaagcaagactaggacttttgaacttccctggtcccaaaccaattcaattttattaggcatatttattaagattaaagaaacaaacaaaagcccggccattgtacatgggaccatggttccataatcccggctctcaggaggtagaggcagaaggaagatgacttctaagccaataggtctacagagtgagatctggtcttaaaaagaaaacagtatccaaaaatgtgcctaacagaaatcagatctttcttttagagagggtctcaaagcccatgatccactgggaatgccccaacacaaccctgacctgtgcggtcttgcaagggacagattttgaactgaagctgtatcaaggggaaacactactcaatagtctcccccagaagaacatgagttaccagtggaccaacctgaacgcaccattcaagtgtgaggcgataaacccggtcagcaaggagtctaagatggaagttgttaactgtccaggtaaggtggagtgaagcagggcgggggtggggtgggggcgcagggtggcccacatgcacaggggtagcttaccagcctacagcgctacagaacctgagctgggaggccagtctggcaaaggatcagaaatgaaaagacaattatttcttcctggaaccttttggggaggcaggctcctggctacccattttggcagtccactctcagatgtgaccacttcaggcaggctaggagcctcttccagaagaaaggattgcagggttgcagaaggctttttgcaggagggactctgactagcccaaggtccctctgctagctggtggtctggattctgacgtctctttaaaggttccctttgggcatctgatatggagcaaggtttcagaatgcctgggaggcagggcaggggagagctgagctggagaacagagaggcacaccgttcctgccaccaaccggagaccagttctgcactgcaacggctccaggcaacccgcaacacccaaggcctgattgatctccagagcctggagctcccagagataatttggctttgttttgctccagtttgctttgctttttggggagagtcttgctaagtagctagcctaggctggctcccaacttgcagccatgctcctgccttagtctcttgctgggattacagatgtacatccctgtgcccagcacccaacagctgtatttgaggagaaggctatcatagtgcccaagttccagcctggaatgtttcagtcaatccggcttgagctggtctgaccctaacagagctccctcccctccgtgggctccatatgctctacagagaaaagcagtcctgacatgggagagtatcggttgggaaggaagccctgggactcagtctgcctcactcgagtgggcctttgagctgccttacaacatggcagctaggttctcaaagcaacctgaaagcaggagtcagtgttccagagtgaagtgacagcccttaattagaacttaatttccgttacttctgtgcatcacttaaagataagagtgaagctcacatgtgcttggagggatcagacagcagtgaaatgtgtgtgtgtgtgtgtgtgtgtgtgtgtgtgtgtggctgaaggcacagatgcagaaggattttattaacacacccccccccccccaggttcatggatggtctccctcttctgccttcctgtccccaccctctattccccaatcacaaaggcacgaggggcagggcaaagctgcctctccaagactccaaaaaaaaaaaaaaaaaaaacaaaaacgttttcctctttctgaaggccctgagttaagagacaccagacttagtcagtgaaccaacaaagagcggtcccatctattgatcctagaaattattcattgtttatttgaaattcaaatttaactggctgtctcgtattttatctggcaacctcatgcttcatgtttagtgtaactagatccctccagaataaaagtaagtatttatcaaggagggtgaggccttggaaggcaagaatgctaggtttgggagcaggggaccgtgcagcttccttaacctgtagttcagagcagaagctgaaactagaccagggaatggccatgaaggagaaaagggggggttgaaaactcctcccattctaaggccaagtcaggcagggataaagtaagtgtgagctgaagtcccacgaggaggaagcagctggccctggagtagtgctcgctcacataaacataggcacagtgtctccaagaggagtgatgggaagaatagttggaatgagacgctgcaaggaccaatgacagagctacagctactgacgtccccaccaggaacaccaccaggcacccagagtgctgccatgggttaacctcagaccatactgtggaaggcgtgcctgctttccaacagtgtctggggaagggctggaggtctgcccgaggaccggtagggaggatctgttggagtcagcttggacaggaagccttgtctgtccaccctgctcacacttgggagccgactctgacattccaggcccttggcaagtcaacagggtctgaaggtccctgaattcatccttgaagcagcttcagaggttactgagggatgcccctactctgaggggaagactagagggacagaagtaacaaccaacatcaacagcttgctttgaccctctgccctgcttggtggacctccagcttgcctggggcccatccctagtcacgagtgttaacagtctttggcctctgtgaagctgggctcagctcccgtttcttctcgccaccgtcctttgagcgcctgctccagctgctctctctaactgctattgattcacaaagaacagatggtttagcccccccctcctgggaaacagctaccagaaaacccccagggtagagagtatagcaagagcaagacctcacctctaggtgttgttttacagtttacaaaagcacttttccatccattatctgatctgacttccgacagctaccctgtgatgtaaggtgcattgtttccattttacaaagaaggaaacagactcagagaagtggggcgtcttaccaaaggtcacacagctcttacctggaagagctaaactaagcctgttgccctgagcaaccacggcactgttttcctgttactcttccctattctggtggaagaagggatcagaactcttatgccactgataactgttgagtgtctaggcggctttcctgaacccaggaggagtttgggaggaagaagagctgaacaccgaggttgggggatgcttcacttgggggaaaggtcccatgagacctcaggcaactcatcctccctctctagaacttggatgctcttttcctcagtgggggatggggtgagatgggcaggcactgctcctcagcccttgcagatttaagtagcactccaggccccagaagctcagcctcaaggaggcagaaaatcctgtggaactctttcatttgtttgatgtaggaggctggggcctgggccatagaaatgaagggaccactctgcccaagacctttcccttagccatattttcttcttgcagagaaaggtctgtccttctatgtcacagtgggggtcggtgcaggaggactcctcttggtgctcttggtggcgctttttattttctgtatctgcaagaggagaaaacggaacaggaggagaaaaggtaagcacacccactcctttatcgctgtaggctgcagtgaaatccccacgggaccgtccctccttgagtctgcgaagaaagggatgggcagggttggaaccagagcttctgggtggctctgttatgtactcagattgatttctgagggacagttctccggggtaacatcaaaggacccttgagaagcggcagccaggttgtataccttcccagaatccaccacgtgaggctgctttggtgaaaggctagtgtggagatccctgaatcgtccacaaactttcataaggagagagagattccacccaaatcccatgtctgtgtacaaatgtcttggccttggatgcctcaaaggtgcgttcagggccaaactcttaggaatatggataaaactatctccagccaggaggcactgggagtggatcagtgcagagtgctcagtgtgtgtaaggctgtgaatttgactcccagagctgcaagaaaataaagcccaaatgagggtgattggtggccctttgtttcccggttagatgtttaggaagtgaggtgttcaggctgggagtacggctaccttgatgcagacttgtcctgcagcctacaaagcagaaattagttatggtggtcctaagcagggagctgaccactcaagggacaatatgttagagactatgttcaggtgtgtaactacggatgctggggtaagggcagtctttagttggttacatgctagtgggtgggcatgtccctggggtcttgagaaatctcagactcacatagggctgggtcccatccctgcaggtctccacctagagtaaccccagtgatgttcaaatactgacttccagcacagcccataggcagggtctgcccataccccacaatgctggcccctgacccagagcccagtaggtttggcttccttcttcacaactcatttctcagtgttgcccccatcctccttcaggccagcatcctcatctgtcatcttacgtaccacttcccccacctggggccgggaacatcattctctctgcacctttcatgtctgggaaacatcattcccaggtctccatccggtacagcttagtggcttgcagagcccttgacactggctcccttatctctgtgctctgctcatactgtctccatccctccttataaggctcatgatcactgcccaggggtcagacacattcctccaaagtgaacctcaggtgtcacccaacacatggcaacctctgccaccaccagactgggaagaggaaaatgacagtaactcacgtgaataaagtggcctgttccagggacaaagtttagttttttcgatgtaaggtagacatttgcacagataaagacgctagctaccaccccagatcatacagcacataggccaaagcatgactaggctgaggcaagacccctagctcttgaatttctaggcagttttatcttgttcttatataactcttctttaaattggacatctatgggcctggatttcctcacctgcatctatagcccaaactgagccatcaagagatggtcttataagaaaggaaaagaactgaaaggctcctggaatgatgtttaggcagtggtagaccttgctggagaggttgtactgggaccctatggttctgctcgtaagaggtgggtggcataggtcatagcaagtatatggcttccccagagcaagattgctgcccaactcagtgtaagggctcagcatctggtcacacctcttaccctctcacttctcacatggttctttgcaccttctggtggtcccccaccttggtggaggctgacaccgtgatgtgctgtttggctcttgtcactcacggaggacagtgttgctgcctgagtcattactgaggtgtagcaatgggcctaacacatagaacacgagagaaagcacaggaggggaaaaaaatgccacaaacagaagagccagcagagagtcatgggagcgtgccactgtgcaagaaggaccacctgctggtctgtgtctaggaccctggattagggtcaaagtctcacctatacccctccaaacacctcaggcacttctggggcaccgaacatggcataaaggacatgttctgtcttttgggtgtctttttatgtatgtgcttagagcacgcaggtccctcaggtgtcaaagccaccttgtttgcctttgaggctttgtgttcgtagtgcatttacagtagttacagtagccagtgtattacctggggtccatatgtcagccccctggtgatgtggagacatgcttttcaagacaaatgttctaaaagggtacaggcaaccattcatttaccccgcagagaagctccccctggctccttgaggaaggctaaggcacagggagtggaataccaagaatgtgccctgaaggagcccagcagtggctccaggcttctgccagctgcctgttcccacagattttctgtgtggcttaaaaacagtgtaagaagatcgacacagtctcaggcttgtcttcctggacagaagccacacaaagaagaaaatccccaagcgtggggaaaggagccatctttcccactgaagcccaagagccgggtcttgcttacgaattttggaagagctagcccatttctcagggctagattgtcccttagagggcactccagtttcctttcagaatgtggcttgtgtgacaatcaaattgagcaaaaggcagacctactgtagagacttcacagaagatgtatagtctctgatgcccttcacgaccactcagacctgggttcagtgggctcgggccctgagggttgttgcttagcaaccttgctgattatctctaggcagcatccagctacaactcccagatgcaatactcactccaacactctagagccttaagtacaaagctctccacccaggtgtcttcttccctcatatttttgagttctaaagaggcctaggtctcagggtatctatggccaacgtttctctctcccctgacacacccagaacttgaagagggtgggagtaacttccctttcctcttcacatctcctgaagccgctggtttgatgcctatcacatgaagcgtgttcagtggccgcatcgtggggctggggaggcagctccatttctaaagtgcttatttttcaagcatgaggactgaagtagactcctcagaacccacataagacgggcaagggtggtacttgcaaccccagagcagtggcaggtgaattccctgggcctagctgggcttcttgataagttgcagggcaaacagagacagagagacagtaagagagagcaagagagagagagagagagagagagagagagagagagagagagagagagagagaattaatctcaaaaagaagaaaaggcgacagtgcctaagaaatggcatcagaggttatcccttggcacacacatacatgcttatctacatatgtactcacacacacatttgcacacccgtgttaaattgttcactattgtcagaatgagttcttaaaacgtcttgccattatagatgaagagctggaaataaaagcttccagaacaagcactgtggaaaggggccccaagccgcactcaaccccagccgcagcagcgcagaattcagtggcgctccaagctcctcctccacctggccatcacctccagacacctggccatcgtcccttgcctccaggccaccgtacccgtgagcaccagcagaagaagagacctcctccatcaggcacacagattcaccagcagaaaggccctcctttacccagaccccgagttcagccaaaacctccctgtgggagtggagatggtgtttcactgccgccccctaattaagaaggcagagttcgtcatttccaataaaaagctgtgtggatttatcttcttcaggtgagcatgcccactcttccgtctagtgtttaatggaagtaggacccaagtgcctcccgagacttgcaggacaaagtggtgtcttttgattcagctacacagtcacttggtctggcctctggaatctgaggcctcttcttagatctgtcgcggcagaaacacagaaaccacaaacatgtgcacataaggatgttggacaagcagcataaaggtttcaccttcctctcaggtcctctacccatgtgagctaccacatgaccgctggctcatgtcctacagagctacctgagcagaggttcgagtcccccaggtgccccaatggacactggccacttcccttgagcaggggtaaaataaaaatttaaccctgcttgttttagaaaggagaccagggtctgagataggaagctgcaaactgggaaagaggctggttggggtgacaatatcaaatctggtccactcgggccactggattgatcttaggagccatcacctgaatgaccagaaccgacacctgtgtatcagctgcaaaggggtcccagcatcttgtgtagacacctttgtacacatactttaacaacaggtgccccatggacactcagtttcttgaccactcaaatgggctcacaatggtctgtagcattattagtgtaaagagggagcctctatagatactggagataccaagaacccatcaggtaacatccagagggcaggctaatacgcctctggctccattcctgagttctgtaggtgacactcatgaacagggcagagcagtctcactagcagtatggcagacccaccctggagaggctgaggttgggggaggtgttcggttaaaattggaaactcatctaccagaggcacctgctttacaacacagggcacacttgtggcccgctctgcccacttcttgtcttcttaggctggtaagcctgggtaagagctggcaggaagctctgagggtaaaccacaaagactgaatatactaaggacttcctgtgagggctcagctatgctttactttcaatctggtaccttttgtttagaccccagtaaatgactaggtcaaagacaaactaagtcctatgccccattcccttttattttcaagacaggggtttttctgtgtagccctggctgtcctagaactagctctgtagaccaggctggcctagaagtcacagagatccacctgactctgcctgtcgagtgctgggatgaaaggtggtcaccaccaccgcctagccatgtcccacacctttcgaaatgttcaaacattagttccagttacacaggatctacccgggcaggagaagagtagacggtctctgacttgaggatttcatctccatctcagtcccaagcgatgggcttggagtccactggccttcctgatgcaatagcttctctgcctccaacccttcagaaagccttctttcttttccatcctctcgccctgcctttcttctactgttctgtaacattttgtatggcacaggacacatctagcatgcgatgtttggtcctttatgacagtccctttattcatttgatagtcattgaactctgctgtgaatctgtgttagaatctagaaggagacactaaaagcaagaggaacaatgacatctgtgtatctaggcagctcaagaggcaaggcaggcagtgggccaacgacaacacaaatggagcctgtattggcaaacacagatcagaggcaagccagggagctcaagaaaaggcaggccgaggactgggtcactaaactggggtggcatgggagcttccgggaggggtgacgtctgagttgagctgtaacaggctagaacagctaaaggtaagagatgctaatagactggaagcaaggatgcagttacccatggcgaggaaagggcagctgctgtagtcctttccaactgtcttgtttcgccaaactgtcttgttttgcaaggtcgcatgaacttttcctgggagatgtaaacatctgcttattccagacaggtcaacagcaacagacaacagcacagctccatggaagtctaacttagtaaactagtgagtttgtcgggtatacttacagagcatgagtgaggggttactcacaggaggagcatgagtaactccaaagaggccacattactgaaaatctcactgtaccatagaagacgatttctccatagctgcatagataagcccccttcaaccaatcttcttttctggagacttgtagcttagcagaactatacacagatgggagggtggtgcagaagggtgtggctgagattccaagagagaccagataactctgaccacccttccttctataagaggaggtcagtcaacagtagtggaaataacctgtattgttttggggtcctctctgaccaacaactttagggaggtagctcattcctgggcctgggcgtttccattagtaacctctgctctttggaatatcttttttcaaccaaacaggattccttttgctcattctttaaccattgctgtaacatcgacaggcataggctgttgggacgttttctcaatcatcttaatgagtatcatctatgcctacctcaaccataaggctcctaagagtgccacagcaatgcctggctcatgtatctttgtgacctggtttcccatccttgttcccttaagcgcacctgttgtctttcagatgatgtttctaaatctgtaaaatacttggaagccgacgtcatagcatctatgtaacgaatcattcttagaaagggtggcaggatctctgaagactaccaccatgggttccgagaagtgtctcagtagacagcagctaaagagagagcaaaggatgggattggtgaggttcatacagcaccaacagatttcgttgtctctctgaaaaggtcgttgctgggcacaggggcttggatggaaggcactaccctacgtcgttcaccaccgtttctatgagcgattaagcgtcttcatcctggtgaacctcatggggatctacaggcatctcctccactgctacagacagctcagagctaatacaaactggctggcttagcccagagtcaagaaggggagactttgtcacatatctaccgggtactccctttccttttagcccctcccacctcctaccacccccccccccatatgaaatggcaaacctccacctccacctcatctcatcctttatccaatttgctctgcaagccagaggttaggggagaatagcacccacacatctctttcatattgcaagtcatcccttacatggccagatcatctggatatatggcccagcctacactgtgtgtcttagctcccatagcaaaggcaatgcaacttctggcagcttccacaggctcctccttcaggttttctcttgtaagggactaaagtgcattcttggggctatcagccattctcaggatgtccctgttctttctaggctggccacattcgtcaaagaggcataccatctgcagtggcttgaaggagaatggcccccataggctcatatttgcaagcttagtccccacttggtgagctgtttggaaggattaggaggtgtggccttgctggagaaggtgtgtcctgggggtgggctttgaagtttcaaaagcctgctacagatctagtctctctatctgtctgtctatccctccctccctctccttccctccctcctcctccttctctcctccttctcctccgtctcctccccctcctcctccttcttcctctctctctctgtctctctgtctctctgtctctctgtctctctgtctctctgtctctgtctctgtctctctctctgctgcctcaggtccaggatgtaaagctcttctccagcatcctgccggcctgtgtgctgccatgtttcacaccatgattataagggagcaagcttcagaaactgtcagcaagctcccagtcaaatgctttcctctataagggttgccttggtcatagtgtctcttcacagcaatggacactaaataatgtaccaccccattaaaaaaaaaaaaaaaggcagcctcaccagccctctgtatccccagggttctccatctccatgctcactgggctgtgattattccatttccaaaggctcgctgatgtgtttgccacctcactgtacacgctcttcccactgtgcatgtggttccctctcctgcaccacttatacctgtggcttgataatgggtgacaactattaacatctagtcattggaaaagggcacctctggttgtaaattaatcagtaagcgttccctaaggtgacacgtagcctgctctgagttggatacacctgagtcagttccctaacactcatcccctgggagagatggatagcagtctctactggaggcattagaggctcaagaatacatctatgaaaccaccccacaagacctagcctgagccacagcctgctgccactgccctggaagcaggatgatcctgatagtacatctggacctcagtcttcaaggcagcctgctgctttagtcacagctccatagagttagggccaagggcagttctgacctttgcatcagccaatctgcttactttggggtatcactacccacccatcctggtcagagttaacacaggggaggtgcttgcagctgatgactagaggtgggctatagaccttcctggattcaagcaaacactcagccaattctagagagatcaaaggaaccagccaagtccaacccagacatatggactgaggaggccatgtccagatgcagagttgtcctcagtcagaggcaggtcaagggcaacagaaggtcggcgtcccagtgaaggctagtaactcatcgcatgcaccagctttcacttcctcctgaagctctgcatcattacactaaactgaacaacacaaaaggcctgagccacaggaaaggaagaatgggaaaaacaatagcaacacattttggggaactagagaaagcagatgacggttggtagctaagagactctaaaagttgagtcgacaccattttagttctcaattgctgtgagaaaacaccagaaccaaggcaacttataaaagtaagcacttaatttgaggttcacaggtccagtgggtgagagtccgtgaccatcatggcggatagcatggcagctggcaaggtactgaagcagtagctgagagcttacatttgatccacaaacaagaggcaaagagagcatgggcattttcaaacctcaaagctacacccagtgacatacctcctgtcacaaggtcaaaccccctaatccttcccaaatagttccaccagctaagatcaagtattcaagtgtattagcctatggtggccattttcactcaaactcctacaaatacgaaggcagcaaggaaaaagacagcataaatgtgctcacagcattaaatcctgactgtcaggaactggagtcaccattaagaaccggaagcacaatgtctctccaggaggatagatgaggttacaatggaagaccggtgcaagatcagttaaaggagcagttagggtcagacacagtacacaccactggaaccccaggaggctgagacaggagaatcataagttcaatgtatgagacccaggtaggaagagagggagagttacacccatttctgtgcccagtaaggatcgattgctgccagtagaagccttatggttcttctccatagatggtaaaacacacggttcctggattagaggacactgggaatagttgacagtagagtatacattaaatatgagaggttagataaccattttctactgaaagtgggggcccaggtggcaaagatcaggtagaattgttcatgataaggcagactattggaaaatgacccactagcatcaaagttttattagctgaagagagaaagcctaacagtatcaacacccaggcttccctgggtgatgttccaacatcaatgctccgtggccctggggtgcattctgaagtcactgagcaccacctcctcacagagagttcaacccctaatgctcccctcttagacaccagcagatggtcatggaccctgatggagatgaagaaaataatgggagaggtaaggttcgaatgcacagaaacatgcaggagagaacaaggtgagacagcccacagctttaatgccctacaaagaatggggaactacttgttcatgaaaaaaaaaaagaacaaaaaactataaaaaaggaatatttagagaacaaagactgtcctagagaattacaaatacaatagtaaaatcagacaagtgtgctcaaaatagaagatagacatttcagaagaaagggcagagcaggtttattgcccatgagataattctagaacgctttcagaatggaagggcataacctccatattaaaaggtctcactagtgttatgatttttggttcctcatgtatgaagctagaagactccattgcattttaacaactaaaacactgaatgaattgaagattcagacaaggaatctctacctcaggaggactcaggcaggaagatcatgagtctctggtcagcccaggttacttagtgagaccctgtctcaataaataaattgaataaaattagaaataaacaaacaaacaaaaacataaacaccaaaataaattttaacaattaaaagaaataatagaaaggaaaatccagccattcttttaagagatgggggtcacataacaaacaggtgcatgtaagttggagatacagagacctgtgctttaccacagtaaacccccaggcacagctccagggatcactgctcaagggaggccctcaaattgtgaacctcacctccatgggtttgatgaccagtatttcagagatgtttgaggggggggggggaaatctaacatcttgcaagaggagagaaaacagtcactctgaaaaatatagaatgctttgtttttcaaatcaacatccaccctgctgggatttgctcataatctaactgatctaaaaataataataaataataataaaggaaacattcacgttcagctcccatggatcattggtccacctataaaggggtaagagaacaagaagcagatgtgggatccacagtccagaggagggagctcattaggagaccaatgactttgggatttctgaagactatgtcctctcctcacacaacctaccattgcctgactaaaagtctcttcattcagttaacccagcatgatatgtgtgacaatcaaggaggtatcaccaaggccagttacactgctcattaagtgtgggaagtggggtgtggcccgcagtccccttgaaatccacttgtttactgcattgcccgagcatgcgcagtgaaaaagcattcgtgggctgtgagctcgtgtctggagcatgtgtgaattctgattggatgaggtggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgttgtaaggggagttgttgtaagaaaagctgcaagaaggagaacaagtaaagaagctgttgcgtgaacccaccttggtgtccatgtcgttcctgtcggtgaggacagcgacaactaagtggggacacttgccatgaaagcttgatgatgtgagttccatcacaagaacccatggaagaaggcaagaaccaatgtatgaaaggcatcctccgaccttcatacacacacacacacacacacacacacacacacacacacacacacacacacgagcattaaaaaaaaagaaaataacactaaaattccaatctatgatggtcagagaggatgctgggagttacttcagttttcttttttctttttatctgttgagacttgctttgtgtcttagtacatggcctgttttggaaatttttccatgagctgttaagaaagtataagtacactgtagctgtctttacatacaacagaagagggcatcagatctcattatggatggttgtgaacccccatgtggatgctggtatttgaactcaggacctttggaagagcagtcagtgctcttactgtatcagatattaacatagctacatttgcttgctttttaagcccatttacttagaacatctcgttcgtccttttgccctgaggtaatctctattcttgatgttgagatgtgtttctcagatgcaacagaaagatggatcttgttttctaatactgtgactatgtgtctttttattggcaaattgagacccttaatttcagagttatcaatgggaagtgtttattggttactgctattttgtcgttttggtgtttgctttctccccttacctgatttactgttctggtattattttgttgttgttatttgtttgagatgttctattgttgttttgtttttgaagacatggtttctctgtgcaattctggcagccctggaactcttgctgtagaccaggctggctttgaactcagacatttgcttgtctctgcttctggagtgctggaattaaatgtgtgtcttcttgagtgcagttaatctgttcagagtgaggttttctttctagtgccttctgtagaactggattggtagataggaattgctttcatttttatttttcttcatcagttgcaactgatagattttctgggcatagtagtctgggctggcatctgtggtctctcagagtttgtagaacatctagctaggctcttctggttttcagagtctccattgaaaagtcaggtattattctagtggacccacctttatatatgatttgatctttttttccccttgtagcttttattttagtatgctttcttgttctgtacatttagtgtctcgattaatatgtggcatgtggacttccttttctggttccatctgtttggtgtcctgtatgcttcatgtttcttggtaggcatctccttttttagattgggtgaacgcatctacaatgttgttaaaagtgttttctgtgcctttgcccagggtttcttctcctttcacactttatgtgttctgtgcacctgggcctttttagactgcccatgttctttgcctgagccttccacctcttctactttgttgtccctgaacttccactggtgagactcacctctgacaatgtttgggtttacttctgttttttacaccctaactttttcatcttcagttttatttctgcttaggttccttcaataatcctaatcctttgctatgttctcctttccagtcttgaattgttctcacctctcatcacttcacttaacagtttgtgctttcatggtcttcattaaggcatttattcagatcctctttgaggcccttaaattttttaaaattgctatctgaagtccttgtcttgtgcttcagctaacttgcatttctcagggcctattgcagtagggttactggctcctgaaggaggcatattgtcttggctgttcacatttgtgtttttacatatagatatagacatttggagttatgatgtttgtgatgtttcttgatatagatacctgatcttgcctttgttgagagggtgttctgttgttgttgcccactttggattcaaggcaagtatggaggccctagggtccttggtagaaagtcattggggtcagtgggacacaaaggaatggagatgggccagaagaaaggctgagaggggaggcaggaaagagctagggagcctggggttctcaggagtataggtagggtgggagctgggactcctacaggcaggttgctacagaactaagaatagtagatcagaagagatcagaatggcagactcaagactagtgaaaaccatctttgtgcttcccagcccaatgtggccactggggggtctttggtagaaagtgtttcagagggttggtggctaacaaaatggccagaagacaaggctgagagggt

SEQ ID NO: 1844 - DNA, 1144 bp, Mus musculus
gcctcaccacagtcctgacagaaagaactcagagtcacccctgggaaaagaactctaaagatgaaatgtaaattcctgggtagcttctttctgctcttcagcctttccggcaaaggggcggactgcagagacaatgagaccatctggggtgtcttgggtcatggcatcaccctgaacatccccaactttcaaatgactgatgatattgatgaggtgcgatgggtaaggaggggcaccctggtcgcagagtttaaaaggaagaagccaccttttttgatatcagaaacgtatgaggtcttagcaaacggatccctgaagataaagaagccgatgatgagaaacgacagtggcacctataatgtaatggtgtatggcacaaatgggatgactaggctggagaaggacctggacgtgaggattctggagagggtctcaaagcccatgatccactgggaatgccccaacacaaccctgacctgtgcggtcttgcaagggacagattttgaactgaagctgtatcaaggggaaacactactcaatagtctcccccagaagaacatgagttaccagtggaccaacctgaacgcaccattcaagtgtgaggcgataaacccggtcagcaaggagtctaagatggaagttgttaactgtccagagaaaggtctgtccttctatgtcacagtgggggtcggtgcaggaggactcctcttggtgctcttggtggcgctttttattttctgtatctgcaagaggagaaaacggaacaggaggagaaaagatgaagagctggaaataaaagcttccagaacaagcactgtggaaaggggccccaagccgcactcaaccccagccgcagcagcgcagaattcagtggcgctccaagctcctcctccacctggccatcacctccagacacctggccatcgtcccttgcctccaggccaccgtacccgtgagcaccagcagaagaagagacctcctccatcaggcacacagattcaccagcagaaaggccctcctttacccagaccccgagttcagccaaaacctccctgtgggagtggagatggtgtttcactgccgccccctaattaagaaggcagagttcgtcatttccaataaaaagctgtgtggatttatcttc

SEQ ID NO: 1845 - protein, 358 aa, Mus musculus
QKELRVTPGKRTLKMKCKFLGSFFLLFSLSGKGADCRDNETIWGVLGHGITLNIPNFQMTDDIDEVRWVRRGTLVAEFKRKKPPFLISETYEVLANGSLKIKKPMMRNDSGTYNVMVYGTNGMTRLEKDLDVRILERVSKPMIHWECPNTTLTCAVLQGTDFELKLYQGETLLNSLPQKNMSYQWTNLNAPFKCEAINPVSKESKMEVVNCPEKGLSFYVTVGVGAGGLLLVLLVALFIFCICKRRKRNRRRKDEELEIKASRTSTVERGPKPHSTPAAAAQNSVALQAPPPPGHHLQTPGHRPLPPGHRTREHQQKKRPPPSGTQIHQQKGPPLPRPRVQPKPPCGSGDGVSLPPPN

SEQ ID NO: 1846 - DNA, 34739 bp, Homo sapiens
ttaaaatattggagggataatgaaaggaccaaacataagaagaagcagaaaatgataaatattgttgatttatttggaccaaatattgttgctttatttggaccaaaaaaacctattctcaaatcttcagttttctcaccaaggtttgggtcaaatgaggattggatttgtcaacttttaatagaatatgtcaatgataaaagtcctgtctcccaagaggaaatagactatgccctgtgctgggggcaggggcctgtcctcttctaccctctaaaagctacaggaaataagccagaaactacctcccctaaagaaattgagacccctaccccaaacagtccattaacacatgggatcctttagaccaccttcctctgctaaacaccaccaactttgcctcctcctcaagcagatgtaaccaccccaaacccttcccctgctcacgttgttccctccccttataatcctgactcttggggccattcccagtctgaatgccctgtcctaggaaagcttcaatgtgaaatagaacaatgtaaaaaggatattcgaaacttccctttcccctcctcctcaaaggagtctgccccaaccctttttcccttaagagaagtaccacttggaggaggggaattggctctgaaaatgcccccttaactagttcagaggtcagaaacctgaagagggaacttaaatcaccattagatgatccttttggggttgtggatcaaattgaccaatttttaggaccacaagtatatacttgggctaatgtccatcttaagtattctcttttttgggtggtggaggggaataaacatgatccacagggctgctatgatagtctgggagcatgcacatcctcccagtcaaaatatccctgcagtagaacaaaaatttccagcccaagacccccaatgggataatgataatgcaacccaccgaaaaaacatggaagaccttagggagatgatagttaaagggatttgggaatcaatgcctcaaaccccaaatatttcactagcatttaatatacagcaggggaaagatgaagggcccatggagtttttaaacagactaaaggaacagatgagaaaatatgcaggcttagacatagaggatccccttgggcaggtgatgttaaagctccattttgtcactaatagttggccaggtatcacaaagaaattacaaaaaaaatagagaactggaaagatcggcctatagaggaacttttgagggaggcccaaaaaaacatatgtaagaacggatgaagaaaagcaaaagcaaaaggcaaaaatcagctctccactctacaacaaagtacccaaggggccaaaacctgtaaacaacttaagcccccactcgctaggcatataaagggtatgaaaaagcaaagcaagggaatttaaaaataaggagagaaagagagcagaacaaatgtttcaaatgtggaagaataggtcacttcgaaatggaatgtcctgaatgggaaaaagaaaaggaagtcatcccacctatggccttcgaggaagaataggggggtcaggggctctgtttcttttatctcgagttccaccaagagccgttgataaatttagaggtgggacccaaacccgagctcattgcctttttaatcgactcaggggcagctcactcctctctttgttatcctccatctggtgtactttgttcacaagaagaactcctgatctcaggagtgaaagaagaaggatttaaagcaaaaatcttagaagaaaaaaaagtcatggaccgtcaccccaggaccaacccccaccagagtaatgttaaagaaaaaagcctaatctgactgtccctttttcctcttctctttcccttagctaccccacatctcattattaatgtaaccaggtcaaagtcaccccaaatcattacttttgatgcttgtcttgttataccttgtggagacttgcaaagtcaaaggcagttctctacttcagaaaagtatctttgccattcttggaaattatcagattgggcagattcaattaactgggcagttcccttagacttgggatattataaagaaaactctgttaactgggaatcttgtactccgaaaacagagtttctctgccgtagcttgtccaaaattctatggactaccaaaaatcatggttggacctccccaacaactctctgtgtgtccaaaaaccatacattcctttcaccaaatgaagcccccaccaactgccagcaaaaccaatgtaatccagtacaaatttccattactatcacaacttcccaaaattcctccccttcattaagtcatttctatggtataggagcagaggtcgcaggggcagactctataggattttttgaaatgcgtttcgtcaccccctcatcccctcctccctctcctaaaccttctaatcaaactaccagtctctccctacccaatagcaacaccaaagtagccattgtagaagttaaagatttaaaacaaatcctagctattgaaacggagtaccaagatgcaaatgcctggctagaattgattagatattccattcacacactaaacaaaagcgattgttacacttgtgcaacgggaaggccagggacccaaattatcccctttccacttggatgatcctccaaccaacagggtatgagctgtatggtagctctcttccaaaaccccacagcctggggcaataaagcatgccgaatttagcgggatgcagtaagcctaagccttttcaggagctaaccaatcactctgcccttgttcatcccagagcagatgtatggtagtactgcagtggaccactactaggtactctgccaagtgactggatcggcacttgcaccctaattcaattggccatcccttttatcctgacatttcatcaacaaagcaaaaaagacaattgcaaaaaagaagtaccatccccccacgggtcctttgactctcacatttatatagatgccatcagagttccacaagagtgccaaatgaatttaaaacttgaaatcaaatagctgcaggatttgaatctatattgttctcatgggtaaatgtaaacaaaaatgtagactggataaattacatttactataatcaacagcagtttgtcaattatgctagggataccattaaaggaatagctgaacaattaggccctaccacccaaatggtccgggaaaatagaatagccctggacatgatattgactgagaaaggtggggtctgtgtcatgattggggtccaatgctatacttttatccctaacaacacagcccctgatggaacaattacaaaagccttacagggccttaccaccctaacaaatgaattagctaaattctggaatagatgaccccttctctggtctcatgggaaaatggtttggaaaatggaagagactcataacctcaatctttacccctcttgcaattgttataggtgtactcactcttgtaggttgctgcatcataccttgtatttgttgattagtgcaaaggcttatagaaaaagccctcatgaaaacccctcgattctcccccaccctactcagataagttcctactcctaaatgactaagaggagcaacaaagtcaggatatgttaaggaaatgtgaagagggagaactataaagtcaagagggggaaatttgccaaaaataataagttcctcttctaagcttccttggtctttcttaatctgtaatgagcacttcgtactctgcttaatctgtaacgagcacttgtttctctgcttaatctgtaactggcaaacctcttactctttaaacaactcttttcacctagttggtaatggacagcctctcccttcctgcctaattggccttattcaatttcaaacactagccaattgagtcagcttagactgtgcggtctgactccagccagtggggaaaggacacagaaacaggaactgcattagggataaaaacccctgtgctaccccgcttagtgtgctcgtacaatcagagggacacaggcagcacccatctgcagaagtaaatgtgccttgctgagaaattttctgtctaagtgctggtttttccttgtggcactgagcacttatttctaacagtcctgacttgacctgagccttgttaaggctctcctttgacaaagggaaagggaggtagaagtcaagaccatcaatattttactaatcagggaataagaggtcaacctaaagtaagacctccaagaatattttcttccttctctgcttcttattctcttccctgtagcctacttccccaggagtgtgagtttaggtaagaaaaagaatcaatgaagacagagcaagagctaacctgtacagtgcagcaagagtggcaagggaggagctggaatgagcaaccgagtagatggtcccctgaaatgcaaacactcagaggcagggactgcacctgcctcagcactcagaacatttaccgaagtgacaggtccacttagaattaaacataattcaattgaaggacaatacgtgttcaatttagatatattagaatagcaacagcaagcaaggagggcagaatagtagctattatcccaccacacagggaccaacaccctggggacattctgcaagagatgcacccaacacacgctttttgagaaataaaatgggactatattgttgactgtgaagggtaccagaagatgctgatgtaggacaggtaagccccattggggcttagcctggagtattcttggcttcactcaggaaagaatcaagggcgagctggtggtgtttgacagcaacttttattgaagcagcagcagaggtactgctccttgcagagcaagtatacaccacaggcagtgtgcccagagtatcagcttaaaggcagttctgcagtcctatttatacccattttaattatatgcaaattaaagggcagattatgcagaaatttctaggaaaagggtggtaacttctgggtcgccaggtcattgccatggaaaaaggtggtagaagttggttattgccatggcaacagtaaactgacatggcacactggtgagcatgttttatggaaagctgcttccacctatctctgttttagctagtcctcaatttggtccagtgtccaagccccacctccagagtcaagttccacctcctacttcagtgccaccctaaaacatgcctttttaacatatggtttttttttgagcaaaaggccatcatgaaccagcagaggcagtaaaagctttaaaaacatggcacaatatttttcttttgtaaagaaaatttacaatttctgaagaaaatagccgtttgtaaaaggtatctccctctcctgtatcaggaagaggaggactcttaacaactcttatcaatggagaaggcattggcttcaatctgcataacaaaccttactaaacacatcttgttgtttggcacacttttcctggtcattgggtaacttgcctccccaacctagaagccccaaatcgctttttctttgtttagtctaatatactctataagtccaagttctaacatccctttgggttactcaccactgggtgctcccatgtttatgagggatacacatcttaatcaacttcaatgtgcctttcccttcttaacctgtcttttcccagtctggtttacagggctccagccagagaacctaagacaagaagaggaaaaagattacttttcacctctcctacaattgggacctgtttttgtcatattccacagcttgtctatatcatgatttacttaaccaatttccttctcttagacatttaaattgtttccaattttgtctttaaaatactgcagcatataaatttatagccaagtctagtacatagccttcattatttccttatgataaaatcatccttgtggatttgttagaaatccacaaatgtttgatactctaattcacactgacaaattgcccaccagaaactatacctacttgcaattctcctggccatatacaagaatgcccatttacaccatcatcaacactatgttttcatttttcaaatgaagatgaaaaatgcatctatgttaaaactgacatttctttattaataaatagaaataaaatttttcttttgtggattgctccttttatgactttgacccattttagttttaaggtgtctatcttttctatgtttacaagaaaaatttaatactaaaaatttaatgttggccaggcacggtggcccacacctgtcatcccaacactttgggaggccaaggtgggaggatcacttgagcccaggagttcaagatgagcctgggcaacatagtgagaccccccgtctctacaaaaaataaaaaaattagccaggcatggtgccacatgtctgtagtcccagctactcaggaggctgaagcaggaggatcacttgagctcaggaggtcaaggctgcagtatgctgtggtgctgtggtcataccactgcactccatcttgagcaacagagcaagaccctgtctctaaaattaaaaaaaaattgttatgcctttgtcatgtatcttgcaagtaatttgctccttttagtacgttgtctttaatttttttatggctttttacatagaaagttttcacattttacagagtcaaatctactgacctctttctttttcatggtttctgcccttgaagccatgctcatcactcagaattgaattagttttagaggagcaaaattaatgtttcaaatagaggaacagaaagctgctcttcacatgctccatgaggaaagtgtgaggaagagaggacaagcgccctccaaagctgagatgggtcagaggatggctggcgccaccttctctccaccaggccttgacacactggagttggatggcagctggtgggtcagccactcacaaacaggaagctccatgctgctcctctgggttggcgatacttttgaaaaaatacgtgtgccctaagcatcctttcttaaaaagacattttttattaacaaaaaaggtgcttatttccaaaattttaaacttcacagaaataaataaaatgtgaaagaaacataaaatcctgggaccccaattcattatgccaaaaggaaaaattaagctgaaagttgagtcacacaagaaactgcctttccttgagttcctaagcagagagttacagataaaaagctgctgtctccacgggtagctactctatgttcaccttatcttaagaaagtgccaatttactgagcatgagaagaatacaaattgaccattcccctacctactttttttctcttgcaacatatggattcagtaatgtgactgtaccctccctccttcccctctggccagcttttccccttaactgaaggttttgaaataatcttgagaaaaaggcacaaaccacagatttttcctgtggttctgtgttcctttttgtccctaatgttgatgaaataaacttctaaattgattgagatctgtctcaaattctttttggtttacaaaggtaagaagtgaaaatttcatttcagttctctcacaatctaatacctgaaagacaagcactgtaaaaaaattcagcatcaaccctttcaggcttttttccaacacataccttaataacaacatagtatgctatggtatactggtatacccatagcatagtataaacatagtatcatatataaaaaggactaatcctatagatattgttttgcaatgtgctcttttcatgtgatttaccaaaagcatctttccatgtcttacttttaggcctatgttatactattttgatggttatacaatatttcataatatggatataccataattttagttgtttgcaattttttattacaaaaatgctacaacaaacgtccttgaacagaattttaaaacatctgtgcaatcatttctgtgggatagatttctcaaattaaaatcactaggtgagaaaaagacataaattttaaagtttggtggaaatgataaattcctttccccagaaggtattgatttacattccctctgatgttgtatgagggttcatttctccacacactcatgttaataatgtaaattatcatcttttctaattttaccaatctgatggtgaaaaatggtattttatagctaagatatatacatatatttttggtcacattagactcctcttgtaggtttgatatttcttctgcgaaatatttcttctgcaagctgatcatttatatcatttgcccattttaaaaactactttgtattgattggtaagaattattggtaagaatattttgaatattaataattttatatatattgcaaatattttgtcacgccttttcattttgttccttatttcttcatctgcatgtaaatcttacttctttatatcatcagttgtgttcatcttttctttcttactttggattatatgttatatgtagccaggccttccatactcaaactataggaatatctttctatattgtccttttagcattattgttattattttatttatttagttatttattttgagacagagtctcactctgctccccaggctggagtgcagtggcacaatcctggctcactgcaacctccgcttcccagattcaagcaatttgcctgcctcagcctcctgagtagctgggattacaggcgcacatcaccacacctggctaatttttgtatttttagtagagatgggtttcaccatgttggccaggctggtcttgaactcctgacctcaggtgaggaggtccgcctcgacctcccagagtgctgggattatagctgtgatccaccacccccggcctccttttagcattattatagtatttttgcatttaaaactttaatccaactgtagttcattattgtggatgacgctcatacaaccatgaggtaaatatttggctttcttttacccagtaacagcaaacaactgctttgacttaatttcatttccttggcaactttctgacagataatatccatatttgtacttaaagttgaaaaagaaaacgagcaccacttttgcaatttttactcactgtgacctaaagaattataaccctgaaaatgtgctttggaagtctgtcatggttatttctctttttaggcatcttttcagggcacacccgtctctgcatcactgtctgtttccttgtgtcacaaatttctgttctttttttctctccctgttccctctcatttattttttctcctaatctctcctttttcttaaccacctataatgttaatcactttaaatgcttttgactcctttgttttggtagtttaattatatttcatagtctctatgcttctttgttttggaataagtttttatttatctaactgtgaatttcactagagttgtaaaatgtatgccgaacataggatttggggattgcaagcatttacagctgatattcaatttctttcttttcaccacaaaaacgattttagaacatgaaaaatatctttggagaaacaaaaaaatcaatttcctcatcattttatgggtctacatttttcaatataatcatatgggataaatgtttgcattctgctattggcttgtgaacatttacctatatttctatgtggtcttgttagggacagtatacctaagtggataaaaggctgtgtggttgaatttggcttcttgtttacaaaagagtgatccttagtgatctacttagcctctctgttccttttctctttcactgagatgagaaaacctatccttcccaatttttttgtgtgagaattaaaatgcagcaagaaaacacacactcataaacacatctgctttggcaaaggagcacatcagaagggctggcttgtgcgcgctcttgctctctgtgtatgtgtattatgttttatgttactgtaaaagatgtaaagagaggcacgtggttaagctctcggggtgtggactccaccagtctcacttcagttccttttgcatgaagagctcagaatcaaaagaggaaaccaacccctaagatgagctttccatgtaaatttgtagccagcttccttctgattttcaatgtttcttccaaaggtaagcataagagtcaaagaagtcccaacccagctttccctgaaagtgactctcagtaactcttttgctttttataggtgcagtctccaaagagattacgaatgccttggaaacctggggtgccttgggtcaggacatcaacttggacattcctagttttcaaatgagtgatgatattgacgatataaaatgggaaaaaacttcagacaagaaaaagattgcacaattcagaaaagagaaagagactttcaaggaaaaagatacatataagctatttaaaaatggaactctgaaaattaagcatctgaagaccgatgatcaggatatctacaaggtatcaatatatgatacaaaaggaaaaaatgtgttggaaaaaatatttgatttgaagattcaaggtaagtgttcattcccttaattgctttatttcagtgtgggtgctatttggcaagttggaaaatagcatttctaatattccccagcgctgacctctgcctccaggggggctatacaggaaaccagatgcatgtctcctgccccagtggagactgtggtccaatgcgggaatgggatccacacatctgatagaccctcaagtctacctgcctgcaactctgtcttcaggtggttacaggaatgtggggttgggtgaagaacctggattaaggtggcattaatcgggagggggacacaggtaggccgagggaaaaggcaactgttccaggttgctgatgaatcggcgagctaagagtggggcgagaagaagaggctgactggagagcagcgggcctttcatcgacagagcccatttcaagccaggctgccctgaaggaggagttatatggcagaaaagggctggaaacaacatatttaaggatgaacagcccttattttggatctgcttgtcagagtgatacaaggtggcaggtgatttttgctgatatgtgtagaagatgcacaaggtgtggctttgtatatctctgcctgtactgggaggacaggagtggatattgaggatggggttagggagactagttagaaagctgctgctgtaatccaagtggagtgaggaccaattaaatcagattttttttgcatgcggcctgggtatcattaggttctaaagctccctgggggattctaatgagctgccaaagtcaatcgccactggcctagaccaaagggtgcctctaaaataggaagaatgaggataataagggtcaggcatagagaaaggtggcttaggcaagggagagaaggtagagaaagtggaatcgaaatgccattgaagttgaaagcccggggggatgctggggaagtagtgacaagaagggaaaagaagaagctgcgcttgacttggggaggcagacaggaaccccagcatgagcacaggccagccattcagtgagcaaataagcatttctgtgcttcacacagaaaatatcaccagaagcagggaccccaccttcttcctctctgtctccagccccatcttcagcacctgggcctaccagcaatcccagatagtgtcagattgcccactccagcaatcccagacactgtcagctcccctgaagtgacaactttccacaccctagtcctgcaaccttgagtggagagcaccttgtagaaatgtagtggggttgagcatggcgctgaaaagggcctctgattatgggctctggaaaccacagatctcaggactccaaacagcacaaaactcgagtgtcctgttttgagtgtgagccctacgcgggggaccatgctggtgttttcacatttgggtcgcatttagcattgcggcggaaataatggctaccagttaggggtcaagtgcttgcttacatgatcttatttaaagcgcccaacaatactgagacctagttgttattatctccttgttatatataagaaaacagagacctagtcagaagcagcttgtccaaggtctcattgcttgacaggagcaaagtcaggattcaaactcagaggtctttttggcaagaatgacgaccttttctttttttttccaagcagcttcattgagataattcatctaccattcaatttgtccatatactaaaatggccttcagtatattcagagttttgtaaccatcaccacaatcaacattttcattgccccaaaaagaaacccttcaccctttagccgaaagacagtgacttgctttatgtgtgtgcacgtcaatgtcatacaacatcttgattcaacttgtagttggtcactattaccagacttaaggtgaccatggccttgggcaaattccctatctgctgtgagtctgcttttccaatgacaacttcaagggatattcagtgagacaaggtgtgtacaagtgtcctgcagtgcctggggcacaatgcctgttttctcagtgctaatgccctcccacatctctttgtttctccaagcttctctttttttttttttttttttaattgagatggcatcttgctctgttgcccaggctggagtgcactggcatgatctcagctcactgcagcctctgcctcccaggttcaagcgattctcctgcctcagcctcccaagtagctgggattacaggcatgtaccaccacgtccggctaatttttgtatttttagtagagacggggtttcgccatgttggtcaggctggtctcaaactcctgacctcaggggatccgcctgcatcggcctcccaaagtgctgggattacaggtgtgaaccacgcacccggcctccaaacttctcaaactccagtagttgtgcctgcatttccttcatgagggagttgctgctgcaggctgaagaggcaatggagggccccttagaagcagatgctagtagggaaggggttaatcccagcaactcagaattaaggagttctcatccatggaaggccttaggttggatcagttctaagacgctatcttagtgaatgtatacggaggtactactccacaagggtgcccatcactgcattattcatgttagcgaaatactagaacagtcagcagttagaaacttattaatcagttaaattaagaatgcatcctttaaaaagatgcatatatgcatttattgatgttcattaagaaaagaacttcataatataatttcacaataaaggggaaaaggcagactgtaagatcacataaattagttttaatttttaaaatattacatatatatatatagagagagagagagagagagagaggcagacagaaagagacagggtctcactctgtcgtccagcctggagtgcagtggtgaaatattggctcactgcagcctctgcctcttgggttcaagcaattctcatgcctcagcctcctgagtagtttggattagaggcgcatgccaacacacctggctaatcttcatatttttagtagagatgtatttcaccatgttggccaggctactcttgaactcctggcctcaagagatccgcccaccttagcctcccaaagtgctggattacaggcatgagccacctctcccagctgaaatattatattatttatatatatacatataaatagaaaatatctgctaaagatatacatgaaaatattattcattattgactttgagtggtggcgttgtgggtaatttttaatctgctttaaacttttaaaaatattttatcagcttgtacaatgattggagttgaaagcccacggatgctgggcagggagtgataagaagggaaaagaggaagctggcttggggaggaagacaggaaccccagcatgagcacaggccagccattcagtgagcaaataagcatttctgtgcttcacacagaaaatgtcgccagaagcagggaccccaccttcttcctctctgtctccagccccatcttcagcacctgggcctaccagcaatcccagatagtgtcagattgcccactccagcaatcccagacactgtcagctcccctgaagtgacaactttccacaccctagtcctgcaaccttgagtggagagcaccttgtagaaatgtagtggggttgagcatggcgctgaaaagagcctctgattatgggctctggaaaccacagatctcaggactccaaacagcacagaactcgagtgtcctgttttgagtgtgagccctacatgggggaccatgttggtgttttcacatttgggtcacatttagcattgcggcggaaataatggctaccagttaggggtcaagtgcttgcttacatgatcttatttaaagcgcccaacaatactgagacctagttgttattatctccttgttatatataagaaaacagagacctagtcagaagcagcttgtccaaggtctcattgcttgacaggagcaaagtcaggattcaaactcagaggtctttttggcaaggatgatgaccttttcttttttttctaaacagcttcattgagataattcacctatcattcaatttgtccatacactaaaacggcctttagtatattcagagttttgcaaccatcaccacaatcatgttactgtgttgctgttataagtagaaaaaaaatatttccattctgaagagacgggcaaacttcgtgacccaacctctagactatgtactaactctgttgctgaatgttgataatttccattttcttccttctcagtaacgcagaatcttgggatgagaagaaaacttttaatttaatttctgcatgcctatatatatcgggacataaatgaagtttgactatggtgttccatggggaaaatattggtgtctggaagtcagagtgggagggaatcattgaaaaataagctagtccatctatattatgaatggagagaaactgagagggaaaagtggcaagtctggggggaacaaagtaaagaatgagaaaaaaaaaaaacagaagacgaggaaaaggaaaagttcacacagctaggaagtgatggggctaagatgtagacctgagccatctaatgctaggcctaggcattttccttttgtggtgcaatctctgtgcgggagaggcaagaggtttgtgattatcgaatgcatgaattaccactaataatgtcagtgcctaacgatctgcccagggctttgccacatgttgctccttttgtgacaggtagggtatgtttttctgatccttttctgatgctctgaggagggccagcgtagaccctgtgagcaactgagcagctctgggctgggaaaaggcagaatcaagtctctggttcccaggcaggtgctctttttccctagagctttgagctccttggacacccacacactcacatatacccacctggcccactgctccaggaacttggtgggggcagaggtatccaaggtccccagtcacatgtcaatgtggtgattcctccaggatggggttcctggctgctgttaaagcattgcctttctcaaactctggaggcactttcttacccatactcctaaaccctgactgccatgttttaggtggtgccccaagaccacctactggacctctcagagccttgaacattttgtctgtaaatgggaagaaaaacatcagcctgtctgttagggttaagtgatgtcatatatgtgaaagcattttaaggtataagacagcatataaacattacatatgatacactatttagtggcataatgtatctgtgaatgtcatcagaaataatttttttctgaatgctctttgtaaataaaataaaataaaataatttccaaaagttgctagaggtctttgacattgttcccttgtccctaactgactccatcccccactgtataaatagatatgtttattaaaatcagaaaattgcctaaattgaactgaatctttactttctttttagagagggtctcaaaaccaaagatctcctggacttgtatcaacacaaccctgacctgtgaggtaatgaatggaactgaccccgaattaaacctgtatcaagatgggaaacatctaaaactttctcagagggtcatcacacacaagtggaccaccagcctgagtgcaaaattcaagtgcacagcagggaacaaagtcagcaaggaatccagtgtcgagcctgtcagctgtccaggtgcgtggcgggcatcacttcacaaacacagcctgccaggccctcagtaggcagaggcatgctgctccaggtcacaggtgctcatgctgggaggcagccctggctcaggatgaggcatgaaagcatatctcttcctcctggaaaccttcaagggaagcatcaggggaggtggtgttctatggttttccatcctgggagtcctcccactgagcacaatttgaccacaagaaattttaaagatcctcttctaggagaaagaattgcaaaactgaagaaggaggagctgtagagagtatctcatgcaaagccccattttccagagagggaaactgacttgcccaaggtcccttggctagttagtgacatgattccaactgctcccctaaagatggttagtggtcagcacctcccatcaggagtaaaggtagaaaggctgcagaaaccctggggggcagggtcatgggggaatggagcccttgaggccaaagaggactgtggacagcaaggcaacactcctggcacacaacaggacggcaaggcttggggactagctccagaaaatctcaaaactccaagaccataatggatccccagtgtcccagcctgatgtgacctccagaagtatttctgagaggcagccttctatagtgcccaagctctcgcctgggagtagaggtctggacttctagtttgggtctgtccaaatttagccagagaatcttgacagagtttcttcccctctctaggcttcagcttcctggcccacaaagaaaataagcaccatgttcacagactattagatgagtaggctcttggatccacttccaagttcattcatgtgggccgttgggctgcctcacaatatggcagctagcttccctcagagccctctaagaaagagcaggaataagtgcccaggacaaaagtcgtggtctttttgtaacttaatctcaggagtaatatcccaatcacttctgctgtgttctgttcattagaagcaagttaataagtctagcccacattcaatcagaggggattgcacataggtgagaataccaggaagcaggggtcattgaaggcatctgagagtctgccaatcaccaacttgaccagcatcacttcacccccggttttcccaccagtcatcctcccacattcccccatcactaaggcacagtaagtgaagttgcctctccttgacttcgcaactttttttgagacagggttttgctctgttgccaaggctggagtgtggtagtatgatcatagctctcagcagcctccacctcccaggctcaagcaatcctcccacctcagcctccccagtagctgagattacaggagcatgccaccacacccagctaatttttaaaattttgtagagataaggtctcactctgttgcccaggctggtctcgaactcctgtgctcaaactatcctcccacctcagcctcccaaagtgctgggattataggcatgagtcactgcagtggcctcgggagatctttgattagagttgccagatatagcaaataaaaatacagcataagtacgtttcagatattgcatggaacatacttatgcaagaaatttttcattgtttatctgaaattcaaatttaactgggtgttttgcattatatctggcaaccctacttttcatgtttattttaactggagcccacaagtataaatatgtgtgtgtattagggatggaaggagggagagagggaggaccttgggagcagccaaggtttgaaggctggaacacttatgtcccttactctatggtgcagagcagaagctcattgcgagaaggaccactagggagatgggaagaatacctggggagagattagggtggaggagctgctcttgaagacccgaaaagggatttggaagttttattctgaaaggccaaggcagagaggagcaatggtcagagtctgaccatttggctcagattaggtgagtgtttacatacttaaaatcaaaatactaggaggaaggaacagattcagatgcacaaaaataatttgtcacataaactcatgggcatgtgatctccaagagatactgttggaagatagtatgcctggatttaggaactgggagggcatatttttgactgacagtgccaccgctgcttctgaaacatgatggaacattccccaccaaaagtactaccaggtgccccagggcaccaccctggacaaactggagagcaggctgtgtaaggcattgcctacattcctgcatgtgcccaagataaaattgtggccaccctacccgatgacttggagggaagatggagctggtggctgcatgacttagccatgtgctccccaaagcatttcaggcctgccctgccccaccccgggtcaaatctgaaaagttctcaagctcagcaggaagtggcctctggtatctcctgcccctcgtccaagccagcagggcctaaagggccctgaatcctttactgacccaatttcaatggtttaagattatgtctgcttctctggtggaggcctcttcatcagtagagcttagagagttgtgtaactggcaggcaaagaatgggtcagagagagactcgaggaaagaaagccaagatgaataaaccaccacagtttgatgatctgttaaacttggtttctgagcctctgaccctctccttggggcccatcctgggcttcatgtataacagtgtctccctggtatgtttttgcctggagaagcatttcttttgtgatgctgggccaagttccagtttgttcttcagatgaccccgtcccctgacccgagccccactgctgcttttctaactgctattgactcacaaagggcagacagccctagaacccctcctgtttcccctgttgctgggaaacagctcccagaaacaccagtgcgagaacactagtaagagcaagacctcacatttgtgttgttttacagtttacaaagcactttcatatccattatctgattgacttccaacagccaccctatgatgtaggtttcattatctccactttacaaagaaggaaacaggctcagagaggtgaagtaactctccaaagttcacacagctcctgcctaaaaaagcctagaccaaacccatttcccttaacaccaaagtcactgttttcctcattgcattacagtgactgaaggtccagcaactgaagactaagcccactgctgttactaacgcactgtgcacccgggtttctctcgtggctccagggaaactctgtgagagggtgctggccgtgaggtcagagtgctgggctggacaagtgaaatatttaccctgagtgtttggaaactgcctggtagagacagtgagaaggaatcatggtgcagtgggggtagccagagacgagagcaggatcaacagtgcagaaacaccgagacaaggggctgcttaagggaaatgctcaggaacagatattgtgtggcttcgggcaactcattctccctctcagggcctcatgtttgaagctagaggttgcatttagagtatctctaagatcctcggatctaaaatttcgtgatgctttccatgacgggggcagtgggcaggccggccttggtgcatgaacaatcaggcatttctagcccctgagagcagtttcccaaagagcctgcagagggagcttcccaaggaccttgggtccttccagggttgacaccactcaccaccctctgtgagcctgggagttatggggtgaaaggtcccaacaagctcttctatctgcttgatgcaggaggcagcatccttggccagagtaatgggctctctgcctggacccctcccagccatcccacttctcttccttttgcagagaaaggtctggacatctatctcatcattggcatatgtggaggaggcagcctcttgatggtctttgtggcactgctcgttttctatatcaccaaaaggaaaaaacagaggagtcggagaaatggtaagctccccctcttttgtcccaccgcaggccccagcaaaatccccatgaaacagctcatggggatgacaccttgaatctgcagagaaaatgatggaaataggtagtttcggaatgtcagggttgtagtcagcggttatagcttgtttcattttgtggttagcttgatttttgaaaaacaaattcttagtggtgacaatgtgggagctttgagacactgaatccagttggcctcattggaatccaccactgaggcctacttggtgacaggctaatgtgaacatcttttgaatgagccacacttctctacataggcagaaaggttagctccaaaacaccgtttctaggaataaatgtcctatctatgggtggcccaaggtgagttcaggaccaagctcctagaaacacagggaaaatcattcaggtcatcaggtagtcacaggaaaacagctgttctaaagcagggtgcctgtgccccctttgctaattctctgttcgagggatgtgttagggttgagagtttttcctcagatcaggcctgtctgacaatctatcagcaatgaaaaggttatgcttgcaagtggggagccggcttagggagcatccaggccacccaaggcagaacacttcagagaatggccaacccggggtcactgtggggggcacagatgagggtgtcagccattggcgggacttgcagccaagggaacaggccctggggttctctgcaattcacgttcacagcaggacttggtctctccctagaaccggcaggcacagccacaccagctgcttccagtgctgcccagggaggtggtccaaacttccccaggcaccggtggccttgggccccgtgccctctggatttggcttctttacctcagatttcttcctcagttctccttctgcctccccatcaggctgcggtccctcagccccacgtcccatcacgtcactacccccagcccaggccccgaaacatcatcctgaacttagtcccattcttcccaccacgactgtcccacactttccaccacagcacagcagaatcgctggcagggcccttaggcatgcctggcttatcctcctctgtgcccagctctggctgttctccatgctcctctccatgctccttctccattgactaatggtcaaagaccatatcttcttccaaggtggacctcacttgtcaccccaagacaaggcaatctctgccatcaccaggctgagaagaatgatggttagctcatgctgataaaaaagtcgttagtctctgtgttttatgtctattagtgcatccagctttcagagtgatcttaggagatagataacaacacagatgaggaagcttaagttcagtgaggttcaattatttgccttaaatcctatggccagtaggttgactcaggcctaggccgaggcaaggagcccagaatttaaggcatagaatttaaggaggctggcctgcccttgcacaacctgaaagttggtgtgtctttaaactgcatgcctgtcagcctcgcttgcctcattccagtcatgccctgggttgagtaaccaggagatgcaaacaagggagaaggacaatgagcctggaggaattcctgggagcacacatttaggcgccagctgcagctgctggagtgggtaggctgaggacccactgtcctgcttgaaccaggcagggtgcacagagccgtagccaaccttgtctgtccaaccctgcctgcagtctcagccatgtggctacaccccattcctcctaccagagctcatgtgcctctgtctacactttctggtggccctgggctcttcacagaaattgacattgcgattttcagttcttgtttgcctcttacttgattttaggcttcctgaggacaatttgtgtctaagtcacaatgacacttaacacttggaagatgaggaataaatgttggaaggacaaatgaaccaaatggtgtatgggccaagtgtggtggctcatatctgtaatctcagcactttgggaggccgaggcaggaggatcatttgagctcaggagtttgggaccagcctgggcaatatagtgagacctggtctctactttaaaaaaaaaacttaaaaattaggtgggtgcattggtgtatgcctgtagtcccagctagtcaggaggctgaggtgggtgaatcatttcagcccgggagatcaagaatgcagtgagatacgatcacacactgcactccagtctgggcaacagagcaaggccctgtctcaaaaaaacaaaacaaataaaaaacaaaaatagtgggtgaacagagtagtaaaccaatggccagtgcaagcttgccacataggagatgaagaaggaccacccactgccccataattcagaactagggccaggggttagagccctctccacagtctactggacataacctaagcaatgactgcagggcacggaagatggcatagaggatgtgttttgtcctttctggaggccctttcctctttgtgcttagagcacacgagccatttaggtatcaaaatcacattgtctaactttgactctacactcaaagccatctgatgctcacatttcatgtagtcagaggaggccatctggtttgaatcaacatccggaagttacagggtgatgcttagagagggcttgtgcttccccagccacacatctccataaagatgtaagaggtaattatttcagctgggtgcggtggctcatacctgtaatcccagcactttgggaggccaaggcaggcagatcacctggtcgggagttcgagaccagcctgaccaacatggagaaacgccatctctactaaaaatacaatattagccgggcgtggtggtgaacgcctgtaatcccagctactcaggaggccgaggcaggagaattgtttgaacctgggaggcagaggctgcagtgagccaagatcgcaccattgcactctagcctgggcaacaagagtgaaacttcaactcaaaaaaaaaaaaaaaaagaggtaattatttcaccccagggaaaaacttctcttcctacctccctctggagccactgcaaagacggccttgggtgcagggactgaaatacctaacttacagcctaaaggagtccagaggggccagcagggtgctccaggcctctagcagctgggcaccttcacagattccctgtgattttaagagtacaggaaaaactacattacgagtagctgtaggcctgctttcatggactgaagtcacacaaagaagaaaatcctgaagggtgaggagaggaggagttctttccctcctaaggccaagaacataggtcttgaatttctgagaagcgagtaaatttctaaggacaaaaagttccttgcatgtgttccaacctcttgccggaaggtggattgcatgacagtagaattgggggaaaggcagatctaacatagaaatgcctcagaaggaatgtagttactaatatcctccatgactgctcataaccccttcccatgcgctctaaccatgaggttcttgctctcagggaacaatttctaggtcagcacagaggtagggttccaggtctgcgtgctctctctgatcatgggagccccaggcacaaagccctccacccatgtgtcttcttcctgctgattccttgagttctcttgtcctaggctttcactctaccttatggtgagcacttctttctctcctacaagcttagagttctcagatagtaggggcaacttctgcttcctcattgcatcccccaaagcagctagcatggcgccttgcatataaaaggtactcaatatttacattgatttcacctggccaagatgaactctattgaggttttgttgttgcagatgaggagctggagacaagagcccacagagtagctactgaagaaaggggccggaagccccaccaaattccagcttcaacccctcagaatccagcaacttcccaacatcctcctccaccacctggtcatcgttcccaggcacctagtcatcgtcccccgcctcctggacaccgtgttcagcaccagcctcagaagaggcctcctgctccgtcgggcacacaagttcaccagcagaaaggcccgcccctccccagacctcgagttcagccaaaacctccccatggggcagcagaaaactcattgtccccttcctctaattaaaaaagatagaaactgtctttttcaataaaaagcactgtggatttctgccctcctgatgtgcatatccgtacttccatgaggtgttttctgtgtgcagaacattgtcacctcctgaggctgtgggccacagccacctctgcatcttcgaactcagccatgtggtcaacatctggagtttttggtctcctcagagagctccatcacaccagtaaggagaagcaatataagtgtgattgcaagaatggtagaggaccgagcacagaaatcttagagatttcttgtcccctctcaggtcatgtgtagatgcgataaatcaagtgattggtgtgcctgggtctcactacaagcagcctatctgcttaagagactctggagtttcttatgtgccctggtggacacttgcccaccatcctgtgagtaaaagtgaaataaaagctttgactagacccgtgtctgctcattgtgtgaaggatcccagtgtcgaggagaggaagctgccgaataagaaagagcctcgctggtgtgacagcaggatcaaattcagtcaactcaatccggctgagacctccttagtcctcaccagaatgacccgaacatgctccccaggtctcagctgcaaagctgggtccaacaacctatttgtagatttccataatgaattaaagcctccatgcacaaacgttaacaggagtcaccagaaaacttaacattttaggtcttactttcttgactgttcagacacggtcataatgacctgtactgtcatccttcaaaacaagggaatctatggatactggaggtgtcatgaactcatcagatgacatacaaaaagataggctaagagacaactcagttgaatcaaatcttaagtgtcttaaatgactatgattaaaaggtcagaccccatccccagctagcagtcatgcagctgtactttgagggaagtggggagaaaaaaatagttttcagttagagttctaaaacaataggtggtgagaaggcacctgctttgaaatgctggtgccttgtctgtggtcctgtctgcccgccttctccttggcttcttagacttgctaaaccttgttacactctggcaggaagctctgagggctaaaccacaaaaactaagtacattcaggacttcctgtgacagctcactgaggattgaactactttttcctctgaatctgagagtctatttttccagcaaccagagttaattactaagggcaatgatgaatgaaacctcatcgcctcccaaaattcaaacacaaaatccagctaggtaacaattgccacaggatctacccagtagagagatgagggctctggccgggcatggtggctcgtgccagtaatcctaacactttgggaggccaaagcaggtagatcacctgaggtcaggagtttgagaccagcctggccaacatggtgaaaccccttctctacttaaaaaaaaaaaaaaaaaaattagccgggcatcgtggcacgcacctataaccccagctactcgggaggttgaggcagaataattgcttgaaccctggggtgtggaggttgcagtgaggtgagatcgtgtcacttcgctctagcctgggcaaaagagcaaaactccgtctaaaaaaaaaaaggagagagagagagagagagagagagagatgagggtcctagctctgcccctttctcattcttcatgatacccatgagtgatttcattggctatctcaccagaacagctcatacgccattcccttaagaaaatcttccctggtctattcagccctgggctctgcctttcttctgaactcctgtggcattacatatggtacaaaacacatacaccctattcaatccttcatcgttcattcattcaacgaacatttattgaacttctactatgtgtcaggctctgtgctaggcactaggaaaacagaggtgtacaattgcatctctgctttcaaggagctcaccacctggtaggcaagaaacggaccaaccatgggacaaatgcaatgcagtatgataaatataggtcagaggcaagtgcatgaacccagaggaaggactttgaacccagactgagtggtaagactggggtgacaaagagggcttcctagaggagggacgtttgggttgcgttgtaatagattaattgaactggtgaagcagaggtacagaattacccatgtagaggcaacagcatgagcaaggctcatttggctttctgtttacacaaacatgtagtttctttttcaactactgtatttaactgatttgaagatgtcattgatttttcaactactgttttcaactttttgtatttctttttcttttttaacaactatatttaactaatttgaagatggcattgattttaagtggcatcattcttttacatgccactaagaaagagaagaacacttctcagttgcattgtaacaaatactaagatacagtcaactttcagtcacaatcccattcctgagatattaaaatgtgaaaaaatgttattttatgttagtgcattttagaattgatgaaatgcatagtaaagaagctttttgagtacaatgaccatttctcaatatcgctgccagcactttattgaagctatcattagccaattgattcaatgggtgagcccagtcctgatgaaaggaagggaagtgaacatacacaacatgcttgtcctccttatccagggaagataagacagattctctgccctgcaccaccattaggtgggaaacacgaaccttgcttaagatttgtgctgctgtcacccacctgtctgacactgtgtgacatcccactgaacctgccccagagcatggacattctgagaagtagtcaggccagctgcgtaggaatagcttgtagagcttgtgaaaaaaaaaaaaatgctgacacttctgtcagtcaggttgggggccaaataaacatatttttaaacaacctctccagctgattccaatgggcattcaagttgtagacaaccttggagactatagataatgcagtattgtaagaaaaataaacagttgtagcccagttagctattcccccacaagcaaatctccaataagaaggccaaccatgttggaaaaaatatccacataatttaaggcactggaacatcgcagaggtttatatgaagacagaaaatttagaggtttctgatagcctatctgcccaccctaaataatagtctaatactagcagctggaccagcttagctccaaaagggtctcaactgtaaactgggaaatttcatctcagtcctcctgctccttttcctttgctaattttctaatgttaggctccttacccatgctcagtgggttgcagtgacttggtgactcaagttcaccaataagtttgccacctcaggaccactgtacatgctgttcctattatacatgctgttcccactgcccacacttttcacctggctcttcacctgtccacattcttctttcagagttcagacagaaagtcatttcctgggggagacctttcctaactcttgaactccactgtaacgtgaatcttgtgtgagaccatctctgtgtccagttctgtgcccatgaagttcaatgtagtagaagactcacaggtatcgaagccaggaagttctgactctctctctcactggatttgtaagcttgagtaatttattcagcttctgtaaacactgattttctcatctgctaaatgaggataacacctcacaaggttagagtgaggactaaatggaaataatgtatgtaatgtaacaaatatatccttgtgtacagaatgcatctgaaaactgtgagctttatttctggcatgatactcaagaaggaatatcctggatggcacatataaatgggctagttattggaaagacacacagctcattataaattgataaataagcactctgtaaggtgacttagtctgctatgagtttgattcatctgagtcagtttcataatgttgcctcacatggaacaaatggatgataaaatcctacaccagaggtatttaaagctaaagaacagacctgtgaggccacctcgcaaatcctagattgagtcaccagccttctgtcacttccctggcttcataagcagggttttcctgaagaaaaaatgccaggacattacttaagtacatggcatctttctggtttatttatagcaacacagaacaaaaggatgaggaaacaagggaaaattctgatctttttaattgcctaccagacaatgacattacaaaaaagaaactacaggccaacaactctcacagatacagatgcaaaatttttcaaaaaatattaacaaatcaaatttgactgacaatgtataaaaaggactatacattacaaccaagtgggattaatctcaggtatgcaaagctggttcaacatttgtaaatcaattagtataatctatcatatccacaagctaatgaagaaaaatcacatgatcctataagtagatacaaaaaaagaatttgactcctgtttatcaacacctgtttatcaaaaaaacttttggtaactgggaagagagggaaacttcctcaacttgattaaaaaaaaatctacaaaaaagacatgcacctaacattttacttaacaatgagaaactctaaactttccagtaagatcaggaatcaggatgtttcctctcaccactgtttctcaacatcatattagaagtcttagctagtgcaataatacaagaaaaggaaataaaatgtatgcaggttgggaagaaataaataaaactatctttgtagatgacatgatcgtttgtgtagaaaatctgaaagaatcaacaacaaaataatactggaactaataagggattatattaatagcaaggttgtattaaataattcttacaaggttaatattaaaaagtccatcagtttcccgtataccaacaatgaacaagtgcaatttgaaattaaagacataataccatttacattagcactcaaaaaatgaaatacttaggtatagatttacatgaagaaaactacaaaactctaatgaacaaaataaaggaagaaccaaataaatggagagctattttatgttcatggataggaagactcaatgttgccaagatattaattcttcccaactcaatctgtagattccgtgtaatcctggtcaaaatctcagcaaattgggctgggtttggtggctcttgcctgtaattccagcattttgggaggctgaggtgggcagatcacttgaggttacgagtttgagagcagcctggccaacatggtgaaaccccgtctctacaaaaagtacaaaaattagccgggcatggtggtgtgcacctgtaatcccagctacttgggaggctgaggcaggagaatcgctggaacctgggaagtggatactgcagtgagccaagattgtgccactgcactccagcctgggagacagagtgagactccatctcaaaaaaaaaaaaaaaaaatccctgcgaactattttgtggatattaaagtgattctcaagtttatatagagaggcagaagtcccagaatagccaatataatattgaaggagaacaaaattggagaaccaaactgccccacttcaagatgtactataaagctacagtaatcaaaatagtatggtattggtgaaagaagagacaaatagatcaaatggaacagaatagagagccagagaaacccatataaatttcatcgtcttgtccaagcttgtccaaccctcagcccgcgggcaccatgcagctcaggatggctttgaatgtggcccgacacaaatttgccaactttcttaaaacattatgagattttttttctgtactcatcaactgttgttagtgttagtgtattttatgtgtgaccccattcttcttcttccagtgtggcccagggaagccaaaggattggacacccctgatttgacaaaggagcaaaagccaaacaatggagaaagaatggtctcttcaacaaataatgctggaacaacttgacatccacatacacaaagagaaaaatgaatctagacacagatttaacagccttcataaaaatcaactcaaattaattacagacctaaatttggtggcctggatactaaatttatttattttaaggaatagtacaaatcaaagaacttaagtggatgttttggcataacttacagaaaaggtaaaggaaaccccaccgtgcaggcactgcttcggtccagagaggtcaccccgtggctacaggaaacgagcctaaggcttagctgtcattatccctctctcccagagattctgccaggccagatgcccggctctcgtcctgcacaagttggtcacgtggacacccaattctttgatggatttcactggttcattgaggtaatgtgtctcaataaggtgacacaagcgggagccgtttttacgcagttccaatagtgaccgattcacgtgttttccaagtgtaagacacactccatcgcattcagccggttctccgcctggtgtcttgactcctgaaggaagactccgccccttcgttgtttctgcagcttcatcggtttctcagcgggctccctctcctcatgagattagtgaagaaataagtttttggcaaaattcctcaaagctacgttatggcggtgaaagcatcagatgtggacaggtagatggaggaggctggagcgccaggttgaccgggggcctcagggcggtcccagcgcacggtgaggaggtggaagctctggctctgagccgccagccgctggggcacgggaaaagcgccagttccctccaagcacaggtgaagcaggaaaccgcggtgactgtcggcgaagaacatctccagacctaaatattagatgcaaaattataaaatgcctagaagataatcggagaaaacctggaggaccttggtcttggcagtgactctttagatacaacatctaaggcaagatccatgaaagaaaaaattaataagctagacgtcattaaggttaaaattttcttgggtaggtttagtggatcacgcctgtaatcccagcactttgggaggtcaaggcgggaagattgtttgagcctaggagtttgataccagcctgggcaatatagtaagaccctgtttctataaaaattttcttaaaaaactagcccagcagggtggtacacacctgtagtcccagctactagggaggctgtggtaggaggaccacctcagctagggaggcagaggttgccatgagccgtgatcatgccactgcactccaacctgggcgacagagcaagaccttgtctgaaaattaaattaaattaaattaaattaaattaacatttttttgctctgtgaaagacagtcaagaaaatgaaaagacaagccacaggctatgagaaattatttgcaaaagacatgccagttaaaggattattattcaaaatatacaaagaactcttaaaactcaacaataagaaaacaagcaaccagattaaaaatgaccaaagaccttgacagacacctcaccaaaggagatatacagatggcaaacacctaagcacacaaagagatgctctatatcatatgtcatcaggaaaaatgcaaattaaaacaacaatgagaataccgctacatacctattagaatggccaaagtccagaatactgacaacactaaatgccagtgaggatgtggagcaacaggaactctcaaacattgctggtgggaatgcaaatggtacagccacttttaaagacagtttggcagtttcttataaaactgtacatactttccccatacaatccagcagtcatattccttggtatttaccgaaagaagttgaaaacttgttcctacaaaagactgcccacacatgcccagagcacctttatttataatgacaccacttggaagcaaccaaggtgtccttcagtaagtgaacggataaataaactgtggtacatccaaacaacgaaatattagtcagtgtgaaaaaagtgagctatcggccaggcatggtggctcacacctgtaagcctagcactttggcaggccgaggcaggtggatcacttgaggtcaggagttccagaccagcctggccaacatggtgaaaccgtctctcttctaaaaatgcaaaaattagccaggcatggtggcatgcaccttagtcccagctactcgggaggctgagacaggagaatcacttgaacccaggaggtagagattgcagtgagccgagattgcactactgcactccagcctggatgacagagtgagactccatctcaaaaaaaaaaaaaaaaaaagttagctatcaagccatgaaaagacatggaagacttagatgcatattactaagtgaaaggagccaatctaaaatgtctacacataccatatgattccaactatatgacactctggaaaaggcaaaactgtggcaacggtaaaaagattagtggtcgctaggtgtcagatggcaggaagggatacatagcaggagacagatacttttcagagatttgagaatactttgattgatactataatggtggatacttgcctttacacatttgttcaaactcagaatgtacgtcaagagtgaaccttattgtaaactatgggctttaggtgataatgatttgtcaatgtagacttatcgattgttaaaaaatgcaccagtcttggttggggatgttgataatggggaaggctatgtgtgttggcggagataggggggatatgggaaatttctataacttcctctgaattatgctgtaaatctaaaactgttctgaaaaataaagtctatttttttaaagtgcttaccaaggacctagcaccatgaaagaaaatgtattcacaccaagatatatgattgtaaaacttcagaacactgggacaaagattagaaggggagagaggaaaaggggtaaggggaaggaagaagaaaaaaggcagtggagagagagacagagagagacaccataccaagtatcaagaattagaaagaattagaatagcactggatttctcaacaactatactggaagctagaagacaacaaagcgatgctttcaaattctggggaattttcagcttagtattctaggcaaactatcaactatgcatgtggcttatagagaaaacatgtgttatacaagcttttctgaggcatgagtcatagtgctggtggccatgagttcaatgttaatgcatcaacaatatatctcaaataagatgtctttaaacagaaacacacataaaattaggttttgtattgatcagttgactcactgtttactcactcagtgttaaggctcacaggaatctaaccctgtatttcccctgggagcaatgtttcagtttgctaagtcagtgtttgcaataactttacagagcataactaccatgaatagtgagaatcggctgtatagacttttccttttctttctttttgcactgtcttcagattacctcttctcatatccccttttccaccactggaccaactacactgttgctgatgattgctgtggtgatgaggcaggacgggagtgaacaagtagagagtttaccagctctcccctgtcctttccttctctgccccagtttgcagacacccatcccccaacatgtgcttgctcacattctggttcaaaagagccttcagtcttctcagagggttctcaattatatgttagtttatcatgtccatgattatttctcttttgtagcttttctctgctatagttctgtagtttacagttgtggaggaaggtaccagcagtacaagctggttcattggcttgtcaaaaacttgatcagggaggatgttagcaatatgatgcaagaacaaccaagaagaaatatcaggtatgaaaaatataactgttgaaacaaaatgcataatagctgaagtatgaatcaggatagatacagctaaggactgaattaggaacctgcaagatcattgcaaagacctatgcaagaatgcaggggaaagtaaaacagcttttctttaaaaaaagaaaagaaacaatagggatatgaaggataaaaatatcagtattcagataatagagattccatagggagaaaaacataaagttgaaaattgagcctataatatagagccaaagagagagagagagaaaaccccaaaattagacattttactgagaattagaatcatcaaagactgcaagaaatttttagaatgttttcagagagaaaaacatacaaaagaacaagcattagattgacctgagacctctcagtaacaatgctggatgcaagaagacaaagaagtaatatttttaaagtgttgtgcagtcatccctaggtttatgtgggggattggttccagaacccccatatatatatccacgtctgcacatgctcaagtcctgcagttggccctgtagaacccacccatgtatatgaa

SEQ ID NO: 1847 - DNA, 1504 bp, Homo sapiens
cctaagatgagctttccatgtaaatttgtagccagcttccttctgattttcaatgtttcttccaaaggtgcagtctccaaagagattacgaatgccttggaaacctggggtgccttgggtcaggacatcaacttggacattcctagttttcaaatgagtgatgatattgacgatataaaatgggaaaaaacttcagacaagaaaaagattgcacaattcagaaaagagaaagagactttcaaggaaaaagatacatataagctatttaaaaatggaactctgaaaattaagcatctgaagaccgatgatcaggatatctacaaggtatcaatatatgatacaaaaggaaaaaatgtgttggaaaaaatatttgatttgaagattcaagagagggtctcaaaaccaaagatctcctggacttgtatcaacacaaccctgacctgtgaggtaatgaatggaactgaccccgaattaaacctgtatcaagatgggaaacatctaaaactttctcagagggtcatcacacacaagtggaccaccagcctgagtgcaaaattcaagtgcacagcagggaacaaagtcagcaaggaatccagtgtcgagcctgtcagctgtccagagaaaggtctggacatctatctcatcattggcatatgtggaggaggcagcctcttgatggtctttgtggcactgctcgttttctatatcaccaaaaggaaaaaacagaggagtcggagaaatgatgaggagctggagacaagagcccacagagtagctactgaagaaaggggccggaagccccaccaaattccagcttcaacccctcagaatccagcaacttcccaacatcctcctccaccacctggtcatcgttcccaggcacctagtcatcgtcccccgcctcctggacaccgtgttcagcaccagcctcagaagaggcctcctgctccgtcgggcacacaagttcaccagcagaaaggcccgcccctccccagacctcgagttcagccaaaacctccccatggggcagcagaaaactcattgtccccttcctctaattaaaaaagatagaaactgtctttttcaataaaaagcactgtggatttctgccctcctgatgtgcatatccgtacttccatgaggtgttttctgtgtgcagaacattgtcacctcctgaggctgtgggccacagccacctctgcatcttcgaactcagccatgtggtcaacatctggagtttttggtctcctcagagagctccatcacaccagtaaggagaagcaatataagtgtgattgcaagaatggtagaggaccgagcacagaaatcttagagatttcttgtcccctctcaggtcatgtgtagatgcgataaatcaagtgattggtgtgcctgggtctcactacaagcagcctatctgcttaagagactctggagtttcttatgtgccctggtggacacttgcccaccatcctgtgagtaaaagtgaaataaaagctttgac

SEQ ID NO: 1848 - protein, 351 aa, Homo sapiens
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 1849 - DNA, 83836 bp, Mus musculus
  misc_feature (1)...(83836): n = A,T,C or G
acttcatgagggttatagtattaaattagattttatatgaaacactttgtacattgcatggtgaattgaataaaaaagagagcactatttacatatcctctacacagttattcttaaagacttcagttaattcaaagcatatactaaccctacacttggaaaataagaacattgcaattcagttttatttttctgctgagcaagtagataataatttcagagagttattagatatattggaatgtatcttagtttaaaataaactaggtgggtgatgagcagttgatcttctaaattatttaaaattagtatacaaagtagcaagttcccttatgacattttcatactaattagtttgtttttctgctcccctctccccaaacccattcttcttctccatctccttgccctcactctccatttacacattctggctccagtacttcccctttctactttatgtcacatggtctattactctccttaatctacttcctaaaattgtttcccgtctcatgaacccctttctaagttcatgacctatactcacactcatacctctgtaaacacacagaaaaaaaaaacacacacacacacaggaaaaaaaaattcacatatctatttgtatacagacctggactagagttctcttattgtttcctatatcctgaaccgatagctcaatcccaatactttatacacacacatttgcaaaaatgcacacatctcccttgcaagagtattgaaaggattatagataatggatcctcacacaccataaatagtcactaagtagacactattgtttttatagttttgtagttaagggcttgggatatgaacatttaggcaacctatgaagaatnnnnnnnnnnnnnnnnnnnncaacctatgaagaatattgaatttgaatcttctggacaattgactaaaggagactataaataaaaacatcttagaagacatattgagagagaagagggatggaagttgccctggagtagatggattgtaagcaaatgaccatgagggctggcctgacggagtagatgtggcccaagtggaacatggttctcaggatcaaacttgtcctaactcttgagaacacaatatactgaaaaatccaaggaaaactgaagggaaatctcccatcacaatccaaaggagaaaaagacaaggaccagagcttctaggctggaaacggacactccaagaccacacagctagagagtttgttgtggtaatctgttaacatgttctgagctccctgcgggtgatcttggttcttgtcactgccagagttctctggattcatgaatgaaaatactctctctctctctctctctctctctctctctccctccccccaccctctcccttaaaccaggattcacctcccctcccccattctacctggaactgaaacgttgggttaaggtccctgctatcagcatctttcatgaatttccttcatctcattagaatatcatctctatattagaagctctttgagtgaggggaaacaaaaccaaacaaccctcacccaaaagagtaatggtatgataaaaacaaaacattattcctgagctaagtataagtttattagttttggacaggagacaacttgcttgtatgaattgctttggcccttttgtttaaattgccactcagattaatagaatttaagtatggggtttgctcagaacagcactggctgctcttccagaggactcaggtttgattcccagcacccacactaaccatctgtaacgccattttcaggggaactgatgccctcttctgacctccaagggcggcagccacacacatagtacacaggcatatatgcaggcaaaatattcatacatataaaattaaattaaatttaaattaaaaccaaccaaacaaaagacatattgattgcatgtttatctataagcatatcttactaaatttaactcatttcctagtgcttgcagtgccaaattgaaactaagattttttttctcccctgctcagaatgactgtgtcttggatatgctccttgaagtaatcacaagattcattaacttcatctccgtccatctccaaagcagcagaaacacctactcaaatataggagatgtgtgatgcagtttcctataacaagttagtaaatgtgcaggagtagctctttttttttcccccagaagaaatagagctgcatctgtagaaccagcagattaactcattagtgctgggttgttgcttcttatttcactttttatttggtattaatttccagacaacacatatattctcataaatgtaagtttctgcaaacatatcatactgtcttttggttgatctccactcttttagttttcattttagggagcttgcattttcaatatgctcagtgattttctgggtgaggagaaattctagaaaggattaattcactacttaaagaagcacagctacaaaaaaatgccaggaatgaaaatttatgggatagtctgtccagtgtaagccctatgttgggttgtagtagactggtaagcctaaaatctaataggctaatgatgttttaataggcatgctgccatcaacacacattcctgcttgaagagtccttttttattctattttgtccccactcagaaaccaggccatggaccatttgctatctatctgggtggaaggtactttgcttctgcagctgcctgtctgagttgctctgggcctggaggctgcagtctccagtttagcacctcatagtaagaactctttgtatatattggatattagtcctctattggatctaggattggtaaagatctttccccaatctgttggttgtcattttgtcctattgacagtgtcctttgccttacagaagctttgcaatttatgaggtcccatttgttgatttttgattttagagtataagccattgatgttctgttcaggaaaatttcccctgtgcccatgtattagaggctcttctccactttttcttctattagtttcagtgtacttagttttatgtggcggtccttgatccacttggacttgagctttatacaaggagataagaatggatcaattcgcattcttctacatgctgacctccagttgaaccagcaccatttgctgaaaatgcttttttccactggatggttttagcttctttgtcaaagatcaagtgaccataggtgtatgggttaatttctgggtcttcaattctattccattgatctcctgtctgtctctgtaccaataccatacagtttttttttttttaatcactattgctctgtagtattgcttgaggtcaaggacagtgatttaaccccccctcccagaagttcttttattgttgagaatagttttcactatcctgttttttttttttttttgttttttgtgtgattccaaatgaatttgcaaatggctctttctaactctgtgaagaattaagttggaattttgatgggggttgcattgaatctgttgactgtcttcagcaaataacctcatatttgtaataggttatgttgtattatttcccaagagcaatgttcgttggctctctttgcttccttagaccctattcttaacagcaccagacattaaacttttatctgttattgtacttacatgcaaaccactgtttcctctgaagtacctatacttatacttttagtctctttgacctttgactctttctgtgtctttttgttttagacaagtctgttgtaagcagacttactatacctcagtctcactacctattatgcccaacttgagcaggacctgtaacatgacatctttttgtagcactctcaatggcatgaaaacttcatgacgcttcagatgctgtaaggcaaaaggtgctccctggctttggctccctctgtcccattcctgtctccctttgactccctagaattttatactaacagattaatacatcaaaacaaaatttaatttacaccatatttagcaagaaattcaattaggacacctaatccagaatattcccagaagccattataatctatatggtaatttgtatatgtttaacatttttttatatactaaactccttgggatagaaattggttcacagtgttgaccctgtaagttcttatttctcataaacaacattgaatcagtaaaaaaccaaccaaacaaacaaaaacacaaaaccaagatactcaaacaaaaaacaggtcatttatccaggatttacgttagatgatttcctaataattataaagataaatgattagaaagtctgagaaatgtgaacttaattaaaatacagaaatttctttttaaaaaatatatacttagatatttgtttatttacttatttatcttttttgtttgcttgttttcatggttttttaagatctatttatttattatatgtaagtacactgtagctgtcttcagacactccagaagagggagtcagatctcgttaaggatggttgtgagccaccatgtcgttgctgggatttgaactcaggagtagtcggtgctcttaactgctgagccatctctctagccccagaaaataatttctatttatcacttactggatcaagtttcactgataccaactcagcacccaaacttggaattcttcaatatgtcaatttaaataatcagtttggagcaactttctcagccacataggttggaagtgatagaggcagagtttgacctctgtgaacttacctctgccaggcatcttcctcttcaattttgtgctatcctttgtgtccccactaatacaactgtatgtagccaaactgaatgccatctatataatcacccgtaatgaaaatgtatactcttttggtagcctatttcatgtgggagaggcattatctctctgcacagcataactccatatacacttttttgatgtgtaaatatatacattttagaaagcttcttccctggttatttcgaatagagcatcagtgaacatgaatgggtaagtatctctgtagtaggatagtagggtctttcaggaatatgtccaggagtcatatggtgagtcaaatgctagttctagctctgctttttgaggaacctccatcctgatttccatggtggccacaccagtttacattcccaccagcaatcaaaaagttgtcctctttccccatgagctttgttgttgttttcttgatcttgattttagccatcctgactaggttaaggtgccaggttatctatctctgagttgatggtcattggtgtcccatagaccccccccccaaggcaatacaaactattgctattgcttttgactgtcctctagaaattgagggtaagaccctattgctaaagatatcagatacttgagaaatcaagctggtactaacctggaagtatcattactactgactatccttgatagatttggaaggtgctgggcacactgcttaagaagtaagataaaatcatcagtgttaccaagctatgaactctgagttacaataacaactggactagtacaatagtggcaataaagttttgagagtaaaaactgctttctgattatattgaagaatagttccacaagattgtggagaacctttttggggtacctcttggcaggaatatgacattgtccaaagaaaaggaaatgggcttcaggcaaaaatctgacattggccatggcaaggaagtaagctcaggtaggaatctgacataacaaacattaaaaggccctgctcatataacacaaacaagctgtgcatgtcttgaagacggggaaggaaggcattcttgtcagaacaacctaagacaggctcagccacgtttattaaattaaaaggggggagatgtggagagcctttttggggtgccacttggcaggaatatgaccttgtccaaggacaaggaaatgggcttcaggcaggaatctgacattggccataacaaggaagtaaactcaggttagaatcgacattggagtgtgggaagccacatgtgccattgcagagtggtgctggctactgctggccaccacgcataagtttggacaaacaaccaatgtgtacatatgcagtaaagctttttgccaagtcactgcctggcccgggcatgttaatgaggtactgagatataaccaatcagatgtgagacatgcaaatgaggtatgttaatgaggttctgtgaggtactgagagagagtagccatcagatgaggaacatgcaaatgaggcatagtgcataaccaatcagggtgtgagacactgggcttggggtctcttcgcctctgcaatcaagctcctgttgcagtattgttcttgctggtcgagtccggcaagattggagcatgacaaagaagtaaattcagggagggacctgacattggccaagaataaggaattaacaatctggttttagggtagaacaaagaagtaggctctgatatcttgatcgtccttagacacagctagtcatggggctttgtgtttattgtcttgcttgttccttgactattgtccttttagtttcttattgtactgctcgcccttaacacttgcatgtaattaaaatggtataaaaagcaaattgggaaaattaaatttgccttcaatctcagaattgactgggatcatgctacaatgttgtctgtcttttttctttttaatcctcactcctgtgctggagaacctgttgactgactgagcgggcgtggtcagtactactacttattcatgacaactgtaataagttattgtgagttagagtcaatccagtctgctgtagaattattgcttctatcttagagtgccaacttctctgtttccagctttcaccttcctggcctttagtaatcactactattctttaggttgtcttttttttttttttttttgcacacacatattgagtgtatttcttataatcatcacctgtcaataaaaaagcttatggccaatgaactgaggcaggaaataggaagtgggacgtccagcagggatagagagaattctgggaaatattcagagttgtgagagattcaaaagctatgtaattcagtaggtagctgaaaccaggttaaaataaaagggataacaagtaaaagcaagtcagagaacaacctgaaggttatggcctcagcaattattaatacataattagtctcagagtagtcattccgggagcagggcccaggaggaaaaaacctggatttattttttacacaaacacatataagaaaagaattttttgtcattctaacttaaattagtataatgtctttaagtactattctattttgctgtatgtggtagaatatttctttttatgactgagtggcagtcattgtagatatacatcccactgttgttggatattttgtttgattccttatcgaacagtgctgtaaaaaacaaaaaaacatgagtgttcagatatctctttgaaagcagacagaatttctcttgaatatacatccagaaacagtacggccagatcctagcacagatctatttatagtattgagtactaatttatgatcccattttttgtttctttataaacagatggtagttatccagggtgctaatatttttcagttcaagctattagtatttttttctgttatataatttaaatattaagtagtatgcagtgatgactctgaagatggtaagatgaatgtattagatgacatcactctgataataaacagtaatatcacaataacctaaagtgttagaaccttgagaaagaggagaatctgaacaagagcaaaacctctgtgttttcctcaaagaggctttacaaaatcaaatataaacagtatttgacggaacaaaattcactaatatgcatttaaggctacatgggattctgaaatatgtttgttttatttactgtttgcttgtattcctgaatagcaaagatgagatgcaagagattggcaaagaaataggtaaaaaaaaaaaaaatctcctgattctcccaaatttatgaatgcaaattgtgaaacactttagcacacagtctcagagctgaaaatttaaaaacaaaacccaaggtaatgtgattcacacttaaagtatgatagactgtagcttgctggtgaggtgaggtgatttatcatgttgtggagttttaaataactgctactaagtgctctggcaccaaaaataacaccaaaagaacaaaacacgacctaatagggaagagtttcttagctaagcaataccaatgtgaaacaggctcatttgaacaaaatccatgaatacaagagttcttgtggttcattttctacttttggttcggaattgctccgatatggggactagcctaaggactcagcctatctttcacacagtgaaaaggcagtagcagcgttgagatatgatgtcatgaacatttgtactgagcacaaacagaccaactggagacattcattataaagacattcagtggaaaggtttcaatgtgggcagtaaattagaaatataaacattatactgtacttatttaatatattgtgtaacgattaaaaatgaggacatagccctaaaaaaatgaatgaaaaaaaaaaaacctgccccactgatcttgtattcttgataaacaataagccttttgacagctaagagtgctctgaacataatggcaggaggaatctttatagaacccactgtgtttgttgctattttaggtgtgtggtcagaggattctctgtaggggtgacatttgagttaagaaaatgacaggaagaagtaagcaaacaaaacacaaagctgtggaacaattttgcaaggagggttttgttttgtttaaaaaaaaaataagtaaaggtacggttaacgatgctgaataaatcgcgccaacttctaggagccttatgaaagcttcggggccattaaagggcgagaatgttaatgaggtcccagagttaggtaaggagtttagtggttactccaagtacagttggttttcacagggcgttgtaaaacaggagtggaacgtagtggatgtaatacaatcgacctcttaaaaacactgcacttcgggtttacttctttgaacgtagaatttccttatcgatcgaacatcatccctttctcctctttcgcccaggatatttgtacaggtttagattttgtttgcacgggttgacagcctgggaggaggagtgtgtgacagttggctcgcgcagtgaggccaaggcctagccaagtcgccgcaggggacgaagcagtgagtggggaggaaagaggagctgtggctgcggttgggagggatggggagcctcttcgcggggtgttgacttccggcagttggagagacaggagctagcaggagctactgcggtctctacgtgtctcgtaggctgccggggaccgccccaatttggcaccggaaacaatggggcccgaggcaaaggcgcgagtactaggggaagggggaacttggctccctccggtctagccccgcggaatcaggccgtgtaccctgaaggctgggagcagccaactgctggtgtcgagtaaggacaggactaggcaggcgggcctctctgcacacaacctctgcgcgcacggtccgttctcctacaccccgctccgggttttgagatctgctcgcagttctaagcccagccctaagcaaagggcaccgatcgactcccgggcccctcccttcctctggcctccggctttgctgcagcagcagctgctgcagggcgttcttctaaaggagagaagtcgggccgaccaccgccgcagggcttgctccggcggttaagaagagcgccgccccgggctagcccagcgtagaggccgacacaccctgggccttgtcttgctttcagatcgcgaagggcgacaacccctctggcgacagcgtcaccggccgcatttccgggnnnnnnnnnnnnnnnnnnnnnnnnnnnnnnnnnnnnnnnnnnnnnnnnnnnnnnnnnnnnnnnnnnnnctccccgccgcccctgggcggagtgggcctagggttgagcgatgcttagcgtccacgcctcagtgggtcttttgcagcagttgcgaaaacccggaacgaaggtgttgttgccgtgcggcggagcggcgccgcccctcgccgcacctccccggcagccctcggaggcctttgctgggcatgctcagtcgtcaggaccgcttcggctctcggagtaggaagcttggggcgctgggctggtaaggacccgcggcggggcgaagatggagtcctttaccaatggtgagtggctagcccgagtcgcggattcccgggctctcagggtccagaggatcagatgtggcaagggggtcaggctgcaggcatccctgccaagggtttcccaggcgggccggggggcggcagaggggccagggtcggctggggcaggcgtgaaggtcagccctctcccgggggccagccccgaacctccaggtgaggtagtcggcaaagtttgggatgcttgcgcggtggagggggcggcggcaaagttggcaacggcgttggtcctgggggaagcggccgcggccaggagaagctgcggccccggcgaaagcctactcgtgcggggagcctggagctgtccgcccgtccttcaccgagctgtccgcatgcctttccgtaacagggcggggtggggccgcggctggcagcgtgatttagtgcactgcagggaaggaaacttaccgggggctggctagtactgctcggtgtggcgaagatgccgccccgcattgccacccgtctgcctaccgctgctccgcaggtcgaccaaacttctttttaccagctagtgatgtttgatcttctagttagagatccattgaatatcaatggcccttgttgggcttatatcataaggtggcatgggtgtgtgtgtgtgaaagtcaaagcagtctgtgtccagaaaatagccacggccctttacttcatggcttttgtctgggcttgtagtgcttgagtctcaatatagaggtgagatgatgtctcaccattttatggtgtttaaatatatggattccactttaggatggaaagtaggaaaactgctagtaaagggtagggcttaatgagattagaggatccactttctacttggcatgtgtttccagtgtggttggttacttcaggtaggtagaaagtcagattaatgggagagaagcatattattgttgggaggggggtcgcatgccacttaaggaactgggaagggggaggggacacccactctatccactctaatgcctaggctggactttgttgtgttctttaacattgtttaccacatcgctggagctgtgacctactcattatgttctccttttccctaattcgggatgctttattctcctgccatctttctgtctgcagtgtttaattaggcttagtaatgacagctttaactccaaatttctttctcatatgtgttctatttgtaattaccaagtttctaagaatagtctggtaaacttactcagagaattaaggaagatttgaactgaaaggcaccatagagaccatctaggatttgagtgtaaaatgtgcttaaaagaggtataaaattttccaagacgttttcttccttctaggcagaattattggagcctccttgttttaaatatgtaggtaagatttttaattatgaaatcttacccaattgaaaacaagaatgagtcatttatttagtcaggtttttccctggttgatttgttgaacttcccccctacataattaaagtacattttcacaccataaagttaaaatcttttctcctcccatagaatatcctcctttagatatatttacaaactgtctcatttgggaagaccatggagaaatcctagagaaaagaggcaaaaggtcaacttttctagttcttttctgtctaccagtttttcacagttggtgttgaaggctgattggcaatgtttcatttcagttaatgctgtcctttaagaaggaaagcaggaactacatataactctgatactgctaatttaaggtgctttgaagactttaaggcggaataggtatttaaaacttttagaagtttgctgtagaattttctcgtgttcgaatactatatagtggaaattgtacttatttttgtcatcttacaatctatgattgaaggatttatcaagcttgtttgtttgtttgtttgtttgtttttcaggacagggtttctctgtatagccctggctgtcctggaactcgcctttgtagaccaggctggcctcaaactcagaaatccacctgcctccgcctcccgagtgctgggattagaggcgtgcgccagcacgggccggcctggatttattaagcttaatattggcttttgtaattgatcctcctttagtaaatctttctcatttacatgctcttgaatgtccctgcataaagaggtgtgtgtgtatagatgtataataaagtttcagtagctctgagcccttggctttcttaaaatactgtcagcagttcattaactgactcacaagttcataaagtcgaggaatttagtcttgtcattccaaccttcagaactcagtgatttcagtagcattttctatgcttccactatttgctgtgcaatgagttgctatggtggctcattttcttgagccctgttctctgcctgaaataataggttcatgtattaataaatatcttgtgttcatcagttcagctaataactgttataacccatttaaaattaatgtttctagaaaaggcctataaagatggactttagtgccagaaattcctatttggctcaggaaatagtttttgccttgaccttgagagggactgttaccacactgaaagctggacatttcgtctggctctagctctctggtgacattttatgggcaaaggaatgtgttgactcgtacgtaagattggtttgacagtagctgccttgtcctattaaggcaggtagagatgaaacttttaggagtagtggtgacctatttatttattagcaccatagaaagttcatggaaactatctaggttttctaagaaatactacattaagacagctatttatttgatgtccatctgcctttattctcatttgcttgagatctctcagaatagctttaatttggattaagagatgctaaaattcaaggcttaatggaaaaatctggttgaggaggtccagggtcaggcctagaaatatctgattgcattttgagaatagtagaaatattcatttaaagagggcttggagaaagttttcaggtaaacaaatagagactttacaaacataggaataaattaattttctgttattatttagtatatattttgctaacagatactagtttttggtgtgattacaggtaaatctagtggttggaaaatcattgctgtattgaagtgccaaaaccaaaagcctagtagagattgtcactttttatatgaattatatagcctccacacaaatcattttactactgtacagtggtatataatcagacgaggcagacctcctgtctttcagagttgtgtatgtttgtttttagattaatatccagttaaaagtattttccaacttttaaaatggaataccttgacaacaaattatctacttatggattgtaaagcagtataaagttatgccagttttatcctataaataacagttgtttgataaatgtgtgtatctctcaaaaaaacttacatatagtatcatctcagaaacaggagcttaccatgtactgtttatatgttcatttacatatatacgtttctttttgttctatagtgaattacttcattggaagaaaactttttaaagtttttctgaaatggaatatgagttcaattgtgtgtgtgtgtgtgtttgtgtttgtttctgctcctgccttatcttttaaattacagttggggaaatctgatatagaaattaagagttagccaggagttagggttaaccatatcttatgccttaattccagcactcagggagacagaggcagatgatctcagctggcctggtttccttagcaagttccaggcaggccaggcctaagaagtgtgagaccttatctcaaaaagcaacaataacaaaacaagaacaacaaaaaatgaaatcaagggctaactagcatcataaaaacaaaacaaaacaaaacaaaacaaaaaaaacgggtaaaaagggtagctataaagtattaaagtttaaaccaggaagcagtgttagcaaatttttttttatcttgagacagaataaaagacagcatattttagaaactattatagcaataattgtcatttgtctgtctgtgatctttgagagctcaatctgaaaggtagagaactcaaaagatgaggagttgtatgaaaaatccagtggtgattttctgttcagtaattcagtcacacagcttcttttatttttttttaattaggtattttcctcatttacattttcaatgctatnnnnnnnnnnnnnnnnnnnnactccccctttttggccctggcattcccctgtattggggcacataaagtttgcacgtccaatgggcctctctttgcagtgatggccgactaggccatcttttgatacatatgcagctaaagacaagagctcccgggtactggttagttcatattgttgttccacctatagggttgcagttccctttagctccttgggtaatttctctagctcctccattaggggccgtgtgacccatccaatagctgactgtgatcatccacttctgtgtttgctaggccccggcatagtctcacaagagacagctacatctgggtcctttcagcgaaatcttgctagtgtatgcaatggtgtcagcatttggaagctgattatgggatggatccctgcatatggcaatcactagatggtccatcctttcatcacacacagcttcttttaaatgctcactttagaggtaggttttctgctggaagaattttacaagcatattatcaaatagtagtagcccataagaaatgtaattttgcctaagataatattctaattgtgaaagaaatgtgcaaaattgtttttctaatctgttcatatagcatttgtcagtaacaaagatacattgactaatgtcacattatacctttattagaaaacagcattttttccagaacttagccaagaccactgtggacttgggttgtgtgtggtgcagctgtgttctgtcagctacttggtgtctggaaaactgtatggggttggagttgaactactacaaagctttttgtaaggctctctccctgacccccttcccctttagagataccctttctgttaatgaaaaaccaggaagaggaacgaaataaaggaaattatggagcccccatggtgtcataactctttttatatctagtgacatttgtagagaatgttacttgttgctttagtagaaaacattgaaaataacaacagaaagtaagaggtgttctgtccaagggagggccatcatcaaggaatgaaggtgctggcaggagatagaaagaatttgctaggaattgaactgactgccttcttttattttctagtcaggagaatccagtcactttaaggtaggactattaactgtctaagatattctacatatgaagaaaacaagatagtcaagagtacagtccctttcccactgtgatagcaattttttcctgttcgtattgcttgatttttgtttcactttggtgttggtgcttatggttgaacaaagagctgattgattttaatttcaaccttagcatctaaactaggaaccaagccgtttaccaaataaaattgaggctgccaatgaagttttcaaaaacaatggagtgttaagtttaattgtaagagattctttgaagttgttttccttctcatatgtactgcttagtgaaaggcctcctgggcattccacatatttctagaatggagtcactgaaacaaaatttgactcagttatctgtgtctttggggaggggtggagtccaaaccttttttaaagctacagggttctactggaggaggctgattgatggggggaatggtggagttagagaaggcttcctgatgtttctttggggagagcttcttcgggtgaggggataggacagcagggatgcagtgagaagtcacctccttgggttgttgatttccattttcttatagcaaatgatggaagtgtttcccaggcaactgctttaaatgtcataaattcctgatagcagaggaggctttggatattagtcttgtgctcaagtgtgtgtgtgtgtgtgtgtgtgtggtgtgtgtgatgtgtgtggtgtgtgtgtgggtgtgtgtgtgtgtgtatgtgggggtgtgggtgtgtgtgtgtgtgtgggtgtgggtgtgtgtggtgtgtgtgtgggtgtgtgtgtgtgtatgtgggtgtgtgtggtgtgtgtgtgtgtgtgtgtgtgtgtgtgtgtgtgtgtgtattattgcctggtctcagcctctgccttaattcccttgagattgtctctcttcttgaacctggagctcagtatgttttatggctaggctggcagccaacaaatcctggggactctcctgccttccctcctgcagggttagaggcacatgtgtccatgcccagggttttcagagggaggagtggttctgatgagtccaactcaggtcctcatgcttgtacagcaaatggttttactcactgagtaatccccactactgggagcttgatatttctttaagctgaaacttactttggaagattttaaaacaactatcagaacattcatatccacaaagtattatagcatcctaagaataagagaaaacttgcgtagagattagtagtagaggctgggaatatagctaagtgcctaagagactattctttaagtaggtattggtacagtgatatgaagactgtataatgcttatctagtttcggttaccaaaaatatgttccatggtttgcttagggcaagttcctgtggcccttgagacttggtaggcagaactggtctgtttagatttaccaagatcctatatcgaagcttgggccggtctatctatacccttagtagcagtaattttctgctctttgcactgggtgctgtgccagcccttgggatccttggtagtgtctcttcagtgtttagagtgggtggctggatggggaaggccgtttaggttgagcgtacaggactgggtgcttctcagtggggtgagaagtagtccattgagtgtacaggactgggtgcttctcagtggggtgagaagtagtccattgtattatgcagcagctttacttggacggtgagtatggagcggtttgatgcctttttcagttggaggtcgtgtgcagaaaaatcactgagtctaaataaaagagacttgaagtagaataagcaaaagtttattaggacgtgattggcttggctccactctagttgttcattgcagatgaacgcacatttatgtaattcccaattttggaaatattaaaatactagatacaaaagtattaaacgcagaagaattcaacatctgtttagtttatataattgaatgacagtgattgaatagtttctttaaaatgtggttacagtcttagccttttgaataattacaatttgtttggacggattaaataagaaaactagtacacaaatgattgtaaattggtgagaaaattactgctttagtggtttaagattgtcatagacttgtattttattagtctaatgtctcagatgaaaaatatttcaaagaattatcaaaaaaagcatttcaacaagttatctgcagaataattacttggtaaaatctattgaatattgggcctggcaaatttattcaccaactgaaatattttctgacgtgagttttttgtttatattgaaatggtttcgttgcccttacagaccccattattgatattcgtaagtgcattttcctgtgcctcagcctgaattccactttcctgggctggtatctcagaaagcagaatgctgatatttcagagcatatgcagtccattgtgaaatgacactaaagctagtcctttattccatcttcagacttaaagtttctaattttatgtggggtaaaagaggaaatgtgaattatataaacttaaagtataattatgatatcttaaaaattataatacaagtattaaaaatttggttataagctacaaaattttggaaaattattatcatgaaatcaattgtcctcccccctacttccataaaagcatttttttcctttgatttcttccacgtttttcctttgtttcattttatttatttttttatttattcactttacatcctgctcactgccttcctcctggtcacctcctccatcaggccttccctccatgcctcccaccccttttcttctgagcagatgggggccctcttcagtatcctcccactctggtacatcaagtttctgtgggactaggtgcatcttctcccactgaggccagacaaggcagcccagctataagaacataacccacggacagacaacagctcttgggatagttcctactccagttgttcaggacccacatgaagaccacatgtgtgtgtgtggggggggggtggctaggtccagcacttaaggccattttgttctatgatgtgaaattaatattcatgaatgtgatcacagtttcaaaaggagacaatgaagaaacaagataatgagaaaaacaaaaattaaaaaaataagattttggggtggagagatggctcatcggttaagagcagcagttaagaactcagaggtcctgagttcaattcccagcagccacatggtggttcacaggcatctgtaatggaatctgatgccctcttctggagtgtctgaagacagctacagtgtactcacaaaataaattaaaaaactaaattaagattttgagtaatattagataaaagtcaactgaagaccagtaaatcagttttcaagaaaaccagacaacttttgttatttaactttgtgtccaataattccatcaaacttaaagttaatcctttgttttaaaaataccaggaattgctcaggaaggatcctttctaatataaattttaaaatcaatactttgtatttattctttgagaatctcatttatgtgtacaatgtgttttgatcaaatcccctcctacattctaacttcttcagtaccccctcccccatcttcttccacctcatttccataacttgctgactccagttagtactgtccttatatttatgggcatgacccttcactggaatataggcaacctatatggaacagtatagctcctaaactggacatggggccttgtgagcccctccccaatccatgctagaattttgactgtcttgacatgtagccagatctgtgtgagtagccatgccatgtcctgaaggtatgattttacagcatcattctcaaggccttctgttcttcctgcctcttcctctgtgatattcgctgagcctttcctggtgggtgagaggtagatgttccatttagaactgagcacagagctaaattttgatacaaaatcttgggtgctgtttaagtttcttaacattcttaccactgtatgttaattatacaaaataacggaattcattatgattttatatatgtatatatatggtacttcgatcatatttactgtctttttacacacaaatactcacgtttgctggtcttagtcaatagacaatattctataactttttggggggtttgcttgtgtctgttttctaaatattttaaaaacataccctcacaaataaaacataaaacttgtgtttttaccgtattttaacacactccaagctttgttcttaaatagagagtctaggtagaattgtggcctttggagagtttacattgtggaaagagtagctttttaacaggctctgaacccaggctaatcactcttcttgagcactgtcgagttcagaattataggtcccttctcgaaactcaatcttctcccaagtgcatttggttttgtactttttttcgttattcattgtggaactctgtctatgaattagctttaatttgtaagatgcttgcacaatgtagttatggtgagtaattcacactgcttcattcaaattctggcctttttctccctgtgtaagtactttttgacttaaagatgttacaggatgttgttttatagtttaaaaactaagttttactgaaagaaaaaaggcacatgatcatctcattagacaatgaaaaagcctttgacaaaaaaaaacacccaataccccttcacaataaaagtcttggagagatcagagatactagggatgtaactaagcataataaagacaatttagagcaggcctatagctgacatcagattaaatagagaaacttaaagcagttccactaaaatcaggaataagacaaggctatgcccctcttattgattcaatatagtatttgaagttctaactagaagaataaaacaaccaaaagagacaaggggatgcagattggacaggaagaattcataatatcattatttgcagatgatatgatagtatacttaagtgaccctcaaaattctaccaggaaactcttagagctgacaaactcccttcatcaaagtggttagatataagattcccttaaaaaaaaaaaaaaaaaaaaaaggaaaagaaaaaaaaaaaaaaggactgtcctatacacaaacgacaaacaggctgaaaaggaaccagggaaacaacaccttttacaatagccacaataatataaaatatcttagggtaactctaacctggcaagtaaaagacctgtatgataagacttaaagtctttgaagaagaaaatgggagaagatatcagaagatagaaagatttttccatactcatggattaacatagtaaaaatggccatcctagcaaaagcagtctatgaattcagtgcattccccatcaaaattccaacacaattttttagataccttgaaagaacaatgtgcaacttcatttggaaaaacaaaaaacccaggatagctaaaataatcttgtacaataaaagaaattctggaggtatcacaattccttatctcaagctgtttttattagcatagaaacacacatattgatcaacagaattgaagattgacacctatggacacccgatttttgataaagaaagacaaattaatatacaatagaaaaaagggaagcatcttcaaccagaaggtttagctggatgttgatatttacaagagtgcaaagaaaattggcaatcgatcagtctcaagacccagctatactcctggacatcttcctaaaggacgcctagcctatcacaaggacacctgctcaactgtgttcatagcagctgtattcataatagtcagaagctggaaacaacctagttgtccctcaactgacgaatggataaaacaaaatgtgatttgtttacacagtggagtattactcagctgttaacatcatgacatcatgacatttgcaggcaaatggatggaactagaaaattcatcccgagtgaggtaacccaaacccagaaaaaaaatacatggtatatactcacttataagtagatttgaactgtaaagactttaagtcttatcatacaggtcttttacttgataggttagagttaccctaagatattttaaagaaaatcatactacagtccacagacccagagaggccaagcaacaaggagggcttaaggggtgcatggaaaggagctcctagggaaggggaaatgaaagagatttctgcaggtgaagtggggctgagtgggtttgggaacaggaaggatcagatggggaaggcagggagggagagcgatggttgaggagacagcagtttgattgtattctggctgtcctagttactgttgtgttgctgcaaagagataccttgaccagaggaattcttataaaagaagctaattggagcttccttacagtgttagagggttagtccgggttcatcactgtgctagaaccatttgagagatttacaatcctccttcacaggcagcagacagagaaagagactaggcccacccacggtgacacacctactctagcatggacacaccttccagtctttgccaaacagttcagctccctggtgagttagccattcagataaatgaacctattggaagccattctcatttaaatcaccttaccagccataatgagattttaaaaaaatatttggaatgaattttatttcacttgtttcatgttttactgaaggatctaggcagtgcaggaagtctctttctgttttatatattaattattaattaatttgtaaaaatttctgggaattgtggcctaaaagtagagaaacctttcatccacttatctacttctggtataggtaggtttttgattcccttaagtgaatgtaatgtgaaattactttattagtatcattattcagtagacatggaacctgctttaatctaagattagatattaaatatagtttatattatagctaaggttaaaatggaccaaaagaatggtctttatatgacaatatgcagtaaacatgctttctcagctggcattgaggcctgtgtcttccaggcattagagatgcaaacatttgtaatatcaaggttagagtagctatctcctgtttcttcgtgggaagctcagtaaactggttttactgactaatttgtttgtgtttataactgacatgttacttttgctgaatgaatgtaacttagcaggagctttggctctgagaaaacattatgaattttgcaatttacctcactacttccaccctaccatgagtttgtatccatctttctgtcttgtattcttttttttttcttcacaaagataatattttgaactttgaggaattcaaaggctagtgattttgaccaggaactaagatgaaggatataagttattctcctctaagtatttggtggctgtgcaggtagattacaggggaacagagtatagaaactaaaggtaaagagatgtggagagccgtgccgcgagcaattgctgaggagagccatgtgtgcctcgagcaatcgccattataagatggtgctggcctccgctgtgcctaactagtaaacaagccttgtacgcaggcgcgagagtgaactcacgcctagtcactcccattctcggggcgtagtaatggggtgatgggcgagcaacgaatcaggagctgtcacgccacatcaggtgctgaaacgtcacactgccggctatataagcagcgccattttccggttcggggtcttcctgagaagtaagcaataaagcttggccgcagaagattccggttgtcctgagtgtgttcttgccggcgggaacaaaagctcgggataaagagattatacttttccacaggaaaaagcataaatggtgggttataaaagcagagacgctatatgcttaggatatatgacgctatatgctgtgttttcattattctaatcgtcatctaacagtgtttcaaacatactttatatttacaaacagagtgttactttaggttaagattactttaaaaaaaaaaaaaacctccaaaataaatatttgtattcttttaatttggaagtttgtctttcctcttccttttcctagaaacttctctatagcaaaggatctgttagttagtttgttggaacaatgtctcactggttagcactagctggcttagcttgatacatagaccaagttagcctcaagcttgcagcagtcctcttttctatgtgctagaattacatgtgtgagccaccacactctcctaaaaacattcttatttatttatttatttatttgtttgtttgttttttgagacagggtttctctgtgtagccttggctgtcctgaagctcactttgtagaccaggctggcctcgaactcagaaatccgctggcctcgaactcagaaatccgcctgcctctgcctcctgagtgctgggattaaaggcgtgcgctaccacgcccagctttcttaaaacattcttaataattcacttagcttccctttcagtgaaatgcatttattgatgcatgaaaaaaagaagtaagaatgaaaggaaaggacatgattgctcctagatatagtgaaggagaaagtttattatagagatgtgggagagcattgccagggccagacacatctgggaaagttcagagtagtcatgacactgaaccttgtggggagagcgggagggagagaggagaaccaagtatggcagccaggagaccaaaggtacaaaaagggacaggtaaccaaaatgtctgaattatatagggaagagcctctgggggaagagcagctgggttggaaagtatagggtagaaggtgtggtttgtcagccataccgtgtgacatgtagagactgagagatgctaggagaacctgttgaccaggtctgctttgctgtgttaaataggcatctcagcagcttgtcctgggtttgaaacttaacaattgatcttttgctgaacttcagattctgtgatttatagagaaaagacagtgtttcataaaaccctgtctcggtgtttggagagggtgtgatgtggggttggagagtctctttatgtgaaaaactttcaaagcttaagatggaaagtgaaccagtattttcctttttcatttctcatcttgtatgctcatttcatggctagagaactgttgtccatttaaggcctaagcagtgtggtgagtcagtttcctttcctgtgctactgtggggccttctgggggaattggacagagccacagaggcagtccccagccaattagattcggttggttttttttttttttttttttgagacagggtttctctgtgtaaccctagctgtcctggaactcactctgtagaccaggctggcctcgaactcagaaatccacctgcttctgcctcccaagtgctgggattaaaggcgtgcgccaccagtccggctttttttttcttcagcttttaaaacgaaactttctgatattctctagagctgataaaaaggaatgagcgcgtctcacacagcttttgatatggctttatgaaaaggtgtaagaaagtgaagctatgttgtagctgttgatgacaaggccatgaagaggcaaggatgtcagtgatgcaatgaaaagacaagtggaattcattagttgattttgagccaaggtatgaaactatgaattttatccctgactatccaagaagaaaagttagagggcatttttatcctgatgttaatctaatgataaaaatcaatggacactttgagaacacagccaaaacagtaccttatgaaccacaaaaatagtttgtataaattgttgacatgtatattgtgctatgtgatactgcggaaacccattcaccactggattttcctggcgtttctatacagtcctgcctcccttcctcattgtgcttatggagagagtggttatactgaagtagagtagaggcagtataattagtctctttcccctataatgaaatggcacacagtgagtgacttaaacaacagattaatttcttatagttctaaagcttatccaagatcaccaaggcaccagcatagcatagttatatcatagttatatcatagcatagcacagttatatcatagtgagggtttcctcttttgtttgcagataccatcttcttgctgtgttctcgagtggcctgctttttgcagatgttgaataagcaaggaagcttcagtggttttccttcgtataagtccaccctttctgtcaggttgagaacctgttctcttggcctcattaaaccttaattagtagagcacactggtgcacacctgtgatctcagcatttggcatgaggatctctgcaagcatgaggtcagcctgctctaagtagtcagtctcaggccagccagggctaaataagtctctgtttaaacagaaaagagaaaacaaaaaaacttcaggcaatacaattcagttcaaaggagccttcacttgcgctctctctctctctctctctctctctctctctctctctcacacacacacacacacacacacataagaataagggtgctattttgattcattgtcatccttgtttctgtttatgtctatagggtttcaacatgctgctcctttccccgcactcagaattccaactctctgtagtgcacaaattataatttcacttcttagctcctttctggttttttttttttttcccttgaactatcttagtaggattttagtgagttaaagatctccatggctaagtttatttttcttctctacatattctaatatggaaacaggagcggagaattgtagcctttttccacctggcctctttgttcccagaaataatgactctgagacttaattatatatgaataaatgcttaggccataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaggtgatgcttccatatagctcacaagagattctctctccacagattctctctctcctcacgcataatgttctagacctttaagaggaccagagttgaatctcttttttctgtgttttcagacaccacaagttttgccctgagcttaaccaggtcagctaggattatcctgtgagggtaggcatcacctagtatagatagctaatctattgttaccgcgtcaagattataattcctgcttgactggctgtgggaaaaggaggatattcctgtgagctatgagttaatttcatctaaatacctgactggtgttttattagtttaaaatgctggtcaggtataaacagaaacagtttttatcatagaaaggtagacatttttgtctaccttcttttagaacaaatttagtaaacgtttaccatgtaaaacttgcttaagtccgaattactagtttctttctttatatcagcaatacttatgttccaccaaccatatgactatcctacacagactttcgaggccagctaaggttcatttgatcctatccagtaagagaagatggaaagggtattcactccatacattggcttcctgtctaaggatcataaaatatgggtaaatatgttgacacacatggtgtatggttattctgtttctaggactttcatgagtctttgctataggtctgaaagttttcactcacccaattgtatcttggtattttctttttaaactaaaataataaatttgtaagaaacaaattagacctttgtttgtataaactatagtttatactcttgactttttaaagcaaaagctaatgaataatacttctatggcataatttaaaaattttttaaatttggaatctatgactgtttctaaccagtattgatcagtttatacttttattgtcaaggttaagaaatgctcagtagataattaaaaatattcgtcaggcctctgacttgatagttggagacatactataaatatagaataaataatatttgtagcataaataatactttattctatatatctttattaatgtgtctgaagcatgcttgtcagtttaggatctctacagatgttaattgtgttatgatatgataaaatacttgttatttaatctctgaagtttagcttacattatcagtgactgttctaaagctgttttcctttttcttctttctaaaatttgatgatgtgctaaataagccgtgtttagatgtaagcatgtacattctgtagagtatacataggttctgctgacagaactagagtcctataaaagtagtgatgtgcctgtccactctcacccagccatatgaaatacttgatgttatgtttagatagttaaccctttattttgctggttttattgtaaatatcaaaaatacttagacacaggttttgtatggtttctatgtggaaatgaactgaaggtaattatgaaacaaagacctagaattcagcctgtgagtgggtagcaattgtttaagtgcagaagcctcagtggattgaccttcagtgtggttagaatcagagtaccccgttattgcaaacgcttgatttggggtattaaactttctaagcttacagtccaggcaattaacagccataaaatacaaaaaaacttacaatgcatcctttcttttatcccagtcctttgtcattcaaaatctactttttgtcattacaattttgtaattgttttgcaaaaactttaaaattgtttattgaaataaattaattttatataaatgtaaacaaacattaattcttttgggaccggctcccttcacaagaatttatttttaaaaaagtattgagtagcattgcactgtatagccatgccatgatttgtctgttatcagtttacaaacatctcaggaagtcttttgtacacatttgtcattacttcttttggataaatacctaggagtatctgttgttggtgattttttagggatatctgctatttatgttttaagaaatagtcacaagttttaaattagttgtgccactttactgtatatagcatatatacatatacatacatatatatatatatatatatgtacacacatatacatatacaattgttagtcttttaattctagacaatccagtgggtgtacatagtgactgtcttagtttgatttaatttgtatcttctcgagaacattgattttttttttctgatttttaaattttggctactagttcagcttcttttgagaatggctgtttaatcttttgacatttctttaaattagataattttgtgtcttactcaatgataagaattttttagatattctgggtacatgagataatatatgtatttgtacaagtatatgcaacaacagttttctgtatgtatgatgtatatgttcatgtggttgtatgtgtttgtgtgcatatataaataacagcagtaaatgttggcggtcttccttagtaacccttcccatcttattttttgtttcattgagattcttgaacttatatgtttttggtcataattgtagtcttgggctatttctccagataaattttactataatagtttggaactccaatcttcatgtattttagtcaatttggtattgtcctacaggtgttaatatttgtttatgtcttaatatttttttacttggcatgatgagctgtttctctggacaatggcaggccaaagccaaccatctaattgtttgtatcagttattttgccatacttgtaagataagtaatagagacagcaatggaaactaatagattttgctacattgatttttatctattctgcacatagataactcacagatttttctccaatatttttgtttcttcaataaaaaatgctggggccctgattcttttctctttgacaccattccattttgtttttgagactattaacactctgttgctgtgacaaataccacaagcgagagacatcttacagaaggaagggatctttagacttgcagttccagagaagagccactgtggctggtaggtggcaggcagcaagcagcagacatagaggttggaatagaagctgagggctcacatcttgaactgcttgaaaaggtggggagaaggggaagggagagagagagggacggagggttttattctttcattatcaattatatttttatggacttatataccacaaaaagaaaagaatatgatgtatttgaaactagaacagaaatagctttacattgtctttaatgactcatgccatgtagcctttttgcatgttagctttcctcgtaactcagtattaccctttcttgatcttctttctaaatataatactatacccagactcagttaccttatgtaacatcctttcacacgggccttaaatttgtcttctgaaactcctttcagtgtaagtaagctacatgacccctctagttctcagatactatagattcatgaacagacaacagaagcaaaactccattaaggttttaggccatagtctccggaaaggtagaacagaaggaaaaaaccttttggaagacattctcattcaaatcaccacagatactgttcaggtttgttttattattgttggttttttttttttcctcctccttcactttagattttcttttcaattaaaaattttctcctgaaactttcattttcatttatctcaacccattttacgtttatttcagagcagtgttataacaacaggttatagaagctgaaagttctatctagtcttgaatgccttgtatatggaaaatgaacattttcttaatactttgtatgtaaagtacttttggcttgtgacttttaggttattaatgttatggagcgtagattcagtatctgtcttagtcctctggataatactttcttttaacagacattcaacttgctagggttcagctcttaaaacctgtttcactttggtggacagcagttccaggatcagtcctgttctcctagcctttgcataataatgcttagtaaacacttcccggttctgatcctggcacctggtggtaaattaggttactagttaaagggagttaaagtttcaggtaggagttactgttgtgtcgggtgtggtggtatacacctacaatgcctgcatttaggaggcaagctaaaactgcatagtgaaacacttgtttccaaaaattaataaataaacacaaaatgaaattttttgtcatcgaatcttaaagagattatccaggattagccatttgagccctttgaagtcaaaatttgttaatatcatatagtatgacaatgattcagttggcctttgctggatgcaaacagtttctaggatatggaaaagataaggagatgagttcttccaagagctttcaggggaatcatagcactgttaacaactgatttggcctcagcgagtcccattgtggacttcttgcatctagaacttttgagaattaatttgtgttgttatagtaagcttttcaggtttgtggcaagtgttgtagcagttatgacttaaatgtaatattttccataggctcatatgtttgaacacttgatcccagttggtggaagatactgaaccttatggacatggtaatggatagtggttggctattaggagtgagactttgggattataggctggcccttgcttccaggtctgctctctgcatcctttctgccatgacataaacaatgtgctccagttcccactgttaacagctacacacccttgagtgataatcctttctgctcatgatcagctaccttctggacagtgtgccaaagacaatgctctgttgtttctgtcagctatgtttgtcacaatggtaagaatagcaactactgtaagcagaaatagacaccaatgcacactgctaccttgcagctttgatctgtatgtatgtatatatgcatgtatgtatgtatgtttatatgcatgtatgtatatatgtatatatctccctattgcccccctctctagttctctggtggttgttctgtaatttttgtaagttcatagaaaaatatctctaggttcatagaacaattcttttccctctggcattctctcaacactgtagcctgcagggctacttttcctggttctcgtacacagaaatatcaggctggctcaatgaaattttacctaattggcaccagcacactatttgtgactaaagcctgccctaagggtagaatggtcaaaggaaagagaacagtattaagatagacactaatcctcgtgtagactgctttgccaagtgttttctccattatctcctgtaaggcaaagtgaactgtggacagctatgaagtaatctgaggacaaagcatgtcgagaccttagtcgtttttgccagtgtcttagagttgtctctaacctaattcaagaatagttttaggacactccctttattgaactttgccagagatttccacccaacttgtcagaataaatctctttatgtttcataagctagttgaattacctaatagctatagcatgactgaaaatatcacttctgactttgggtaatgcccccacacactgccctctaccataagaggagagctgacctgctgcaaatgtggatatgctgtgcatagaagtttactaatttccattgccaccatgacaaatgatcacagattagatagaaaataaagtacaaaattgttctcctacaactctgtaggccaaatgcatgacctgtcttagccgggtgttgctagtaaacactctgtgggctctgggtaggaactatggcctttagtttcccagcttctaaaggccacttacattcttttgctcctactccctcttttcatcttcaaagctgcaaaaggcaagccatgcccttttttatataactgtaccctgatctatccacctctcgccttcactaaggactgatttaattatgttgagcccagagttgtttctgctaatggcattccatttttcttcatgattattatacagttaattgaaccatgtcctatgtcttgttgaggtttctatgtacagaattgaagaagagatatgagtggtattattgtgatttggtttatgtgacactaatacttgagcattggtcacttcacccaagtggccatactataatggtactcacttagtttagttatttgctgaaatcttcactttaacttttgataatatatagagtttgggttttttgtttgttttgttgttgctgttggattgctttatttttggtttggggatggtactaggagtcaaagccaggaattgtgcctgaacctagatagaaatctgagaagacagaaaatttctggtgataggaatttcctctgtatttaaaaccacaaactttataaatgtcttaaatggtaataaatagtaataaacatatatcttaatctaacctatttcttttaaatattattataactcagagactgcatagtcaaagaactgcttgttacctaatattctaaatcataaccaagttataaatcccctgaaaaatacaactatagtaaaattaagtactgtgaaaaaaaagagtctaaactaaaacctaaaataaaggaaaaaaaaaaaccaacaaaaacaactctgctgggcacggtgattcataccaatattctcagcactagcagtctttgccaaggccaaagccttgagcaatcgtactggattgaggccagccatgggtgagctgaaagccagcctgagccaagagtgaaatcctgtctaaagaaaactaaacagcaaaattcagtgcagcatgatttgctataaactttatgttgttaattagaacgaggcatatgagacaagttggccaatttctgaggtttggctgagaagcaccagtgcctgggtaagtttgcttttcagacggaacactgagttctgtgtctttaaaattaacagtgcagtcattgattgccctccagccccagtgatgaccatatgttcagaacagtacttttaagaaatggaaaatagttaagcatgttttaaagatcttataaagacatttaagaattttgtggaagttttttccacttagaaaaaattgaagtacagtctcccccagatacttatttactgtaccaggggtcactcaacaagtagaacaggggaaaaggaaacaacagatacagttttcccaaaagcatcaaccctgataaaatgagagttctctaaagatatgacctccccacccatcatgtttagactgttttgtatgagatttgtattgaactttgttgcttagttttcactggtaagtttgactcttactgttatttttatctttctgattagattttaagaatttatgttagtaccaaagtatgaaaattcattaaaatatgagttcccattgcttttttttaaggggggggataagaatatctcaaacagagttggaacctgtaatatcagcaaacttgcttctcttctcttcttggacacttttaaggtatcctattatttgaagataattattttgaaaaacatttgtggtgcaaaaccaaatgactgctctgaggttgcttaaccatttcctgtgactctgagaaactggctgctttcagaatcactgtgctgagtctcgggtgcagtgaactatttcactctcatcttcctgtaaagtttacccacacacatacatattacacacacacatacacatattacacacatacacacatacatattacacacacacatattacacacacacacacacacacaccaacaactaaagaaaaagaggctaggaatttgaaagagagttgagggtgatacataggaaggtttggagggaataatgggaaggggagaataatgtaattataatctcaaaaataaaaataattatttataaaaatatgttttgtttctgtaattcttagcaaatatccttcaacaaatgtaattgttttatgcatgaaattcttagggctctctttgaaggtatagttaagatgcaaatggttgtttttttttataacagcacttagttttttaacaacaaacttgaagtgttagtacgggagacactgggatatttcttttttccttcctttcttttctttctttgttttctcttctttttcttatcctcctcctcctgctcttcttcctcttccccctcctcctcctttttttttttttttaaagacagtgtctttctatatacccccacccccaagctgtcctggaatttactaggtaggccaggctagcctcaaactcagagatctgcctgcctctgcctttgcctcccaagtgctggggttagagatgtgtgccaccatactcaactctatctcttaattttaatgagagagggagaaagtccatcttgctgtttctgtttggttagtgaatttagtggacaacataaagaaacatttttgaatatctatgactaagaaatgagatgttatataaattctggtagggcctggagagatggttcagcggttaagagcactgaccacttttccagaggttctgagttcaatttcaagcaactacttggtggctcacaactgtctgtaatgggatccactgccgacagctatagtgtactcacatacataaaataaataaataaacaaacaaacaaataaataaatatttttaaaattctggtaatagtatatgatgctaatcattaagaacttgttatgtagtaggttgtattctgaacgctttatggcttatataacttagtgaggtgggtagttctttccagtgattttatatattgtatattttatgtatgtgtgtgtgtgtgtgtgtgtgagagagagagagagagagagagagagagagagagagtattatcttcctccctccaacatagataatgttattggtactgcttacagatgagcaaactgagcttgaagggttacccagggttacataggaggtagcagaatgcctggttcctgagaagttcttaactgttctaatgacaaatgttctgttttttttttttccttatgtttctgaactgagtctgaagtatcagtaaggccctgatgttactcagtgtattgcaatctaagatattccatggaactgtagatctgatatgtacaatgtggtttaagtttggtcttaggagataaattattttgtgagaataattcagaggcatgttgctcactggtagaacttgagtccctcagaaaatatgatcactgaaatattggtggttatactatataagaagtaaggggttatatgttattttgtgaacgtttcacaaaatttatgacttaaaacaacaaccattttatttgctaattgttttttttaattattctctatttttttttaacagtctagactttatccctggtccaccgtctgactgtcctacatctcacaccttttcctcccatctccaagaggttgtccccactttaccccccctccccactccactagacctcccaactttctggggttaggtgcatcttctctgacttgagtgcagacctggcagtcctctactgtacatgtgctgggggcctcgtatcagctggtgtatgctacctggttggtggatcagtgtctgagagatcctagggattcatgttagttgagattgctggtcttcctataggatccctctcctcctcagcttcttccagcttttccctaattcaaccacagaagccaccagcttctgtccattggttaggtgtaaatatctgcatctgactctttcagctgcttgtcgggccttttggagggcagtcatgataggctcctgtttgtaagcacaccatggcatcactaatagtgtcagaccttggggcccccttgagctggatcccaatttgggcctgtcgctgcacctcctttgcctcaggctcttcaacatttttgtccctgcagttttctgagacaagaacaattctggtcagagtttttgctaattgttctttaggtcaataatttgaattaggtttaggtgaacgtgtcttctttctcgcctgaagttacttaagagcagtcattgtctgttgcgcctctaagatagctttactcatgcgtctggcagtggatgctggctgttggctgtatgtttttaatgtggttacccacccacaaggaagctagcttggattttctctaacagcgctgttagagtaataatgaatagtaaagtttacacagcctaccaaggcccagcattaaatattctggcaaacctttttgcttcatttcattgattaaaccaagttacaaggacagtagaaatttacatagtaaaggtaaaattacacttcctaagacgaggtccctggtatccaagtttcctgatttctttctaggctgacaatttatgtctttttattaactttctatctttctctctttctctctttctttctttctttctttctttctttctttctttctttctttctttcttccttccttccttccttccttccttccttccttccttcctttctttcttttctttgtttttttgagacagggtttctctgtatagccttggttgtcctggaactcactttgaagaccaggctggcctcgaactcagaaatccacctgctttctttctatattagcatatttaaaacattatttgtgggctggagagatggctcagtggttaagagcactgacagttctaccaaaggtcccgagtttaaattctggcaaccacatgatggctcacaaccatttataatgagatctgatgccctcttctggtgtgtctgaaaacagctacagtgtacttacatataataaataaataaatctttaaaacatttgtatatgtgtgaaagtttattccacttacatataaaaggaaaatcgggtaataaaaatacccagcataaccaaaccccatctcttaggaataatcactgtttatgtatgtttttgtctacgttgtatcctattgggtcaagttgatttaaatttctgtaacatacttttctttctttaaaccttatttattatttattcagatacctttctgcatttgaggtaaatatatattatctatataatactgtattaaatatgaacatactcatctgctactctaccaaaggttaatagatttctggcaacttgtttcttagtgtggtattggaaggtgatggaacctttaagaagtaggtctttggaaggtgatcgagggcaccgtccttgaaggaaataatgtatttttcctggaaccctgagttagcagtgcagagagggttgttacagaaccagacacttccttgctttggctggcttcctgtcttccctgtgttgctgccattttgatgttatccagcatgaggtgattcacataatcagagctacatgctctctggattcagcaagatacaaaactgttagctaagtatatcacttttctttataagtaccccaaatattaatagtaagaataaataggtagaatataaatcatttaccatttttttgctttataaaaagaatacagcaataaacattcacttaaatttttttattacatttacttattgtctgttggacatttacttattgtctgttggttggagcttcatgtggaagtcagagaacagctgtgtcaattggtttggttcagtccctctaccatgtgggacgcaaggagcaaactcaggtcatcaggtttggttgcaagtgccttcactactgagttacctcaccagcctctagatgtattttaaaagtttacttactatcattttgtttgtgtgaaagtgtgagcattgcgtatgatatgtgtgtgaatgcagctgggcatgcaccccagtgtcagtgtggagtttagaggacaggttgaggactcactgatgatctctgtcctctactgaggcagactctgttgggctgtgtagtataggctagctgacccaccagcttctggtagatttatctacctgccacagatgtgccactgtacccatctttttgtacccactgaatcctataggttctggggattaaccaggttggcatgcttgttcagcaagcattattacacactgagccagccatcttggaggctttttaaaagttatgtatcatttctttgtgtgtttgtaatgtatagccctgtgtaattgatacttttctttggtggacttggtgaaaaacattttagaccttgataggtattgatgagatgaatttaagaatcctctggtataagctcatcaataggtgtaacttagccaagctgagttttttgtgttgagagcatgttaaagagaagttttgaaaagctagtgaaactttaccctttcttagaaatgggaacaaaacactcatagaaggagttacagagacaaaatttggagctgtgacgaaaggatggaccatctagtgattgccatatgcagggatccatcccataatcagcttccaaatgctgacaccattgcatacactagcaagatttcactgaaaggacccagatatagctctctcttgtgagactatgccggggcctagcaaacacagaagtagatgatcacagtcagctattggatggatcacagggctcccaatggaggagctagagaaagtagccaaggagctaaagggatctgcaaccctataggtggaacaacaatatgaactaaccagtacccgggagctcttgtctttagctgcatatgtatcaaaagatggcctagtcggccatcactgcaaagagaggcccattggacttgcaaactttatatgtcccagtacaggggaacgccagggccaaaaagggggagtgggtgggtaggggattggggtgcggggtgggtatgggggacctttgggatagcattgaaaatgtaaacaaagaaaatacctaatttaaaaaagaaagaaagaaagaaaagctagtgaaaatgtaaattataaagaaaaaaatcttctcttaacattttatttatagattaaaatatacagacatagttgctatgttggctaattggctaaactttcgttttgtatatggatctgttggtggctgtttgtccaggaagagaactttcttcctttttctataggaaattattttttcattttttttctcttctgtcagtttctgttaaggactgcaatatgctgcttatgtttcttgcctctatccttgattttttatgttcactttgtagagcttccagacacggattctttgtgtcctgcagttctcttacagactttctttttttcatctcaaatgctttccaacattggtgcttaaaacatgtttcgtagctgcaaagttaaaccaactaggaattcatctttgtgtttctctctctagtatagaagtattaatttttgcccatagtgtacaaaactacagaaaatagaaattgtaaataggctcttcatataatacaatagttaatttgcaaatggtagaaactttattgaatcaatatatcagattggtaaattatacttggtgtctgtgtaatgtttccctataggttattttaatcagaaaagtctgaaaagtaggtaaagtttaattgtcttcttacaaattacagttgtaaaactacagctgcaaattacctgtttagttgtgtaaaggcaaatgagcttagctttaggtacacctgatccctagggttttttgtttgtttgtttgttttgtttttgttttttttttttttaactgtagctgtcttcagacacaccagaagaggacatcagatcccattacagatggttgtgagccaccatgtggttgctgggatttgaactcaggacctttggaagagcagtcagtgctcttaaccactgaattatctctccagcccatataaaataaataacacattaaataaacaaataaataaataaaacataaaataaataagtaaatctttaccaaaaaaaaaagatttggtattagaaggagcttgctattgtcataattacgatgtgatctctatcaggccccaagtatcagtaaatctaggttcagtcttcgaaaaattaatgcatagacatgtgtcaccttcaataattatgacttaattttaatgtgttgggtgctacttttatttcaggtgttattgcaggcttctcctcttttgggcacagcatttaacaaggcaaatgacctgactctttccctcaaagaattatctgtgagtgaagcaaaatgtttaagtacagttcacatagaaaaacttcctgttctacagagtaaactagtccttggaattttattaattttacttccttcaatttttaaagtatgctcattatgctagaactaaatacagtgtagacttggaacttatattctgccctaaactctaaaagtttaaatctaaaccctaaacttgccatatagacaagttccctgtacagtttccagtgtcccagtttgacaggtggtttgtggtgtgaattgtggggagggaggtgactcatgattctggaatgaatcttttgactctccctgtatcctccatagaacactgggaggactgcgggtataattagcactgcacatctaattataaacaaaactccatgtacagtggttaccaggaagtaagcccgtgctggataatctttcaagttggcaggactaatttaaaataataatgtggtgtttactaaaagtcaagttgcttttccttgattgagcagaaggtttactgtaaaggtaaagtggattatgtgacagtactatctatggaaatcatggttatcaacttctagggcctataacagttctttgccatagtatttatacccttttcttcctatgaactatgtattttgtattttatgctatgctcatttaggcagtagaagagaactggtcacagaaagaaattctacagttagttggattgatttttaaaaggaaccagagatatgaaaaaaatattggactggtataactgctgaagaaggacgatttatggtatgaggagagtaagagctggagtaggaagcgaggaggggctgtggcagccatgcaccctgcagagaccttcagagaaatcaatgtctggaacacctatggtctcagagtccatcgagtggatgagcactgtgcatggcatgtgcttcgtgaaattctaaaagttcagctgaaacaagatctgatttagttagcttatgtatcagcttggacagtgtgtctctaagattcagagcaaagatactagctatggagattattacacatagctgtatcctaaacttctgtgtaggatggtcatatatttgcaaaatgggcctaagagttgtggttaccaaatgaagtaagaattttaaagcagatgcatacaaaggagcctgtcttagttagggtattactgctgtgaacagacaccatgaccaaggcaagtcttacaaaaaacatttacttggggattacaggttcagaggttcagtccattatcaaggtgggagcatggcattatccaggcaggcatgatgcaggaggagctgagagttctacgtcttcatccaaagacggctagtggaagactgacttccaggcaactagggtgaggatcttaagcccacacccacagtgacacacctactccaaccaggtcacacctattccaacgaggccacacctccaaatggtgccactccctggcccaaaaatatacaaaccatcacaaagtccctttcacttttcatattcaaaactatccagttaaaatttttaaatgtactggaacacagtttccttttacggaataaaaagttacaaaagttaaaatacagagatagatggagagagtgggagataggagggtgggaggtgtactttcttggcttgggtgtatggcagtgccactagctggttctggttgccagatgctttgagagaagggcaaatgctgtctctgacctagaacttctgatttgccttgttgctgcacagtatttgagatgtttggacttttaggtcagtttgtaggatttagaagcaaagccctgcctaccttacccctcagtggcaatttgctctgacttcctgttgttttctgtttggtatttcaccggtttctgctctttctttatttcctcttctaattactaatatttgatttactaggttttttgagctccttggaatgaaaagttctgttaactagttttgaacatttttctaggcattaaaaaaaaactaggaattttatgcttttattgtttgctttaaatgttttctaaattccttgtggtatctttgacaagtgattgtttggaattttatttttccaaatatctagaaatttgctgcttgagtttttgtttccattataagatgtagcttagtggtagagcttttgcttatttagcatttatgaggttctgtgtttaatccctaacaccaccgccaccaccaccaccaccactactgtttccaccagcaataataccaagtatatagatttctgaaatgtactgatacttattttattccatcttgctaagtggttcatgtgtattctgcatttgtttgcctcaaagttctgtagaattagctcagtagatgtctgtcttagtcagggtttctattcctgcacaaacatcatgaccaagaagcaagttggggaggaaagggtttattcggcttacacttccatactgctgttcatcaccaaggaagtcaggactggaactcaggcaggtcaggaagcaggagctgatgcagaggccatggagggatgttctttactggcttgcttcacctggcttgctcagtctgctctcttatagaaccaagactaccaacccagagatggccccacccacaaggggcctttcccccttgatcactaattgagaaaatgccttacagctggatctcatggaggcatttcctcaactgaagctcctttcactgtgataactccagctgtgtcaagttgacacagaactagccagcacagtgtcagttgagtagaattagctaatagccctgtgactatacttctgtgacctgtcttcttgccctgtgaattatatagtgatagactcttcagccatgatgattgataattcttttgctgtttgaatttcattttcctgatggatttgggaactctgtatttaagtatacacataactaagaagggcatgtaacattattgaattttaagattataaaatttctatgcagttaacttgtcagtgtctttaaatttaaaatatgccttaccaacagcatttagttgaatttagttccaaatttaatgtttaaaagtagcttaattgtatatgaggttgagcttaccattttatcatattttaatttaccctttacttttgtttcttatattgcattttttcctcttatttctcttacattgtatcttttgggtcaatgagcatttttttagtaacttattttctctctttagtattttctaattttttattttatattatctaattttagtattttatattttttgctaactatacatctcatggatttttttccagttttgtgtggccaataggattcatttttaacttactgaagtctatgtacagagtacattgaataacttcacattttacatttaaccctttttgtttcctgcttcttttcttgaaataactcatttgtcctcctcatttcacacttgaattcttattcagcttcttccacatttctgccatcaccccacttcttttcccaacatccctcttgtagcttttgtttacatagtttacaaatatctacaatgttatttcttactttaaacattttctttaaggaaattatggacaaatgttatttcttccttccgagatatctgataggtctgatattatttttgttcattttaagacgactgctctaaaagtcttcttatagtatataattgcttgagatgaattttgtcagcttttatctatgttgaaagtgcttacacactatccttgtttctgaaggatgttgtaactgtggatgggatgcaaagttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctctccctctccctctccctctccctctccctctccctctccctctgtgtgtgtgtgtgtgttagatgaagcagatgtgtacatatgggcatgtacagaggccagaggaagatgctgtgtgtcccctgttgcttcctaccttgttcctttcagacaaggtccttcattgacctgatgcccacagtttttgctaggctcagcctgtcttctcttcctagtgctggggttacaggaatgtgagtgacagccacctattttacttgggtactggagatttaaacccaggtcttcatgtttttgtagcaagtattcttacccattgaccatttccctgtcctctggtcccttttatatagtttcagtttttctggtaaaattctgtctgttcacatagaattatgttttactttttaaagcccctttcctttatgttttgggacatatttacagtagctgcattaaaagttaagtgtagcaactgacttttgatttcttatgagtaatattttcttgtgtaattgaatgaccagtgattttctaattacatttggacaatactgaagaaatagtgtagagggtttgtttgtttgtttgtttgtcttttgttttgttttttccctcttggagtgttggtattttaaaggaagcttaatttctgatcacctggttataggcttggttttatccttggacgattctcaggtcttgctacctgctcaagactcattttcaaattatttttcttttgtggatttccatagggcttatacagtcgaccttacttgagaatgtgacttctgttccccagtgtttcaaattgatgccagaggtattaccgggttcttgctgggcctcggttgtactgttggcacttccctacattgcttgacctctggtacttctgtttcctttcagggatattgttccctctctattatgggcctgtgctgctgtgtgctgcatttgacaaaggactctcaggaagttctgcacaagcctatgtggccccttgcacttggctccttttctctcttgctacagtctttgtatgcccgtcctgttctctttggactccagcttgccattctgctattagaaaatggtcccaaggcagagaagtagagttatttggggctcagtactatgtagaataaaggtcacagttttgtcatttagatagagaaagaattcaccaagaaaggaaaatgcagaagtagaccttattagctatactgtggtagactgcagtggacaagacagcaaagagaaactgtctagaggcacttcaagggactgctttttacggaagtgaggtttctggtgggcagtcaagcagtggttcaacggcagtgttctgaaacacctgcagtaggggcttatagtagttatcaacagtctggcctggaggcagtgatggtcttgccctgagtcagaaatggatcaatataattacctgtcctaaatttatatccatatccacttcttttttcttttagaggtcacattcttgatttgtctgttgtctaatatgtgaaaatacttgtatcatttgtgcagatgattaggtataatcgtgtactaaattaactaaactaaaactgcataataccgcccggcgtggtggcacacacctttaatcccagcactcgggaggcagagacaggcagatttctgagttcgaggccagcctggtctacaaagtgagttccaggacaaccagggctatacagagaaaccctgtctcaaaaaacccccaaaaaactaaaacaaaactgcataatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccttggcctcttattatatcctcctgcttctgaactcaggtagtcacgatttgtttcttatttgttttaatttttgtctatttttctattttaattgtggtaaaatacacatttttttttcctcttaaggcctgggctggtaagcatagggctatgtgaatacttcatctgtaccctgttcgtgagtcagagctctctgatcctcttttgggacctgtcttttattactctcctcagatatctttgccttttccattcttgcatgttgtgctgggcgtctagacttgtatctcctttcacagagtttactgaggttgtctgtgagtctccactgggatgtgatgtttctcagtcttcacttccagccctccaggctcagtcatgatcatcttcctgggttcttgtctcccttgagtcctctgagatgctgtccctgtgtttccctcagcacttcctccacctcctcattttattttccttatttttcctttcccgtaccaaatcatgtttaagttgctgcttccaccttaaacacacactaacaaaaacaaaggatttcactttcctacctacaccatatatatttttaaacattatgcctgtgcttttcttcaataaatagcctgtaccttgctcattgtttccttgggaaattggaatatggcttgcattcccatcttcccaccaagagcccatcttgccaaagttcctaaatttttagttgccaaatacagggactggggagcggggggagatttctagccctagttttacctggtcttttacatacatatactgtcagtcctattccatataaaaccatgtgaaaaccattggtttcggcatgctcttctccggatttgctcatctgttctatcttactttcctgggctgtccatcttcctctacccccacttagaaactgatactctctgacttgcttccctttcggtggtttcagctactgtatgacttaaattatgatttagtattttaatcatctgtctgcattgttcttttaagcccaagacttgctaccatagtcctaatgcaatcttataaaatcatggtgtctacatttttggtaggagacttgagactaaaagaataagtctataagagccaagattcaaacattcatctgaaaatgaaactgtaacctctattttatgctgctagttaaacatttttaagcagctatctggcaaacattaaatatatcatggtccatgtgctgtgcttactgctttctttcatagggtggggcagagagggtcagaaagaaatgaagaaaactgcagaaagacaaacttgaaaacccgtattcttaatcttggggtctgatttcccttcctttcattttcctggccaacatgaatttgtaggacttgatagttgcgaattaaatcatgcctttactgtttatatatgtgctcgtaaaacttcactttctttttggtttcttttattttttgaaaggggagggaattgatatagaaatttggtgtttttttaaaagaaggaataagcccaataccagtatagagtaaccttataatcatgctaaaatcaaattgtattgatgtaagattcaagacatttcaaaaacaaacaaaccaggtttaaagtgatgtcttttgactggcctgtattaaaagtaggttccatcaggttggtatttagataaagatgattatatagatcaaaactgtgttcttctaatattcagtaaaatatagcagttagtttggtgtgctttactactggatgggtaacgttttatgtaaatattaatttgatgaggtttaattataaaaataagttatttgcattttggcagagtgctgactggccaattcttaaatttgatgaagacagggcaaataatcaactgttgaatattccttggctttaaacaggtcatggctaaacagtcttttttttttttttttttatgtcaacttgtcccaaggtatggtcatatggaaagaaagaatcataatcaaaaaaatgcctccatgggagtgggcagtaggcaagtctgtagggtattttctgattgatgattgatatgagagggcccattgtggctagtgctaccctgggcaggtggttctaaaataactgaacaagcccggaagatggagccagtgagcagcactcttccattgtctctcctttcgggtttctgctctgacttctctcagtgatggagacctcagagttgtaagataaacaccttccttcccaagttcctttaaatgtggtgttttatcacagcaatagaaaccttaggacagcattcagactcaaaaagttctgatggatcctagtagatgagtggtgatgccctaatattaagcactaatattacccaataagagacttttactgaataagtcatgctgactcgagctcatgattgcatctagcatagggtgagcaagatgcttaaggggcataattttatctctcataggagtgcaaacacatcagaaaggttaagaatttattaagggcttacaaacaattttgaataatatttcagtgtgagattgcatgaatgaaatgacccttttggtggaatgagtaagaagtgacacccacgggcttccctatttgaacattcagtccccgtatggtggtgctctttgggtggttatggaacctttatgagattgaaccttgctggagaaagaatatcactgtgggatgctttgagtttatagcctcatcccacttcctgctccctttctctttctcttcctttttctgtaggcatgtcatacataattaccagctaaaggagactcaaccctctggatcccaagccaaaaaccccaaccatttcttcaaattgattttgttcttgatgttgatcacaacattagagcagtaattaataaaccccaaaatatctattgaaaccaaccatcacaaggcaatgggaacaatattggaagtttagaaaattaaattctttaaaaaaaaaaaaaaacaaaaaacaaaaaaaacaaaaccaagatattgtaactactgttctctacacataccattgacagggaatgggcaggtggctacttgctaaatccacacctataaatgagtagaaattttattcaaatagatctttttattttttaatttattaatcattctatttgtttacatttcaaatattacccccttccacgaaccccctaccttatccccctcccctttgtctctaagagggtgctctcctacccacatactcacgcccgtgtcacccctctagcatcccccttctttagggcatcaagcctcgacaaaaccaaatgcctcccttcccactgatggcagataagatagtcctctggtacatatatagctagagccatggacccgcccatgtatactctttggttgatggtttagtgtctgggagctctgaggggttctgttaattgatactgttgttcttcctggagttgcaatccccttcaggtccttctgcccttcccctaactcttccattggtgtcccggggctcagtccaatgcttagctgtcagtatctgcatctgtcttagtcagatgctagcagaggctctcagaggatggccataccagactcttgtctacaagcacaacttggcatcagcaatagtgtcagtgtttgctgtctgcagatgagatggaacccatggtagagtggtctctggttggtttttccttcagtctctgcttcatttttgtctctgccttttctttagacagaaccaaatgcctcccgttagacagggacaattctggattaaaaattttgagatgggtgggtggccccatccctccactgagggtcgtgcctatctactggaggtcatctcttcaggttctgtctccctgctgttgggtattttggtttatgtcatcccctttgggtcatggaagcctctctcatccctggaggctgggactttttctagtggctccccaagttcaccatccctcccccacacacacacacacccgctacttatttctactagttctcctggctctctggacttctatctcttcccatacctggtcctgctcccctcccccttttttctctccccttcccttctcccatccatagttgagtaataatactccatttgtagtagtactccattttcaaaatgtgtataaatgtaccacattttctgtatccattcgtctgttgagggacatctgggttctttcgagcttctggctattataaatatggctgctataaacacagtggagcatgtgtccttgttatatgttatatgttatatgttatatgttatatgagcatcttttggcccaggagtggtatagctgagtcttcaggtagaactatttccagttttctgaggaaacaccagattgatttccagagtggttgtatcagtttgcaatcccaccagcaatggaggagtgttcctctttctccacatcttcaccagaatcagctaagtttttgatcctagtcattctgattggtgtaaggtagaatctcagggttagttttgattggcatttccctgatgactaaggaggttgagtattgaatgtcctaatttctttaggtacttctcggtagcataatttttaccaatttcataatggagaagtagaaaatggttggccatcttactctagtttcttttctctctaaatcagaagtgcacaaaagtacgaatgacagttaactcttaaaaggaaatgagttctcttgacaatgttctagtgagtttagttacacaataacagatatgtactagactgaatgaaggaagaggaaatcatgacatccaggcagaggaactaagtaaaaaaaggcctgccggggagagatttcactgacttgttctcagggtaagacagtctgctatggtctgagcacatctaggaatagtgtggttggtgcctgtagaattccatcaatgcttctgacatgcatgcagatcactgggtaatctcctgaaattcctgcctggaagggaaggagtctgcttttgtaagaaggtgtgacgtaatacgggtactgtggtcttcattctgtactttgagtagcagttgtaaactttactctaatatgagtagtgtgcatttattttgtgagttatgagttaccactgtttattctttattgagcactatgttttcctgtatattaagtaatgtcagttatgttctaatgtcagttataatgaaataatatttttaatttcattaccagataccaaattgttaaaagctcttccctttcattaaattaacatgagtcagaagatgcattacattaatgagaagattaaaatttgaataaattgttttagatctgggttgaaatgtacaattaaatacctgtctaactttaagattaaattaatccatttatgtttgtttttttcatgccttaaatttaattttgttactttatagaactcttgtgaagattagaattaactgtaaagtaccttgtgagaacaaattaaagatgatttcaatttgttaaactcttgaaatcccttaaaagctgtgatttttaatgtaaaatattgactgtcctaattctgagttattgagagatatgtagtattattttccctttgcttcttccgacctttcttcagtgattcttgacaagtatgaggggggcgggttatagcttagaaagcccccactacgtccctgccttaagatatgctgacactcgtggtgtttgttctcttttaaagatggaaactgctgttcttgtgaatgctacaggagggtgaaaaagcaggtgtttgaactgtagttgacctgttttttaagttttttgtctgtgatactgtttcttgcttaccaaaacttcataagttattttctgcttttattttgcattgggccagaaacatccttctcttgtgtgtgtgtgtgtgtgtgtgtgtgtgtatacacatttaaaaaaaaaatcagtgtgattccatagtcgtttccttaccacagtcctgcccgccatcttacccaagcaatcgcccgttctcttgaggagctcccttttaagcctagaagcaggcagaccagtttatgatttgcctgagggagaatgggtcacaggaaagagacccacaacctggttttatagtatttggccaagaattataggtgtccagacccagaagtaagacattgagtgtcgtcctttcctttcggccccacttagtcctagctgtttagggacaaactcagttagagatggccaagtaatatcttctaaagtcaagccagggacccagaaggttgggtaggactgtattaaggaaaatactatgaaatcacagctgttttaaaaaattaatatactttaattattaaaagaaaacaaattcaagtcaaatatattttgcataccaaaatgatccaggcctcaagcctttatacagctcagtaagcttcaatagaggtacagtcaccaaccttttccaccattggatatatttttatgcactcagtgactaccaacaatgagaaatcaatgatagactagaactagaaaaacaattagctttataccctcttaatagtttttattttgttgttgttagttttggttcgcgattgtgattgtagtgtgcttttttaaatatatgcttgggtttataatgagtaattcaagaataccataaaacctttatttaattcaaatagcattgaaatggaaaaaagtcttagtgtttaaaaaaaatcctcaagtgattagaaatgcactaaatttggtgttttcaagaaacattatcttatgagctctcccctacttctatcttatctttatttcttaattttgtagatcggcttcagcttccaaggaatatgatcgaaaacagcatgtttgaagaagagccagatgtggtagatttagccaaagaaccttgtttacatcctctggaacccgatgaagtggaatatgagccccgaggttcgaggcttctggtgcgaggtcttggtgagcatgagatggacgaggatgaagaggattatgagtcctctgcgaagctgctgggcatgtccttcatgaacagaagctcaggcctgcggaacagtgcagcaggctacaggcagagtccagatgggacttgttcattaccctctgccaggaccttagtgatctgtgtttttgtcattgtggttgcggtctctgtaatcatggtgatttatctactgcctagatgtacctttaccaaagaaggctgccacaaaacaaaccagtcagcagaactcatccagccagttgctacaaacgggaaagtgttcccatgggctcaaattaggcttcccactgccattattcctctatgctatgaacttagcctacatccaaacctaacctcaatgacattcaggggatctgtgacaatttcacttcaggctcttcaagacacacgggatatcattctccatagcacaggacataatatttcaagagtgacatttatgtcagcagtttcaagtcaagaaaaacaagttgaaattctggaatatccatatcatgaacaaatcgccgttgttgccccggaacctcttctaacaggacacaattataccctgaagatagagtattcagcaaatatatctaactcttattatgggttttatggcatcacctacacagataaaagtaatgagaaaaagtatgtaaaactgaaatggttcttgttctgtgctctgctgcatgtaacttctacaatgcaaataggaccctttgtcacaccatagatattttaaattcagaggtttcaaatttacgaagttatatgtacagtagaatggcaatatgggagaatatacttcttttgagcttttcatgctttctgagatgaatattgccatccttccatgaagctgtaaggagtgaggagaatgggctaatctacttgcaggcaggacttaaggaggtacttagtgagttggagaaagagaggatgaaatatgcctatgtatatccttcttaatgtccttaatctttactggttcactttttaaaatgtcagtttgagtgtggaatctctaaaattgcaagcagaactctaagagaaaccccagagttatctcgtctaatctgatttttttttcccccgaaatctttggacctagtgctacctagttagaaaaattaatactgtgcagtagaattcagttatttttagtgtagttgtgtaaattctaggcatgagctgggttgagttatgttaaaaaaaatgtgggtccttgaaactaagaaatagagaaattaaaatagtatcttaaactgaaagtttagaatgaacagaacataagttcatttacttgcctcttaaagtgaagtacccacatgattgtctatcttgagagtacatataagtttagatcattcttaccttcaggatgtctgaaaattattaatcctaagcaatgttgtatgttttttcaattttgctggaaacttttatattggccccactataattaaatatttaaattgatagagtaattagggggatgcatttcttcttgcttgaaaggcagctcttcttaccaccaatgctcttgttgcctggaaaaatcacaatgtctgtaaatgctttgaagagacactgcttgtggtcaggaaactttgcctcctttccacactgctgccaacataatctatgcctatttttatctttgcacttgtttctgctagaggcgctcatggtcaccttcgatgtacaaacattttacagttcttattcctaacattttgacaatcttcattatctggcctttgttttctctcacagcccttattctcctatcatgttgaacactctattcctacaactaagcataacagtagtcagtatttattgggaactgaaatactagaaactgctcagaacatcttatgtttctttaatcttctaccttgtcaaactaagaaatgctaatatattcataatagccaaggatgaaagtgcttataaattactattataaagtaataatagtctgccaggactgtcagggagcagagagggaacccagacctttccattgtattgaaccacttccccagttcatacttcatttcttttgcacattgtttttgccagtgcttaagattctcttactcacctcccagctaattcctgtcctgacttgaggatatgcatgcttagcaagtgtttctgagagcaaacatagtcacaaggaaagaataggtatcaagtttcacaatagagaagacattgtaattgtcttcaaaatgtagacttctcatagacttgtgtgagatagttgttttattgcttgaacaataacttaaaagttttctcgtttgtttgttttgacttagaacattaggatctatagtcaggcatgaggaatgcagttgcagtcccagcacttgggaggtagaggcaggaagatcaaggaggtcgagaggcgcgcgcgcgtgcgtatatgtgtgtgtgtgtgtgtgtgtgtgtgtgtgtgtgtgtgtgtgtgtttgtgtgtgtgtgtgtttgtgtgtgtgtgtgtgtgtgtgtgtgtgtgtgtgtttgtacatggtgagtatgaggccaatttgggctatttaagattcagtctcaaacaaaaagaagaacattatgatataatttttgtctataaataggcctctctaatgtgagtagtagggatataattagactttatcctattctgtttactgggtgaaaatgttggcagtggatgaataaaaggaatgagctttagaaatcgcatggttatcagatgaagttcactctgcttttactgggcctatgcttatcaggaaagacataatgactttacgtgcggagagagttgtagttacctagtactagtagtaagcatcgatgtagaaccacctaggtagcctaggtggttttgttagtttattgtaaagttttcctggattctggcaaaaccctaaggcttggttcagggagacctggctcaaccataatatgtaacatataagacagagatgtaggttacagactggacagagtcatggagctaataaatgtagaccccaaattcaaagcactcttttctgcttatcttctaaaagtggagtctagcacagtgggtgctgtgtccacagtgcctgtgaatggcatagaagctggcataagagaggcctctcgctcgccccgctactctgcttgtgtagtcttcaagtggaaatcactttctcctgagtgaaaatctaccattagcccctgctgctttttgtgattttcacaggcaggaccatctctaaaaaggaaagaggaaagcagaatgctattaaagaacaactggtttttctattttcatgaaagtgcatattgtagatttgagattcagtgttgtgaacccagctggttagtagctgctaatgacaatcctatggacttctatcagaaactcaagcctctccgttggtgaatcccactgcacttagcagctgctccagcttgtagacgcgtattgccttctttccttatgctgccgtctttctcaagtgtactcttcaattctgtgctttatcaagtgtgcttgatattcaaggacccattcaggttgggtactagtttctttatagtgtcttcacctgcagaagaatttgtttcacaccatttgatcccactaatgtgcttccactgttagcaatacaatttgaagcctgcaagaagattctgccccctactaggcctctgctctcctcgcccccctcaacccctttagttaatagtaggtcttttagaggctggaattgtaatgtatttttttcttcgtagccctagtactttgtgggatgccctgtctagtaggcactctaactattggaccaaatttgcatttctttttaggtactttgcagcaactcagtttgaacctctggcagcaagatctgcttttccttgttttgatgaaccagcatttaaggccacatttatcatcaagatcacaaggaatgagcaccatactgcgttatcaaatatgcctaaggtactgggacgtgaaggtgcaatatttggatagatctcttatctctgagaacagttggattcctctttactattggtagggatatttagaaacatatgtgtatatattctttctgaaatagttagatacaaatggaaagaaaagtactttgtcagtctgaggaatgcttgagaaaggaaaagaccctgcagggcttagaatgcatgcgtaagaagtgtgaagtgtcttcctgctctacagtagcacaaatactaacactatgaaatagtataagctgagtaaatgacttgagacataatgaatttgctcttgtaagcattattgagactatggaattgtgatcattcttagtgttttggctaatgaaactctggattattgtcatgtggaaatggacaagaacaggagcctttttcttgttagttgcatgggaggtagtaggggtaacaccaagtagaagagttttatgctcaacagaactttattctttttgtgtctgcctgaatggctagtgcagccggtgtggtacttcctagaacctgtatggctagaggtgagaagtagccacaggtagcaggcaataccatctaccatctacccccatagccatcagacagcatgagctttcattgtcacagtcaactcatcaccttaatatgactcttaaagaggtgggcacctacttcacactaacccaaagcaaaacctgattcatggttgggaaattttgagagttcctggcatttcttcacctttagtcagtgacagagttctctagtgacttaatgcttttgattccactaacttttcctgggggtactccatggagcactagatcatgtcagggaatgttttagctacaattccctcttgaagtcagtgatcctcaggttatggaggtagggaatggggaaggatttgaattttgctacacttggaagacagaacaattgctacagggaacaaatatattgagagtcatgttgaggttctcattatactctgtgtcttcttgatcaagagaagagactgaaaccattatctagaaatttgtgttgaaagattaaaatgtctatttattacttcatgaatttttaatttcttaccgtatttgtcattgatcctttagttacagaactgtcatcttcccttttttttttttttttggctatagaagtcatcggtccctgcagaagaaggacttattcaagatgagttttctgaaagtgtgaaaatgagcacatacctggttgctttcattgtaggggagatgaggaacctgagtcaggatgtaaatggaactctggtatgtccgtgctctgattgtctgaaagctggtgtatagtagggtggtggtagttcttggtggttaccttatgaatacaagcttttagatcggattttaacatgttacaccagaaataccactctcatttaactcatatatactactattcatttgctgtctgaaagttagtagttttcaagtttcctattttgtgagaattatagtaagataacatattatactgacatttctagaactgtactgtagaatatgatggtcagtagcctgaaggaagccaggacaggaactcaaacagggcaggaaacaggagctgatacagaggccatggaggagtgctacttactggtttgcttctatgactttgcccaacatgctttcttatagaactaacaccaccagctcaggaatagcaccactcaccatgggctgggccctcctccattaatcactaattaagaaaatgccttacagctgaatcttatggtagcattttctcaatagaggtttccttctttctgttaactcttcattgtgtcaaaatgacataaaactagccaggacatatcccaagtgtctctcaagcatcctggtacactttgcacatttgatttcatttcctcctggtgcatctcatcagtcattaggaagaaactcaacactttctttatgcaaggcactatgctttcggtgatgtgttcagttttggaaggccagtgtgtcccttagatcctacaggctctattactgcttttcattgcaggtgataaggtttgggcctgcttttgttggctcgtatttgtttttattacttaaaggcacaaacgggttcaacctaccaagtcataactgtagttataaagtctcttaaagggttcttggactagatggcaagaaagcatttagactataactgccacggcctagttgccagggggctttcatttgactgttactaggatatgatttgtttgtttttcttttcctcctttctttattttttaaattgtttcaacctacagccttaaacctgctaaccacctcttgtaccacagagctgcaccccaaatccccatacagtagtaattgatattctcttacccaacccaaaatattgtttaaggcatttctcccctggtatgcatggtagtgaagacctgtaaccccacctacttaggatgccgaggcagaagggtcacagtttcaagacattcctgagctacaaaatgagttcaagactgagcctggagaacttaatgagaccctgtggccaactaaaaagtaaaaagaggcctggggaaatagctctgtggtggggtgctggcatcatatatgtggggctgtagtttaaatctctgagaccacaaactagcaaaagactttttttttttcctgagacacatagttctctttgtttattttccactgttttattattttttagaataaggttgatataaatataatgagcagatgataactatgtattaagaagttaaaagcacatgttctttaaggaaaagaaaaaaattagaaaggaaaactttcaaaaccctttctcctaattgtgtgccagaattgagaataattgtgtcacttggtcaaatttcagtttcttttataatcatatcatattacttaaactgtgcacttatcttccaaatagagagaggataggtatttaagtaatctctgtaattctatgatttgcttctgagtgtgcagtctgaagtgaatgagcaatgtgagacctgaatcatagttagagtgtctcatgatacaactgttttttattacatgatccatcaaagcaagccaacaagtgaagttgatatttatttatgagtatatatttagtgcctactggatgacaggcacaataacaggcaccaaaaggattaacaccttagttttgtgctgcatataacccatcttcacaattcataagtaagagcacttgtgagttataagagtgtaagaatgtatcattacattagggtcagtgcttatactttgctctgaggtgtgctatagtagtttatttgagatattggggaaagctttaaaaaaattaaaacactaagtaattcttttgtgtaagtatgggtataaatgacttgtttgctggtcctaacagtgctcagctgagtggcatgccattttaatcttacctgcctttacaccatggattatgtttctcttcaggtttctgtgtatgctgtaccagaaaaaattggtcaagttcaccatgccttggacacaactataaagcttcttgagttttatcaaacttactttgaaattcagtacccacttaagaaattgggtaagagttagatagttcctttgattttcattgcaatttataacaaagatttgcttcataaacaatttttttaaaaaagcctttgccaaatatttttaaaagaaaaccaagaaatttttaatgctgtagaaattttatttgtgtacggttatttataatctatacatctgaacttaacttagaattacttagataacttaagtttatggggttgtagaaatttgcttaaggctccatatggagtttgataaattctaacttcgaaggaatttcgggttcagatgggaggaggagatttaagttttgtttggcgtgacactggttctgaagaacaaagtggggctctgactgggcttggttgtgttcactctaatctgattcattgtgaaagaaatgggctggcgttgtccttgttaggggacagtggaattgctgatcaggtcttcctcagctgatattcaggtaccgagcatttagacgtagggacaggaagattcagcatgttaaggatcatgaaagaccttctactgggcagagtcttgacttagggagttctttaggtgagaagttgatctcttctgtcttgacatgtccagatttggtggccattcctgactttgaagcaggagcaatggaaaactggggcctgcttacattccgagaagagactcttctgtatgacaatgcaacttcttcagtagcagacagaaaactggtcactaaaatcattgctcacgaactggcacatcaggtatcaccaacgcacaccgttatatctcactccctagagttttagtaaatacctgtatgttactaagcatattactattttgtggttttagtgttgctattatataaaatgacaaagggaagaatttcacctttaagctatttcatgtccattgtctcatctcataaacgccctatggtgggccataatcccattttacaggaagacaaatttatgaaatgatttgttcaaactcacacagctgtgataccattaagcctcgaagaataactatatattcagattatcttttttagtatcccagtgctgggaccaagcccaggactttgtgtttgctagacagtgctatatcattgagctaaattctccaaccttggaaaatcagtttttttctaaattgtacttatctgtgccatgtctaacaactactggcttctcaatgaaaccttgtaggatagagcgttttccctcagttacaccatctcccttattaagcagaaccttcttactgtgtaactaaatttctcctatcttaactcaactctcgagtaccatttcataggtgtgggctatcatatccagctttctactaacgagtcttgaatcacagttgtcaggaccaattttctttttcttttttcctgctacaagttggttttctattaatgtagaagaaggagctttccctagtgtagagtaaaggaattctctgtataagatgaaaaaaggaagaaaaaaatgttcgtgaacattcccatttccaacacattatctctgttgagccctcaatatgagatgcttttcagtgggtttggaagctgtgaggaagctgtatttgaagaaagactagaaagtgctgtggccagttaactttgcctcagacatcatctatagatggctgtgacccttggaagaactttttagcaagctgatatatcaagcatatacttactgctatacatgagctgaaagaaaagtggtcttttgtgagatttcttctaactctgtagaatctgttttttattttatcttctgtttggggcttataacttatcttcctgttaaacggtttttaagatactacctttgaaaaataaatgattgctactctcaaatgtaattgtttgttttattaataatgtattttttgctactgttgtgaaataagccccataccacattgacaaatttgcataccccatgaccactttttttttgcaaatgtgggtgcatgcatgtgcatgtgtgcttgcgtgtgtgcatgtatgtatgtctgtgtgtgtgtgtgtttctgtctgtgacagtgcatcaggagtcctcttccagcactctccacctgtcctgaggcaggatctctttctgaacctagaattcatatcttagagaggttgggagccaacagaccccagtgatttacctgtttatatgtctgtaaaactgggattgcagacagtttttagagaattacatggtggcttcttacataggtgctgaggtccaaaattaagtcctcaggattgcagggtaagtgctaatggctgagccatctcttcatacccaaaagtattttgaacatatgttatttaggaaggtctcttacctttttccttcttcttattactatatataagaaaccattgaaagattactctgacttcttttgtgcggtgtgtgtgtgtgagagagagaatacatacatacatgccaggtttctataggaatgttacttaaattttagtcagaaagaatcatgtgttttgaacctcaggtaatggaagaaaagcatgaaatccaggcagatcctctgacaataggaaaatctttacttgtcatggatgattttatatatataaattggaaagtaatcttacagagttgatattagatcagataatttcattatctaaggagtttcactttaatgaagcagcttaaaattttcattacagccaggcggtggtggcacatgcctttaatcccagtacttgaggggcagaggcaggtggatttctgagttcgaaaccagcctggtctacagagtgagttccaggacagccagggctacacagagaaaccctgtctcgaaaaacaaaaaacaaaaacaacaacaacaacaaaataaaccattacctatataaaacatgttgtatatagcatatgttaaaaattcacacatattttaataagtaaatatagtctttcctgcttttttcccaccattcagtttaggtaaaatgttgaactttttattttacttctaaaatcaatttatacagctttcaaaatcctttcttttttgggatagtttgtataacttttataagactttaattattctgggtatagattgttttaagatattttgattatcttcaattagcctgatagtccattcaattaagaaattcctgagtcctgctggtgacgaatttgtctcttacagtggtttggaaatctggttacaatgcagtggtggaatgacctgtggctaaatgaaggctttgccactttcatggagtatttctctgtggaaaaaatattcaaagagctcaacagtgtaagtactgtgtttctttgtcctatgaggagggaatagccacattataagttagtatttaccatatattttctacatatttgagataatttgaaaaaagttaaaatcagtaatgctggagacttgacaatgaaacccactcttgcatattgaagtatttcattaaacattaaaatgattattttttactttaggatgattattttaactattacattttattttataagatgtggtccttttgtttgaaggaatgcagataaaattggaaaataacttaaatacttgtataaaaagaaatgaaatgaagactggcttcatactgctttttatattgtcactgagtgcattctttcaacagttcttaagtaacataagttgcttaaataaagaaacaagggcgggagatatggctaagcagttaagagcactagttgctcttccagaggtcctgatatcaattctaagcacatggctcacaaccatctataatgtgatctgatgccctcttctgatgtctctaaagacagcaacagtgtactcatatacataaaatagaatcttttttaaaaccaaacaaataaattactattgctgcatacaaaccatgcatttgtttcaaagattgaataccattctgttaaagagaggtattgtgctgtgagtgtgtcattagagactggagatacttcctgtactcaaggattttcagacaccataggtcataatttcataggcattgctgaaataattcaagtattattgggtagctgaagggaagcacaaaacatgtgcctctcaaactataggacagtctcccacatagtattgtcttcaaccctaaaattctgtgacttgctcttagacgcttacatacattttttaggtatttataagaagtattcttgggagttttcagtttgacatttctgtatatagggcttgattccgactgcaagtaatttttagttgagatacgaaataggtagtttaaataatgtgtgctacttaattaaacattgaaatacagagtctcaccacttgggggtgctgagaacactttaaattctaatatacattctagggacactcttggctgagctctcgatgctttcagaataagagttgtattttcttttaagtaacctctaagaattatatatcactttaatagaaaatcaaggtaaggaccccatttctgccctaagtttcaatttctgttttaaaagtctactttaacctttgttgaatatttatcttggatattcagatttggaatttgcctctgatagtcagagattctcaattttacagttatgctctcttttcagaaatgcagattctcacatgcctcagttctcagtgccgttttaagcttaaggaactgcatacaatttactttcatttgtttatatgctgcaccttagtgagcccaggtgtttttcattctgtagcaattgtgcctttgtatcggtcatgacttcctactgctttatcttttgctagtatgaagacttcttagatgctcgatttaaaaccatgaggaaagattccttgaattcgtctcatccaatatcatcatctgttcagtcttcggaacaaatagaagaaatgtttgattctctctcctattttaaggtatcactgtgcacaaagaaatgtacttttacaagacttcaaccttattttgtaggtcagcaaacagcgtgattcacattaaagactgaacaagtgttgcctttggtatcctattgaagttttaactgtttaaattttaaatatgtaaatctgtttggtcttaacgtttgtgtttctgtctcccttttagtcagtgtgactagttttcaggcagtgaagcagatcatgtaagaattcatctttcaaagttagttttctccctggatctgtccgtagaatgtgtgcttagaagagcatcctaagcaaagccctttattgtggtactcagaattgaggtattttctacaatcaagatcaccaaaaaaaattaagcataaaaagttattttagtaattgacagttctccttcaggatgtgaaacattagacaccaggacagtggatggaaagtagaagctggcttcattctgagcaggttggagaacagagggagtgtggtactggtattacctgaatggatgctgtacaagggtgatgctaaagcttatgattggttgtcagagtccttggatagtaaatccctctgctagatagcgaagaaaatacattaagtgtgaggatagaaaccatactatcaaaaagctcaaaattaggaggtaaatacatgtgaatgagcaagagaggctgtgtgtgctgaaatagtacaaaaaatgtatgcatgttgaagagagaagccaaagaacacaaggtagggcagatatggactttgaagagaagagccaggagggctgatggattcagagatggaaccaggcttaggaaggtaagaaagaaagcatgagcccagctacagcaggtcctgagtgccataagaaatcgatgatgtttttttaacataaggatgatttgattaaagttaatatttagaaaatttaaattggattcagttaataaagttgattccgagaccacaaatgggacatgacactgaaaatcagacatgcagagtgaacgtttgcaatgaatggtcatagcaatgggaagaaaacagatctaaaactaaagggagttttgtacttgaaggacttagtgacagggtaaaacagataaagaaggaggcaaaaatgttgtctggattaaagcctgatgaagtaaataatagtacttttaacaagaaattaggagtttaatgtgagtacacagagacactaattttttcttatctgcagtttttctttcaggcttcagtaaactattattagccatcttaggaaaaatactaaaaggaaagaccagaaaagcagtctgtaaattttaaactacatatcattctgagtaatatgtcctgcatgggcatgagccannnnnnnnnnnnnnnnnnnnttcttaactttataaagaaagaaaatctaggcctgtcttgctaagatctgcactatagtaaaatattttgaaataaactacatttacatgacttattatagtaagtatattgcttataattatcttattaggaattattaatattaaatatgcctaattcatttattaaactgtattataggggaaaacattgcatatgtaaagttttgtgctatgtgatctactagggggtcttggaaattatcccctttggataagaaaactattatattccagttatttggtgatttttaaagcccatacatgaatggtcagtaaggaaaaatctaaaatgtgtttctgttgctatacagagggtaaaaaaatttgctatttcaagacatgatataacagagttctgacaccaattaaccacctaacgccagaattcatgctttctcattataagatttcagtaaaatacttaacccctgacaatatggtaactacttattttacaattggaaatttgatgaatatcccacatcactgagaaaaacagaacacagaataattccagtattttgtgcaagaaaaaacaaatggctggggaagtgtgtttaacagatatattccatttgttcttcatagtcaccaaggcactgatgtagggtgctttgtgagggttcattcattagccagttttgaaaatacaatatgccagtcactaaactctgcaggttcttcaggagacaaactagacagtgtttctgtggagtatctaaacctaagtatatataaatcagggggctaaagccaatagagaacaactagaaagcaaatttaggtagggaaaagacagccccaaggattgaaatagcagggcaccaaactttagtcattggaaagataaatcagaaacactatcccaaggctgtgtgcataaagactttcaaacaggagaggatcattaatcatattaactgctattggtgcattattgataaggtgagtaagagaactgagattgacctggcaccaggaaattccccagggaccttggttatgacattgctggtagataatgattatcaaaagaacatgggaagagagcaaatgctgatgactctgaagagttttactacaactgagaagcaagaactattgtgataacagaggaggtgtgaagttaaagagtcaatgatagttagatagatacatagatagatacatagagatggataaatagatattaagaatgtttgacatttgctgatgggaacattatagaggagaaagttggtcatgtaggagaaaagaagttagaaaatattgcttacttttatagaataagcacagctatggtgtaaaaaaaatgagagtaatggctattactgataatcttgatgacttgatattgttacatttttatcacaaatgaaagtcattcaaaccttgtgttgagtgcttgctgctaggcattgtagtaggcactgtttttttagttgcgtctttaaattggttgcttaactagtcttcgtcatagaagaagatataacatatgccagatatagaaaataatttcagttgctagtagagcaacctgacttctctctcaaatcagaaatggcaccaaagaggtagttgtttcctggttggaaatgtgatgtgtgtgtgaggggtatactattgcctgcatacttgcaagctcagtctggagtcttagtgtttgcttgctcctctgtacagtcattagcatagtacatttcttcagaaggagaaagatcctgactgtttcagtaacatgggagactaaaattagaatgtaattattgccaccagagagattttcaaagctctgctaactgactatgtttcctcttgtatgcacatgggcatagatagtactttatgcattggagatggagaaagagatgccatagaaattttacaatacatactgtttcaatgctgacatgaaaacagcaaagtgcactgaaagaccacaaagaatggcttatggttgatttattgtacgtaggaatcttaattccctttgctattgtttatatctttaaataattgtatttaaacatggtctacatctgtgtacatggaagactaataatgtaccataaccatgttgtatatgtgaagtcatatattttagaaatgatttattttcaatcttagcttcttgattctatagcctctaatagtttgatattttcttctctttctcaattttttgagcagggagcttctctcttgttgatgctgaaaagttaccttagtgaagatgtatttcggcatgctgtcattctttacctgcacaatcacagctatgcagctatccaaagtgatgatctctgggacagcttcaatgaggtaagtaacgtggataattcaatccagttatcacatatagaaatggtaccagtgagagttacttaagagagagaagatagagcttagcatgtaagtatttgttatcaaagtcaagaagtgaaagtactgtttgttgttattttaaaaattgtatctggccctggatggtcatattattctgtaccttaatctccacccctagtttgctaagtaaggaaagtttttctcctcagtattaatgaatattacatatttttgatactttctgcaaaaaacttattttgaagtagttaccttttctagtttttctatcttcaattaatgagtctctatgaagccctgtgaatctcttgatttgaggcccctgaaccctctcagtgctgtatcacaaggtggttcccatgcgttccatactgcccttgaggtgtctcttggcttttgttacacttccactttctaacaagcagtgcaaatagatagaagttcctcttcagtgcagtgaatgagcagaacttgcctatgtacatatgttggctgcacaatcctggtagccctataagtttgttattctgatctagattggtagttctttgtgctctgcaagatcatagatatagctggggatctgacaaaagttcatgtcatctgcttcagcaaaaccacatatatgcaaaacatctcacatagtttcagtcttatggatgctcagtcaagaacccttcctttggatctgtctcgtcacccactctaatgggtagtgttttctagtaataacttttcgcccagaagataggacttttttttaaagatttatttatttattatatgtaagtacactgtagctgtcttcagacactcctgaagagggcatcagatctcgttagggatggttgtgagccaccatatggttgctgggatttgaactctggaccttcggaagagcagtcttactcactgagccatctctccagccccaatataggactttcttattgagttctgtttgagagaagaaaataatttttatttcctaacgctagtttctgtattatctcccctccagtcatatgttggcacttcagtcaagagctatcacttatttggttcccatcacatatatcctgacatttggaatatgtgcctgacttcatcactcactgcaaataatgttgttgtcccaccccaacctattttgtaacattattctcagttttttcagcaccatatcaaactatacactagtttcttcttttcagattccgactttaaacgtctcaaattatcttgctttttttcccagccactggacctgaaataaataggttggagccatgagaaagataagattaatacgtcagggaaactggggagcattattttgtactttggtactttaaaccgcatgtagtgcttgaagtggagcctgctgtggcgatgtaacagttcaggttttatgatgatgtaatggcttgaatttacatctatgagtaatccgggaaagtaggctaaatcataaatgtaaccttcccgctttaaagagaccatgtatcaggaaccactttttgatcattgataccagatgtcttcaaggtagagcttcagagggtctaaataacctgtgacattagattttagattttgcaggaaaagtttacatatgtgtgggaaataagatctatgatcaccaaaaagagtttactgttgttctttaagagactcagttaagggagcagagttctttgtacctgttgctaatattatctatcaccctttagctctcctctaaaactgggcacttaaaagatagtgaagtctcagagtaggggataaggaagagtgtagacttgctgcttctcaggactgagttacaatgcttgcatcctagaatactcctcactcattgcatctttgtgaagtagaggtgctgtggcccaaaagttcactttcaccctctttggattctgatgttaaactctacaggttggtagcactgctgcttttcagcctggtgccattcatgctgaaactccctcttacattacaagctagtttgcttaagcagctcctgacttagggtgatgcaaatgtaaactcaactcagtattaattctatgtggtcttcatggaatagattaaggaaagaggaaaaggtacaggcaaagtagactaaaacctttattatactaagtttatctttaagcagaattaattcttcttaatttaataggtcacagacaaaactctagatgtaaagaaaatgatgaaaacctggaccctacagaaaggattcccgttagtgacagtccagaggaaggggactgagcttcttctacaacaggaaagattttttctacgcatgcaaccagaaagtcagccttcagatacaaggtatcatccacttttcttcccagcttgtctgctttctaccttcgggtataagaatttaggtgttttattccatccttctcgtgaaaaccgatgaggtcttccctctctagaaggagcttggaaagtctcagtttccagttactgtctaaagccatgtctacatatcaggaagagagctaacctccagtctttttcttctgcagccacctttggcatattccaatatcctatgtcactgatggaagaaactattcagaatatcgatcagtttcactactggacaagaaatcaggtgtgactatagttaatacctttctgataaaaaattactaatagtgtaattttaaaactttgaacataaggcagataacagattatattttccagtatgtacattctctgatctaatgtcatatatcattgtccatcatttgactacaataaggctgaatctttatatgtataccattggcttttagttgtaagaaataaggttagtaaagtgaacaagtaaaaataaataaataaatttttaaaaaaagttaaagatattttaaagaatattttggcaatgttttatttttaggtcctaggtaaatattttatgttttaaaataagtaaaagagccagagcagttgcttagaatgttactatttactctcgaggtctggcttgcagccagtgcatcttaacaagcactttagagattatttatatgcataataaaggttgattcatgacctaaatttacagtaaatgcttattacaacatatcttgtagacatgtacattctttggtaatgaaaaacgggccaaggaaccatgataacaaggagataataaatcatgacaatgatccaggctgagcaaccctacatgagcgtcatcatagcattcagaatagttcagagtttttagatcatttaggtttcagatttccagattaggaagttctgttagtaaaatttgtacaaatggtcgaaaatctacaatgttccaaatttgaaacacttgtgaaatacatctatgatacctacatcccaaaagaacataaggctcttggattatgtgagaatcagcaatgaaatccttagatttatgaaaaagggaaagttcttgcttagatttggatttgttttcaaatctacattttgatgggtgaataaagcccagttgtctggttcacaccatggctctcccatttccatttaactagattctagatgaggtatttggcctctctgagcctactataaaatagggctgcgataaggattcttagagtttatttatataaagtacctaaaacaatgtctggcacgtattaagatcatgttagacactgttactaatgtccttataaagaacctttaagcataagctatgtaggtagtcttaatgctgccatcagttcactagtgcttcttatcattttacaattttctatttgaaatcattatgtacttatgattttcatatcttgccttttaaaaatatatggtaaaaatatgataattggcatagtcctttatttttctatgcccatgattcatcaattgtctttattaaaataaaaatattagatgatgcgatttcttttcctattaaatgatttttttttcaatctatgcttctcagaattgtagactgttaggtttgtgatcaggtacttgacactaagttgctcttccgtgtaggaagatggcagctgccagctgcagcgagggtgccatttccttgcagcttctccacacactgcagcagagcacactgccaacacagcactcgcactgtgtatagtgctgggggcagataaggatcccaccatgtccttgattaaagtgtgaaaaagtgttgccttccctgctgaaacagaactctaaacattaggagttcctaaaatggtgctctgacccaaagaagaggagtaactccctactgggcatatatcagtgtagtctaaatgcaatgcagcatttaaaaggggccagtaaagaaatttgcaaacttcaaaatagtatttaattttttgttggtattagaaataggcaataagaaatctgcttctgtcggctctttaaaaagctctgtttatatgtgcatgtggtaaactgttcttgagattcacgctgtataaaatagctacattttcctacttattccttaccatagtcaagtcttagttgctataacagaataacaaacataatttaaagggaagaaagatttattttagctcacaatttgacaggttcctggcatctgggagaagagaagaaaaaaaaattggcagattatacctgtctggagacattccagagtagtaactctcttcctccagaccctccctcccaagtgcccattccctaccaacttatcagtgagataagcagttccttgtcagggataaataagatcctctagcttgggactaagctttcaacaaatgaatgtagagagacctgtatgtgtgaaccattgcctgccttcctccctcccccactatgcattctcttttcctgcttttctccccgtctccacacttcccccatcccctctctcctgctttgcctctcttcctttgcttctccctccatccattccccttccctccctctttccccctcctgctccttcccctcctttattccctcccctcctctattccctccttctccccctccctttcttctttgtgtccctctcccactctgtctccttctactcccctccgcatctctcttacctgtttttgctgcaccgaatattttccagcacctcaaacaggccatatttgtgtctaaactcgtctgtgtgctatgctttctccttgaagaacaccctgacttcccactcccttgacttcctccttttcattcttcagcccttagctaagccaaggctcattcctcaaagacctctgcatcccaagaaaagatagatttctagtttatagtttcaaataacagtatgtactttctactcagaatattctgtaaatactgtctacttgtgtctctacccatgttatatttatctccccttgagggtaaatattgtggtttataaatcacatgcaattggtaaattcacattggtgaatactactcaccttagtagtaagtgcataaagaattaatgaatgaataaatgaaatcattgaattataatgttgactataaaaactttcaagaaagaacatttaaagccaaatgaaatgtcttatttttcttcattggtaaaactcatagtaaaagggaatatacaaaaaggaatataattgttgaatatgcagctggaactggcctaatttgacataattgtcactaatagttcccttgtgactgttgctgctttaatttctgccagttcagattttgagtacacattgaaaacattctactcttataaggaaatgcttgaccctaaggatcctagaatctttttggcccctgacaccccaatagtaattactctcaacttagttgcagtttctttttctatcctcagaatgtagtagagaataattatggcactataagatcctctggtctctgaggtgtacaggaaggctctgagcttggtttactggttcagtcacgtgcaataaagtccatttagcatctctgtcaccttttcccatacacgttgtttttgagtaattgttacacaaaataacaagctagagagggtcatattttaggttatgctaaaaaatttttactttgtccttcatttctgttatctacattttatatatatttttaaacccaaaatatttaactacgcgatatttaattctaactggaaattgtatgtttctggaaaagtatgtcaccattcgagaaatatttctatgaaactagaagatgtatcattggaaggaaaaacaattagaaagaaaaaaaagggaggtggtttactgccatacttttatgtgctgttatctttgttcctacataataggataaagaggaaaggaagtgaaacaaagaaggctgggcttttgctagggctaagctgtataggattctaatccgctggacgtcatagttcctaattttatagtaagaacatgtatttttatttctttgtttcagaactccaatatttcttcataaaacagtatttgattttcatagcttatagacaaatggtttttaaaatcacaattagattactttgtcagaaataatggggttttgccatttaaaattaaattgctcaaactttattattttactttacaataaactatgaaaaccaaactgttaatgtgttatgattataataaatttaaaacttataaaagtagtctcatatacatttgagctagcaaccagtttcatccttatatataaagcaattatttgttcatacctatggttttgatgtcctagttcatactatatatgataaacttactatctcctgctgttggctatgttgctaatattctggcaacttgataacagtcacaatttgaaatatactctctgctgtatttcttctctctcttatctggagttggtcaggtttgcagaatagtccttgctcatcagtgaaaatattcattattccaccattcatgaccccatccactgaaatggaggccatgcttagcattccttttgaggtcagtggagatggggctgtgtaatacctctttcctgggctttatctttaaaagcaccatacaagattatacttgctaacccaaatattgctcctttttggattagctaatgatataattattctcatcagttagaagcctatttgcagtggcctaacctgcaaccatgactttttccttcactaataattcccagaactacatattaccctgaaaaaaagagtaatgtgaatttatttcacctaattgatcctttccatctattactatgtcaagaataaaaaagaaataaatattgaatcttttaattaaaaggactggtagttctattaggacataattagaagtatttccatcttcagaacatctacaatatcagcaaaattagtaataaaaggagtcatcagataaagtctaataatttatgcttttgaacttgataaactgtaagtaaaacttcaagcactaacctatctttcatgttaaaatgtgtttctaaagcaatttgtatgaaaataattcactatataagtattatgataaggaaaaaatttaaatgtttcaaaacaggaaatggactaaagtggggcaagtcctgaaatgaaaagttggctatttgggcattgcttctgaggacaatggaaatgaaggggtgggaaggttaaaggtgaaaatgcaggatgaacatcaacacatggaagataactgtaggaaatatgccattaattcaaacaagcatgacagtaaatatatactacattatcattgggtttagatgagtttttttatataattaaaaaatgtatatttttactttaagatcagaagataatatatcattcatattttaatgtggtttgaagttatttgttatgaccttagtcattatatattcattcatttgataaggatttgtaatctcctgctaggtgcctcactgtattgactgagaagttaatagtgaaggatcagtacatagggcttgtagcaaatctttacctcaggtctttccaagcatgactctcctgctgcatctacatccttgtcaacttttaggaacactcttattagtaagtttagtgtttagtaacataattattcataattttaagcatgttgaaaattcatcagtatattttgtagtcagttccttgtttatacattctctttgccaaaatcataggcatttttaacaattctcttagcacacacatacgtgtatacatatgcatatatacatatacatacatacatacatacatacatacgtacacatatatatgtgtgtgtattaaaaaatacatgccactattctgttattttaactcaactatttatcttgtgcctaacaaaaccttaatttttttctaatgtttattttgatagctttgaattattttctaaataattttttaatagtataataaaagacaaaggttgagatgggacatactttgcataatgtacccactgttttagctgctgtcccgctctgcacaccatcccttttccctcatgcataatttcttaagccttgtgttttctgaagtcacttaaaagaatgacatcttagccatttcttccttcacaaagcctctccagactgcccttcagagtgaaatagttctgtttgcttccatgaatgttgtattttctttttctaccagtggcactatgtggatgttgtatctaggtgcttttattagaccataaaaacagacccctctgtcttctttgtcatttgttctccagtgcctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacaagtagaatacatattttgttcagtaaaactgttataagaattcaagcttcacattactttatgaatgaattctcttcatgaagaaattggcttctgcctaaagcttagtgctaacctgttagttgagtagcatctctagtgactggaccctccttatacatgtgtgggttaccatatacattatagaagcccaaagccaagaaatggcagtggtctttttttttttttttttttctttcttcgaggcagggtttctctgtataccctggccttcctggaactcattctgtagaccaggctggcctcgaactcagaaatccgcctgtctctgcctcccaagtgctgggattaaaggcatgtgccaccaccgcccggctggcagtggtcttttgtagaagtgttttctgaagagcttacaattttagattgactccagacctagaaacacaaagaatactaatcattattactttccaaattttgactgtgttttaaatatgaagtagccttgttatgtccattcaaccattactgctatgacttttacaaactacctagtttagttagttagttagtttatttgtttgagacagggtgtcattgtgtagccttggctggcttggaactgcatcaactggcttcagattcagagacccacttctctttctcttcagtgttgggattaaagacatgtatcaccctactcagcctaacagcttagtattcactgtaaactcacaatagactttataaataaatagagtttacagtttacaatttggcaaactgagtttacagcaagaaataagatttgtctgttttctgatttaggtattccaaatcagtcactatttagatagaggtatgctatccccaatcttgtggtagatagaaataattagtaaataaaattaatagcagtcatcgtttccaagacagtgtaatgcttctacttagtccatgccaaataatagatgacttttggatcaaaaaatgagctgttgtgtatctttctattaaaatgcatcattacctgtgagccacttaaatatatttacttgaatatagcattgtctgatgctactgtaaacctaagtttctggtctacagatgtaaatactcactataaagttttcctccgtgaagttatgtgtgtctcagtagatttatacttcatattcatttattctatagtcttggcaaagtgcctcttcggatggcatttgatttgattgactatcttaaaaatgagacccacactgcaccgatcactgaagccctgttccagacaaaccttatctataatctcctagaaaaactggggcacatggacctgtcctcaagattggtggtaagtcttccttccttcagtttctcttacagcctacctttaatactgttagtcacaattctgttcagcttttaacatttcttcctttaaaaaagcagttaaattcctttttttttttttattttgctggtttaaaatatctattctggatcagaatgccattgtttatcatgaaaagttggtgaaacttttacatgaaaatagtgttctttcaatatcaaaatatagacatttgtctgctgttaaatagagccatctaaaaagaaaatgtccttgaagtccctcttgtttttacccaacattaaaacagagtcatttaaaaaggagagatcctattaatttgctagtggtcattataaaatgtagagtgtttgtcctgaagataccctgcctggtagttgttgctgactactctgcagggtagcgatgctgttaggtagcagtgactgtaggagctgagtattagacctccgccctcttaaaaccagtcactcaatcgtaacagctattacttttgacacttcaacaattaaggtaatataatagttacctaggattgcttaatgtgttgctacaaacttgttgtacaaaagtaccagaaactttattatgcccctggaggctagaaggctagagtcacggcgttggcagcataatcttataaggaataatctactgcctggattttccttagtttcaggtaaatgctagtaagccttgtcattccttccttaaattcatgtcacttgacaaggcactatactgtctgtgtttctgtgcccaaatttgccagttgtcatcgttatatcaacctctagtttagagctcatagtaaccctgtataacttcattttcgcttgattatatctacagagacagtgcccaattaaggttatatgaatcggggggaagtacactgttcaatgtagtatcagtagtagcagacaacactaatacacatcactcatttttatcactcttgaaggacactgatttgaagggctttaaaaataccctaaaggaaggcagaatgtctgcctgttctaaggctgcctagctagttagcttcatggaagcagaagcccttcttccatgtgtctttctctgctctagttgagattagtcttagggagcatttggtaagtatctcaagttatcctttggttgaaatcacaaattgggtctttggagtattttcctgttggtgttcaagtaacccatctcctgctgcgttgcgtcttcgtcctccgtggtttcaggtttgtgtttggaatgtacaatagagtagatccaagggactggtgagtaagtgcgnnnnnnnnnnnnnnnnnnnngcttggtccctttagtgctataactccttacattttttgttaaataccttcttggctgtgggatggtaaaccatgcccagaaactcggtgaatgcacacctgagacggtaggtgcctcaccgctccctgccagattcctggcctagaaaaaaaaaattcttgacctggaactcgtgctgcacttcccacataaatgcgactgggatgtctaaaggccctgagagtttagccaatgagttctccttccccaacattgcttcctgcaaaaggtatttaatcttgggtccaccctgtgaagttggtatagtgtgcatccattatttcccacagtacaaagtttggaaccaaggcctatctctcatccagaagcaccaaggggagcatggagaaggcctctctgcctcccagccacagtcccggccaagctgcagctcccgttccccctggccccaggctagtctctatcctaagcccaactcctaagctctcaactcctacgacccagtggtgcctgaatgtcccggagcttgagagtgcccatcccagccttatcactagcctgtggacccctgacacttcattcccaacgtttctgtgtgggacttatctgtgtgttttctttcttttttttaaattggatattttcttcatttatattttaaatgctatccccaaagccccctatgccctcccccaaaccctgctctccaacccacccactcctgcttcctggccctggcattccc

SEQ ID NO: 1850 - DNA, 2267 bp, Mus musculus
ctagggttgagcgatgcttagcgtccacgcctcagtgggtcttttgcagcagttgcgaaaacccggaacgaaggtgttgttgccgtgcggcggagcggcgccgcccctcgccgcacctccccggcagccctcggaggcctttgctgggcatgctcagtcgtcaggaccgcttcggctctcggagtaggaagcttggggcgctgggctggtaaggacccgcggcggggcgaagatggagtcctttaccaatgatcggcttcagcttccaaggaatatgatcgaaaacagcatgtttgaagaagagccagatgtggtagatttagccaaagaaccttgtttacatcctctggaacccgatgaagtggaatatgagccccgaggttcgaggcttctggtgcgaggtcttggtgagcatgagatggacgaggatgaagaggattatgagtcctctgcgaagctgctgggcatgtccttcatgaacagaagctcaggcctgcggaacagtgcagcaggctacaggcagagtccagatgggacttgttcattaccctctgccaggaccttagtgatctgtgtttttgtcattgtggttgcggtctctgtaatcatggtgatttatctactgcctagatgtacctttaccaaagaaggctgccacaaaacaaaccagtcagcagaactcatccagccagttgctacaaacgggaaagtgttcccatgggctcaaattaggcttcccactgccattattcctctatgctatgaacttagcctacatccaaacctaacctcaatgacattcaggggatctgtgacaatttcacttcaggctcttcaagacacacgggatatcattctccatagcacaggacataatatttcaagagtgacatttatgtcagcagtttcaagtcaagaaaaacaagttgaaattctggaatatccatatcatgaacaaatcgccgttgttgccccggaacctcttctaacaggacacaattataccctgaagatagagtattcagcaaatatatctaactcttattatgggttttatggcatcacctacacagataaaagtaatgagaaaaagtactttgcagcaactcagtttgaacctctggcagcaagatctgcttttccttgttttgatgaaccagcatttaaggccacatttatcatcaagatcacaaggaatgagcaccatactgcgttatcaaatatgcctaagaagtcatcggtccctgcagaagaaggacttattcaagatgagttttctgaaagtgtgaaaatgagcacatacctggttgctttcattgtaggggagatgaggaacctgagtcaggatgtaaatggaactctggtttctgtgtatgctgtaccagaaaaaattggtcaagttcaccatgccttggacacaactataaagcttcttgagttttatcaaacttactttgaaattcagtacccacttaagaaattggatttggtggccattcctgactttgaagcaggagcaatggaaaactggggcctgcttacattccgagaagagactcttctgtatgacaatgcaacttcttcagtagcagacagaaaactggtcactaaaatcattgctcacgaactggcacatcagtggtttggaaatctggttacaatgcagtggtggaatgacctgtggctaaatgaaggctttgccactttcatggagtatttctctgtggaaaaaatattcaaagagctcaacagttatgaagacttcttagatgctcgatttaaaaccatgaggaaagattccttgaattcgtctcatccaatatcatcatctgttcagtcttcggaacaaatagaagaaatgtttgattctctctcctattttaagggagcttctctcttgttgatgctgaaaagttaccttagtgaagatgtatttcggcatgctgtcattctttacctgcacaatcacagctatgcagctatccaaagtgatgatctctgggacagcttcaatgaggtcacagacaaaactctagatgtaaagaaaatgatgaaaacctggaccctacagaaaggattcccgttagtgacagtccagaggaaggggactgagcttcttctacaacaggaaagattttttctacgcatgcaaccagaaagtcagccttcagatacaagccacctttggcatattccaatatcctatgtcactgatggaagaaactattcagaatatcgatcagtttcactactggacaagaaatcag

SEQ ID NO: 1851 - protein, 694 aa, Mus musculus
  VARIANT (1)...(694): Xaa = Any Amino Acid
EAWGAGLVRTRGGAKMESFTNDRLQLPRNMIENSMFEEEPDVVDLAKEPCLHPLEPDEVEYEPRGSRLLVRGLGEHEMDEDEEDYESSAKLLGMSFMNRSSGLRNSAAGYRQSPDGTCSLPSARTLVICVFVIVVAVSVIMVIYLLPRCTFTKEGCHKTNQSAELIQPVATNGKVFPWAQIRLPTAIIPLCYELSLHPNLTSMTFRGSVTISLQALQDTRDIILHSTGHNISRVTFMSAVSSQEKQVEILEYPYHEQIAVVAPEPLLTGHNYTLKIEYSANISNSYYGFYGITYTDKSNEKKYFAATQFEPLAARSAFPCFDEPAFKATFIIKITRNEHHTALSNMPKKSSVPAEEGLIQDEFSESVKMSTYLVAFIVGEMRNLSQDVNGTLVSVYAVPEKIGQVHHALDTTIKLLEFYQTYFEIQYPLKKLDLVAIPDFEAGAMENWGLLTFREETLLYDNATSSVADRKLVTKIIAHELAHQWFGNLVTMQWWNDLWLNEGFATFMEYFSVEKIFKELNSYEDFLDARFKTMRKDSLNSSHPISSSVQSSEQIEEMFDSLSYFKGASLLLMLKSYLSEDVFRHAVILYLHNHSYAAIQSDDLWDSFNEVTDKTLDVKKMMKTWTLQKGFPLVTVQRKGTELLLQQERFFLRMQPESQPSDTSHLWHIPISYVTDGRNYSEYRSVSLLDKKSX

SEQ ID NO: 1852 - DNA, 113240 bp, Homo sapiens
agagtgaagatttctttctaagcatttctagtaggcttagggttccatttgggaaaaaatggaaatgatatatctatacctgtagaattttctatagcatttctgtttctaaataggttagtgtttaattgaatgaaatctgtacctttttaaatagtagcaaccagatgggggaaaacaaacttgcttgagcaatggtgaatggagatactcacagtataatttgctttttttttttttttttttttgagacggagtctcgctctgtcgcccagggctgcagtggcgtgatctcggctcactgcaacctctgcctcccaggttcaagtgattctcctgcctcagcctcccaagtagctgggactacaggcgcgtgccaccacgcccgactaattttttgtatttttagtagagatggggtttcaccgtgttagccaaaatggtctcaacctcctgacctcatgatctgtccacctgggcctcccaaagtgctgggattacaggcttgagccaccatgcccagccattactgtttcattttaatcaagcattgttattatggtttctaaaaagtataacctcaagtctttcatatatatcagtttatcagttttatatcagagatataatttacatggcataaaattcatccatttaaagtttataattcaatggtttttagtatagtcacagggttgagtgcctagcaaaacgatcaatttcagaatgttttcatcaccctaacaaaaaaccctatacttattagcagacacttcccattcttgcctcccttcagtctaaggaaatcactaatctactttctgtttctatagatttgcctagtctggacatttcatataaatggaatgatacaatacatttcaaataagtggaataataacaatatatggtcttctgtaactggtttctttcacctaacataatttttaaaaggttcatctatgttttaacatgtcagtactttctttttattgttgaataatattctattatacatataaatgtttcacattctatttatccattcatcagttgatggacgtttgtgttgtttatactttttggctattgtgaataatgcagctatgaacattcatctaccatttttgtttgtttgtttgtttgtttcaagacagggtcttactctgttgctcaggctggagtgcactggtgcagtctcagctcgctgcagcctcgatctcccaggctcaagcgaacctcccgcctcagccccacaagtagctgggactacagacatgcatcaccatgcctggctaatttttttatttttcatagagacggggtttcaccaggttgcccaggctggtcttgaactcctgaactcaagtgatccatccacctcagcctgccaaagtgctgggattacaggtgtgagccaccacacccagtctatgtacaagtttttgaatgtgcataagttttctggtcctttgggtatatatctaggaatggaattgctggatcacatggtaactgttgcttaaccttttggggagctgccagattgtttttgaaagcagctacaccattttacattcccatcagcagtgtatgtggcttataatttctctacatttttgccagtatttactattatctggtttttttattgtagctatcctagtagatgtgaagtggtggcttattttggatttgatttgcttttccctgatgactaatgacactgaacagcttttcatgtctcattggccatttgtatatcttctttggagaaataatattcagatcctttgctactttttttttttgtttgttttgagacggagtctcgctcagtcgcccaggctggagtgcagtggcgcaatctcggctcactgcaagctccgcctcccgggttcacgccattctcctgcctcagcctcccaagtagctgggactacaggcgcccgccaccgcgcctggctaattttttgtatttttagtggagacggggtttcactgtgttagccaggatggtctcaatctcctcacctcgtgatttgcccgtcttggcctcccaaagtgctggaattacagtcctttgcctacttttaattggattatttatcttttatcattaaatttaaaaattctttatatatgctagatacaagtcccttgtgaagtcccttggtttgtaagtattttctcctattctgtgaactgtcttttcatttctttctttctttctttctttgagacagagtcttgctcttttgcccaggctggagtgcagtggcatgatctctgctcactgcaaactctgcttcccaggttcaagtgattctcatgcctcagcctattgagtagctgggattacagacacagaccaccatacacagctaatttcttgtattttgtatttttagctaagctggtctcaaacttctggcctcaagtgatccgcccacctcagcctctcaaagtgctgggattatagacatgaaccaccacgcctggctatcttttcatttcttgatactatcctttgaagcatactttgttgatacttatcttcaaccttatttccattacaatgaagttgttatgagttgaatagtgtcctccaaaatttatctgttaaatttataatcccccatatttcagaatgtgaccttatttgaaatagggttgttgcagatgtattagttaagataaggtcatactggagtagggtgggcttccaattcaatatgactagtgtccttattaaaagaggaagtttggacacaggtatgcacacaggaagaatgtcatgtgaacactggagttacttgccacaagcctagggactattagaacctaggagataggcctagaacagatccttccctagtgcctttagggggagtatggtcctaccaacaccttgatattggacttctatcttccagaactatgagataatgaatttctgttgtttaagtcattcagaatgcactaggttttacagtagccctagtgttagaataggtagccaggcagacatgagcatgacagcagagctccccatccatgtctactattttagagaggcaattgttatactgtctctctaaaatagtaactggttgcagccagcgtcagggaaaggcaatctcgcaatagatagaaaacaacagaagctggtgatcagcagcttctcagtaagatctcatgagatgggtaagagggctcaagcatgtgcactaagaggcaaaatggcatacaacaagtatatggccttcctctaggattgctcaactggtaaggcgaaaacacctcaagtgaacatgtgtacaacttcagtaaggtgatcgctccctagtgctggcaggtcacagcacatgcagacagcccaccacaagggataaagcaagggaggagacacagaaatcctggcaccatgccaatgtgtaaaacccccaagtcaagggccaaacagtgcacttggatctctcaggtacacttggccctcttgcaagtgtactttacttcctttcattcctgctctataactttttgataaactttcactcctgctctaaaagttgcctcagtctctctgccttatgcccctcagcagaattctttcctccaagaaggcaaaaatagagtttctgcagacccgacggatttgccattgctaacactagtaaactaatacacatgcccaaaataagttagatctacttttctttctccttccttccttctttccttccttccctccctccctcttttcttttccttccttccttccttttttttcttccttccttcctttctttcttcttgagacggggcttcactctgtcacccaggctggagtgtagtgcaccccggcgggagtgtagtggcatgatcttggctcactgcaacctctgcctcctcagttaaatgattctcttgcctcaccctcctaagtagctgggactacaggcatgcttggcatatgttctcaggatctcctggtcctctgtaatgggtgatggccattcatatttagctcagaataaatctcttcaaatattttacagagtttgactcttttcatttacaataatataccacttcttggtttgtaatcctaattatattaatcaattatataaaaaattacattgtatttaatggctccatctttactttcctatataagtgccttagggcacttatttattaaaatatatcagtgtttataacctttagtggacatttaggttgcctgcctaacattttggttgcttaactcctgtaaactaaaaataaaattctaagcctcccaagtgactgaacagaccatgtcttggccaaggggaccccagggtaaccttgaaaactaaattctcattcatgacaggatgccagggtcaaacaagccttattataccccttcctcaatattcaggattagcctttcttccctaagggctaaacggaaaccagcccttttgaaagattccacccctaatatcaaccaaccacctgatattgcctctagttttttgcctgataagagatcaccacatggagtggttctggcccatctccagagaatgcacagtaagagttttcatgtcctctgcttcaccttttgatgtcagaggactgaaaactccaccctcggatcatgttaacactgccattttttgtatatgggacccatgaaggggcatgaagctccattgcgcatgcacacatttatcctttgataaatattcatgactcctcctatagcttattgaatacatatatttggccaccctgctcagcataaattcctgttctctttgcccctccctcagagtgtctgtttctggcttctggctgtggggtcagcctgtcagcatggccaccctacaggctgcaaccctttatgagaaataactttccaaatttgtgaacctcatcattcctcagttgacactccccttttcctttctgaatggaaaatggttttgttcaaatacccctctcctcccatacgaaacaaggaaggtgatcttaaactcagcagatttaggctgtactttgtctaagaaactagtcatagtgttactgaccactggttcttgggctgtcaatgcaatagagattgatgtgaggccaaaacagtttccctagacaagccttcattggagcttatgcttggacataagggaggtagcacaaaagagagaattccctgactgactccccaaaaagaactagtcgtggttttttattaggcaaagtgcgggaattgacatcaggggtaggatatgcaggctggactgggcaaagcatatcatgtgtaggctatgcaggtcagcattacctggttagtatggctatcttgagtaatgggcagccagaggcaacaaggctgtaaatcaattgttcagcattccttccctacctaggacactccacaaccttggtcatctcctaaggccagttctgggaaatctttttttttttttttcccagacaggatctcactctgttgcccaggctggagtgcagtggtgtgatcttggcttgctgcagcctccaccttccaggctcaagcaatcctcccacctcagcctcctgagtagctgggaccaaaggcacagaccaccacgcttagctaatttttcaattttttgtagaaatgaggtcttgctgtggggtacacgttggtcttgaacttctgggcccaagcaatcctcccaccttggcctcccaaagtgctggaattgcaggtgtgagctattgtgcccagcctagttcctggaattctttaagtaaaaggcatggtttaaacattaaggcatcagtgaggtagtagtgtaggttttgtgctcggtgagggtgcatgaaagaatgctctagtaggggtgaggtgaagctaagccccatttctactctgtctcaattataacctcattttcatttccagtgattggtctacaaatgtacaaaatatagttttggtaaatgagacctaaggagaattctaatggggaatttctgagaagggtttcccctgctctcaagaaagagacacggaagagtaagttccttcttcctcccctgctgcagccaacttttgaccatatggtagtctgggctttggggaattgctcatatagaggactgaagagtggagagagagaagttgggctcttgatgaggctggtgagctgtgattgaagattatcttatcagtggacttgttatatgaaatgataaatgtctgtatcatttaaactagttttactcagagttttgtcttttgtagcccaaggaatctgaactagtatatcactgttctttccaaataataacctttcactttatttggctgcgtttttttgctaatgcctaagctctacttgaactttattagataattattctgctttcttctgtgctctaaacatttcttgatttgatacaacttcaaacattactaattaatgcagtgtatgtatgctacaaatgggttacaaaggcaatgagatattgactccttcggtccttagggtggccggaaacctcatgatggtcagccttgccctggcgggaagcagcttcctccatttattcgagtgctgaacaaataacattttcaaatgtgttcaatgaattaatgtattgttgcttatttcaaaataattagaaagatcacttagcagggctgaatccaaattccctatggaatatcaactaattaagttggaatcttaattaaatgattaatggaatagacttctaatagatgaaattagctatatttctctctattccatattcttttcgtggatttttgtcattgaccccaatttgcttgtggaaactgggagacaacagaaaactctgaagcactggtttagaacacagatggcctgagttccagtccatgtctgctcgtggattgtgcgtaaatattctaccctctctagacagtagttccctccttatctgtttcaatgtgaggcttggatttgctgatctatggaataccaagtgttttattttgataaaaatatccctatattcattgattatcaagtttgtcagttctttaaacaaatgcaatttgtttttcagggtgcttatatttttttcctgtcatgctatttattatgtattataattaactctccaaattaatggttttcaagtgttaaatggtagagagcaatgattccgaagacagtagatgggtatagtagataatgtcacattatctcctttgataatgaatcgtaacttcataataacttaaactgtcatattcttaaactaaagaggaagttctgtgtgggaggataggcgggtgttaaagataaaaacataatgggttttggttgtgaaattgtgatatcatattccctcaaaaaggctctatgaagtcaaatgtaaaacagtatccgttgaaacaaaacaaacttcattattattcttttgctcctaggtaggcttctgaaacatttcgtttgtttactatttttacttcttatacaaaaccacgtcttttttttttttttttttttttttgagatggagtcttgctctgtcgcccaggctggagtgcagtggtgtgatcttggttcatcacaacctccgcctcccgggttcaagtgattctcatgcctcagcttctcatgcctcaccctccggaatagctgggattacaggtgtgtgccaccactcccggctaattttattttttgtatttttacatgtctttaaatggtccttcatgtctttgtgtgtgtgaaggaatgggaggggtgggaggcaagaggttggcaaagaaatcatttgtctctttgtcaaagaaatctcaaaaagacataatgatccacctatattcgctagtgcatttttttttatcacgtctctgcagagttgggatatgtaaaacaaaacacaaggtaacatgtttcacacttaaaagcatgatagactgtaggttacaggtgaagtgaggtgaggtgatttaacaagctgcagtgttttaaatatctcctatactaagtggtttggttgcaaaaggaacttcaagggaacatgacatgacctaaaatatagagaagagcgtcttatttaagcaatacaatgtgtgaagtatgttaacaaaatctagctctgcgtgtactatataatatctgaactgggatacatcagctcctgtggttcactatttttggttctaaaatgtcagtactaggggccagcctaacggttctgattacctttcacacattagggagatagcagctctgaggtatcatatgatacagacaccttctctgtactgatcaaacacatcattcagtatggagtcattaactggaagggtttgcagcagtggaagtgaactctaaacaccactatgtccttcacttattcatgcaaaaattatttattgtatacttacccaggcattggggatacagccttaaaaaagattacgactctgccctcacaaagcttgcattcttgagaagggagactgataataagcaacaaatccaaaacattgtttcagacagtgatgagtgctgagaaggaaataaagcaaggccaagtctttatagagtgtttgtggctattttagatgtatggtcagacaagggttctttgcagaggtgacatttgagccgagacttaaatgacaagatggaatcagtaggcaaagcactaagcagaagaaacagttcttgtgcgaggagcgagcaaaaggaattattaacaatgatggatggaacttggcgacttccgggaacagcatgaaggcctttgttaccaaaatatggtgagtatgtgctgatgaggtcccagagttaggcaaggagtttcattttttattctaagtgcagttggtatccactggaagtttcaagtagagcgtgcgttgtgagggatgtaataacaacaggcagtttaaaatacaatattgtacttcgatttgacttcttcgaaacctagtttccaattccagtgctggtcaaacaacaccctggccgtccctgtttgagcaggctgtttgcgcttgccgcggcttgtttgtccctggcgccccgctgttgaaagcctcagagcgtgtgacagttggcaggcgcagtgaggcgcagcccgagccaagtcaatgcaggggccggggctgagggaggggaagaggcagaggaggcggtgatggcgcgctgggagggcggcggcctctgcagcgagggtggtggcgatgcgcataccgagaggataaggaagcggttcccgacgagcctcctcggggcttatggggcccctggcggttcggcctcggaggctagcggggctgcccgatttggcactggaaacaatggtggctcggggctggaggcaatggcgcgagtgctggggggcaggggcgactaggggagtttcggtttctcgggcctagcgccgcggagccttgctgcgggccccagtggtagcacccccgggaaccgcaggtgttgatttaaggctcggaacaggcgggccttctgcccacatcctgcggcgcccgcgacccgggccgggcgatccggcgccgggttttgttatccgcccgcacctagaggccgcaaggcagccgccagccccgggactggaccccagggcgccctcggccctgcgaggtccccgccctctcttccgtctcctcctcaccgccctcctgaggcactctgatgcgggcgggcatctctgccgaaaacacctacagcgcccgctccctcggtccttcgagcagtgatccctccgcggccaacctccccagggaaaccagcgattcgcggttcagatagcgaccttcgcccgcaggttcctgctctgccttcagacttcggcttcagtggcacctgctcagcgaggcctcgtctaaccaagccatccgaattaactacccactcactcgccatcacatcaccccgatttaattcgcagcggggcactgactttacactcgtgtgtcttctgtgtttatttatggtctgtttctggaatgtccgctcctgggactgggaccatgattttctggcgcagtgcgggtgtctcggcgtccgggatcgggcgggtcgcagtagggctccacatttgttgagtgactgaacaccgttcccggccggggagagcgccgcagccgggtccacttcaggtaggggctgggctttcccggccccgcctaggccccgcccccagcgcgaacccgctcccacctcgcctgtccacggagcagcagggggtttgactgtgcttttccctcttgcttccctcgctctttctgcagctgccacgaaaacccggaacggcggagcggcgccgcccctcgcggcacctccctggcagcccttggaggccgcgctgggcatgctcagtcagctgggccgcctcagctctcggagtaggaagctcgggcgctccggctgtaaggagccgcggcggggggaaaatggagcccttcaccaatggtgagtgggctgccgaggcgccgggacccgggctctccggagccctgagggtcgtgggcagtcgtgacacgcggggtcgggctgcagccgtctcccccaacaccgcgggcttcccacgagggctgagagaggcaggagaggggatctgggggaggcagggaggttcggggggcgggcggcggccagtgcgggacccggggctggcttgaaggtcagcgccgccgccgccgctcgcccggggtgcggccggtgggcaaacagcaaagtttgggctgctgtgcgcagaggagtgggcagtgggaaagttggcagctcaggtttgcccccggaggaggcggtgtcggcccgactctcctgtaggagcgttaagttgtggcagctgccgagcccaacttttgtggggcgccaggagctgtccccctgcccttcagtgagctgccggcgtgacttttcctaatagggcggggtgggggtgggaggcttggcaggttaatgttgtggaaggaagggaaacttcaggaaaggcttgctcacctcgctcggggccgcggaggtgcctggccacagtgccaccctcctgaccctgccgaggtactcggcagggccaccacgcatcccctcactggctgcagatcacatcagtttttcagtcagacttgttaatgtcaagggtccgtcacggtggtgataccactgtgtgacaggaagcgagagtcaacgcagggagcctgcaccctgcaaacagccacagcccttcactgaacggggagcataaatcccaccctagttagaaccatggcttttgtgcggaccagaagtgccagagccacaatataggggtgagatgtcttaccgttttgcggtgttgagtgtgtggattcccttttaagatagaaagtaggaaaactgccagtaagggagacgactcactaaaagaggattcagtctctggttgacatgttttgctgagtgtggttggttacttcaggtacagtatcacattaataggggccacagtctatatccctgtttagtttgttagttaccactcaagagcagacagatattgtccactttatcccaaatcccagccagactttgttgtatgctgtgcttcattcatggggctgtgaactactgattatattctccctattcctaatgtagaatgctttattctactgccatctttctgtctgcactgtttaattaggcttactgataacaactttaattctgaattttctttctcattcaggttctatttgtaattactaagacttaaagaatagtctggtgaagttactcgaagaattaaggaaggtttgagctaaaatgaactagagaccatctagtactttagtgtaaaatatgtttaatacaagtcgttaagtccttgtaagtgactattccaatgttcattctttgtttttggaagaatgcttggagttaccatgtttttaaatgtgaaatttcatctaaattaaaaaaaaaatctctgtgatgaggctgactcacccatttggtcaagattagtgctagctgatttgctgaacctttgcctacagaattaaagtactttctcaagttttaaaattggtgtcttttctcttatagaatatgcttctagattgcttctagatgtgggtatttgcaaactgtcacatttgggaggacaatggaaaaatcccacagaagagaacaaaaaaagaagcaatgcttcaactttcatgtaggaaattggatttctgattctttcctatctttcagagttgatgctggagacagcttggcagtgcataattttggttaatgtagcaatcactccttggagccttatttagcatccttttacaaggaaaacagaaacgacaatatctacagtcaataagaaattaaatgttagcaatttgaagtgcttttcaggtttaagatggacagggtatttatttgaaaacttttgaaggattgctgtagaattttctagtgttttcaaatgacatggtacagtagacagttatatacttcatccttttgagtacaaaaaataatgcatgtataatgctcccattggtctgggtgtgatgatgcagagtatttcattatccatagaatttatgattgcaagatttatcaagcctggtattggattttgttacacgttcatcctcttttaatggaatctttcccacttacactttttcatgtatccctatatatgtagagaggtgtatgagcttaacaaaaaacagtttcagtaatttaggaccacatatcttttagttaaaatcttgtcagtggttccatctactgacctatgcatttgtaaaggaagtgaatttagcttatatcttgtcactctagccttcaatactcatctattccagtacgttttttttgtagtttccctgttttctgtccaaagttgccactggtatgacctatttttgttgggccctgctctctacctgttgataattggttcatttgatgaatatcctatgttaacctgttcaggtaacatacttctgcaacccatttaaaatgcatatccctggaaagggcttataaggatggatcttagtgctaggaattcccatttagctcaggatctatttttggctttgtccttgggagggattgctattatgttgaagtctggacatctggtctgggtttggatctttggtggctttttttatgaagagagatgtgctggaccagtacttaagattgttttggcaataatgattatgtcttattaggcaggtagaggtaaaactgttaagtaatagtgatttgtatattacaaaaaaaaaaaaaaattgaaggcaactatctgcttttttggttagagatattagattaaataattctttgatgtttatccagatttttgtcttcatttgcatgcagggttggtatattttgtaaaaacttaaattcatcttaagaaatgcaaatgctaaggttcaccctcagaatctgattaaggaggtctgattatatatgaaatacatactagaaagtatgtatactttctttttttttttttttgagacacagtctcactctgttgcccaggctggagtgcagtggcacaatctcagctcactgcaacctctgcctcccgggttcaagtgatcctcctgcctcagcctcccgagtagctgggattacaggcgcccgccaccatgcccaaataatttttgtatttctagtagaaatgaggtttcaccatgttggccaggtgaactcctgacctcaagtgatccgctcaccttagcctcccaaagtactgggattacaggcatgagccaccgcgcccagctgaaagtatatatactttctagtttgtgatatattctaaagtatatctaaaggttggtattttggcattttgaggtcccagaactgaaaacataaatagttttttttttcatatgaatgtaggtcctatgaatcacttttattaccgcagtgtggtgcataatcaaacaaggaggacttagttgtcttaaaaaattatttttgctttcatgttcagattggtatccagttgaaagtatttttcaacttcaaaaatgggaagtctgggcaacaaatgagatatttgtgggttgtaatacagtataaaattgtgattccatcttttaatcttacaaataacaattgttctatagatatgtgagtctttttaaaaaaaaatttttagcatcacttctcaaaaatgtgagcataccacattttgtttttatttttcttttgctctatgataaatttccacattgaaagacaactcttaagaaataggagctcatagtttctctgtgtgatggaatataagttaaatcctgtttttatctttctgtcttaagtttttaattttatttgggggaaataagactgttaggaattaagtgttagcatcactaacaatctagggttaaagctatagctagaaacagcccagtttttaactggaaactagtggtagaaaagttctttgctattacttgccagtttccaaaaactgtcttgatacatgcataaaaacagcatattttagaaactcttataaccggtgattatcatttatctgtaggttatccttgagaactcagcctgaaagatagataaccagagagattggttataaggaaattatatagaaaataagtggtaattttctgctcagtaattcaatcatacagctatcttttgaatgcccatttacaagtagattttctgctagacacagttacattaaaaaaaaaaaacccacaacctcgtcatcagataatgcttacctaaataagagaaatgaatagaagaacctagttttgttgtcatgctaatatgaaatatggaaacacagaagaaataaaaaagcaataaagttttgtctaagacagtattctaattatgaaataaatgtacagaaactgttcataactgtttgcatgtctactaatttagtgtaatactcctattaggaaacagcagtattaaccctgtctatgaaaacattaggaaattgagatttgaaagagtttagccaagattaccccagatgttgggatggacctagatgaggcctgtggttcttggcagtcgaggtgaggtcagtgcagctatgttttgtcaattagtcacctcatgacttgaaaactgtagggcagcagtccccaaacttttcgggaccagggaccacagtcggggggatgtatgtatactttctagtttgtgatatattctaaaggggagaaggtttggggatgactcaagtgcattatatttattgtgcactttatttctattattattgcattgtaatatacaatgaaataattatacaactcaccataatgtagaatcagtgggagccctgagcttgttttcctgcaagtagacagtcccatctaggagtggtgggagacagtgacagatcaggcattaaattctcaaaaggagcacacaacctagatccctcacatgcgcagttcacaatagggttcgtgctcctatgagaatctaatgccaccactgatctgacaggaggtggagctcaggtggtaatgctaacgatggggactgactgtagagatgaagcttcacttgtttgcctgctgctcactcctgctgtgtggcctgattcctaacaggccagagactggtactggtctgtggccttggggttgggcaaacctactgtagggggctggagttgagctgatactactaggcctttccatagtataattggagcaaccagaaagacacagtcttttatttatttatttattattatttttttaatttgaatccgtagataaatttcagcaacttttctgaaagtttgcaagaagccaggattgagaatgaagggacattttggagcccttgtggtggtacagttctttttatatctagatcttgacctagatctacatatggccgttatagagagtgttgcttattgccttggtgtttctggacagtaaatggaacatcaagagttctctgtgtccatggaagggtggacaggattcccttgtaaccttatccattgttgtaattcatttgtgattgtcctagcagcacctgaaggactttgcattttacaaagatgtttagagaaaattggaagaggagaatcaatgatgaagatgaaagaaatgtggagattgggggtaaaggaagaagctgataggcagagattttaaaaatggtcatgccttgatccttgcaagtctttggttcagaaatgagcttcagttggagagcaggacactgttgtatgaggttgaagacagagtctaggttggaaggggacaggtaggtaggtctggttggattaatggaattgggggctcaggggacaaatgagttaagattggcatttgggagccttgccaagagatagaaaacatttgccagaaatttaagcatactgtcttttttatagtcagaaaattcagtcactcgtaagttgggactgttcacttgtctgaatgttttagatttaaagaaaaaatatagctctttgataaacaacgtggtgtggagctgtggtaagcctgctcttgctcctgactcaccgccgctcgctctcaccaaaaaacaggttggtcaggagatacagaaaaacgcccatgaagccagaggtggcaattcactgaattagaatcactctaggcccagcgcggtggctcacacctatactcccagcactttgggaggctgaggcaggcggatcacctgaggtcaggagtttgaggccagcctggccaacatggtgaaaccctgtctctactaaaaatacaaaaattagctgagtatgttggcacgtgcctgaaatcccagctactcgggaggctgaggcacaagaatcacttggacccaggaggcggaggttgcagtgagccgagatcgtgccactgcattccagcctggtgacagagcgagactccatctcaaaaaaaaaaaaaaaaaaatacgagaacacttggacacagggtggggaacaccacacactggggcctgtcatggagtcgggggaggggggagggatagcattaggagatatacctagtgtaaatgacgacttaattggtgcagcacaccaacatagcacatgtatacatatgtaacaaacctgcacgttgtgcacatgtaccctagaacttaaagtataataaaaaaataaataaataaaaagaatcactctaacgagctgcaaggtaaaatccttggagaaggtgtgtgccgacttgatcaatggatcaaaggaaaagaatctaaagtgataggaccagtttgaatgcctaccaagactttgagaaacattacaagaaaaacttcttatgaaggttctgagacatggtattgtttccagatgagaatccataagtgactcattgacttccacagtctttctgagattgttaagcagattacttccatcattattgagccaggagttgaggttgaagtcaccattgcagatgcttaagtcaactattttaataaatgattaccagttgtttaaaaaaaaaaaaaagaaaactatagagagctatctaccttttgggactaccatggtagcagtcatttgctgttcctttttttgggagggacgggaacagggtcttgcttggctggagtgcagtggcacggccacagcactgcagccttgacttctcaggctcaagcgattctcctgcctcagcctcccgagtaactgggaccacaggtgcacaccaccatgcctggctaatttttgtattttttgtagagatggagttttgccatgttggccaggctggtctcgaactcctgggctccaatgttctgcctgtcttgacctccccaagtgctggtactataggtgtgagccagtgcggccctgtggccagcctactattctttatagcctggctttgcttcacttttctactggtgcttgtgatagaacaatgaaccaattaatttttttaaaattccatccttaacatgtaaatgaggaggaaaccaggtcatttgccaaataaggaaaattcaagcttccaagggagtttcaaaaaacaatggaggatcaagttcaattgtaggagactttttgaaattctttttcttctaatacatattgcttaatgaaggtactcctgggcattccacatatttcaaaaatgtagtcactgaaccagaacttgaatcagttgtctgaatttctctggattgtggggctcagagtcttctccagccaatgatctggggtgaaggaagttaaagaaggcttcttcaactgagggaacagaagaatgaggagtgcagtgagaaaaggatgcctctatgggttgggtgtgctcccttcctcttgcagcaagtgatgaacagtgctatgtgggagcatttcccggacaactgactcaggtgtcattcagtgccatagagaaaatttctggtaaggaaggaggcttaagccatagtatttctcacagctgaaactgttattttgtcaaatttaaaacagttgttagtatattcatcaatgaaacatcattacattgtcaatgaaacatttcattgtcaatgaaaagagtcaaactgtaaaatctttaaagaggcttattctgagataaataatgtgtgaccaaggcccaaagcacagtctcaagaagtcctgagaacatgtgcccaacatggttgggttacagcttgatgttatacattttagggagacagaagttataggcagacaacaatcaatacatgtaaagtgtacattggctcagtctggaaaggggataactcaaagcggggacttctattccagttcataggtggattcaaagattttcttttttgtttttcttatttttgcttttttttttttttttttttttttttgagacagagtctcattctgtcacccagactggagtgcagtggtgcaatctcagctcactgcaaactccgccgcccaggttcaagcaattcttgtgcctcagcctcctgagtagctgggattataggcatgttgccaccacacccagctaatttttgtgttttttcagtagagatgagatttcgccatattgcccagggtggtcttgaactcctggcctcaagtcatcacccacctcagcctcccaaagtgctgggattacaggcatgagccacacatgtggccacattcaaagattttctgattggcagttggtcgaaataattaagttattatctaaagacctggaatccatagaaaggagtgtctgggttaagataaggtaaggggtcatggagaccagggttcttaatatgtagacgaagcctccaggtagcaggctttcagagaatagatggttattatctcttatcagaacgtaaaatgtgccagactcttagttaaatctctcctggatcaaaaaaagacctggggtggtgcagtggctcacacctgtaatcctagcactttgggaggccaaggcaggaagattgcttgaggccagcagttcaagaccagcctgggcaacatagtgagagcctgtctctacaaaaaaattaaaaattaaaaaaaaaaattagtcaggtgtgatggtatgcacctgtggtcccagctgcttgagaggctgaggtgaaaggatcacttgagcctgggcaaagtggaagtgagctgtggtcatgccactgcactgcagcctgggcaagagagtgagaccctatctcaaaaaaaaaaaaaaaaaaagagatcagaaaggtctttttctatagaatgttccacacaagagacagctttgcagggccatttcaaaataggtctaagaaatatattttggggtaaaatacctttatttctttcacagcctgctatctgttgtgtgatgttatactagagtcagtttagaatttggtattttattgctacaaagagtgtttcgtcagtcttaagatctctgttttaatattaatgctggtcagttgtgccagaattccaaagggaggagagtataatgaggtgcgtctgacccccgcttcccatcatagcctgagctagtttttcatgtttactttggaatgcccttggccgttcagtcagaggggtccattcggtcagttgaggggcctagaattttatttttggtttacaaaatcattccaagatcctctttagaggaaaaatttatagagattagtgggaatgatgaggagaactcaatcttgagagctcaatcaaaaggagatgtttaaatatctttttaagttggtattggtaaagtgctttgaagacagaaagaatgtaatacatgtctggtgtctgcttgtcctataattgtcggaagggcctcaatgatgaaataagggaggctgccatgacacttgagtcttggtgagaggagctagtgtgtccacatttatcaagatcacctgcaggagtttgggctggccccctcttattagtagtttctctgttttttaaactggaggctcagcgccttagtatctagattgggtagctacattatgaagataactcaaactgaacaatagagtattgggtattagtgggaataagaaatgcattgctctttaaagcagcagcctcacttccatctgcatcagtacaggatactgagaggcttggtagcattccacttgtaggaagcacacagaaaaataattgaatatagaaaagagggtctagtgtgacttggggattagataatagagcatgttgaattagatggaaataagcacatgttcactaaagtgtggctagctttgttccagtccagttgttcactgcagttgggcataattctgttttaattaattaccaattcaggaaatattattgcgataaagacttgaagaatttatgcatagaatcttgtcttggcacatcatcgaatgacaatgactattagtagaaaaaatgtagttactatcccagccttttgactaatccataactaattttttaagttggttaatgataagcaaactggccctcagtcagttgtaaattgatgacaaagttgttactataaagactgaagactgtcgtatacctggtgttttatcaatccaatgagtcacatggaaaagtattacaaaaaattatctgcaaggtaattttttgttcagatccttctgagatctggcaaataaatgtattcaccaactgagatttcttgtttaactcacaagttttctgtatacattgaagagttcttataaatttcctttgcagatcccattcagtgatatgcattctttgttaaataactcacagatactcattatgtctaatgtaatttttcattttaaataaggaattataggttaagatgttcttttaagactatagtatagcgaattgatggaatttaaaagtaaactttttatctttagatcttgtgaaagtatttgcagctatgcagatttgcttgagagattaataagcataaatatttaggcatcattgacaatgtaaattactttatattgctaaatctaacaggggccctaagcattgttaaagactggcaccctatattgtgaggaaagatttaagaaatactatggaatataaagattttttgttaatttgattggggggacaagtttgtataaatataaatgtaaataatttaacctaggaaaagaaaaagaaaattgaaaattggagctaaaataatttgatttttccctcaacagggttattggctgtcttttaagtgactaaaagagcgtatctttatgtgaattttaggcatggtcatatgattaatacaaggataaagcaaccaaatgctctcagtatttattcccgtgctatttgtctgttttttagttcatggagtattgtattgtacttggtaatttgatgcttttgagatgtcctttagacagatttttaactacaggacttcctctgtagaatcgacaatgtgtttcactctctgtggcattgacaatgtttttgaatgcctaattgttcagtagaactccgtggttattattacaactttgtacattattataaatattttatattagttgtatattccactgcagatagcaaccagaaaactaaatacagaaatattacatatagagagaatataatgtacaaaaaaaatcttgggagatgagtgctttgggtttaattctattttactgaaaccagagaataataggattcaaatctacctaatttttctatttttctgattttccatttttctctttttgaattttttccttttcacattactttagtaatttgttcttcatctcttatttttatcacctagacagaaaatatagcaaagcataaatcatttttcaggtcaccatgcttcattcttcttttattggggaaggggcagtggtgatccgggaagaagcatagtgtaaacattttaatacaaatttctctttttttttttttttgagatggagtcttgctctgtctcccaggctggagtgcagtggcacgatctcggctcactgcaacctctacctcccgggttccagtgattctcctgcctcagcctcccgagtagctgggattacaggcatgcaccaccatgcccggctaatttttatatttttagtggagacagggttacaccctattggcctggcaggtctcgaactcctgacctcaggtgatctgcctttctcggcctcccaaagtgttgggattacaggcgtgagccaccacgcccagcccagattcttcttgcattctgttttaaactgctcccattaataagtatttttatttgttttgcttttgacttgtgcccgtgtatctttttaaaaaactattctattttcaaaaagatgccctcccaaatagatacattaaatgcattaaaatattcctttactgtatgctaccttgttctaagctttgttcttaaatttacaaatattaacgtagcatggtccctgattttgaggagcttacattcttgtggaattgtttctcgaaaagattattaatatgaacatacagactagcatcctctccaaaaaccatcatactttgagaattataggtccagtcccacaccttttactggagatacatttggttttgtagctttttttctttttttccattttggagatctatttataaatctaccttattttgttgactactgtatagtatagtataatagtgaagtgaaaagttcagacagccatattcaaatcctggctctttattcactagctctctgattcttaaggatattaccagaatatcttaatatctttagttaaaaacctaaaatgtacattcaaaacttaaaacttttttgaaattagcagtggtctaagataagtggtggtttgagcatattccagccttagtgaggttttgaaaagctgggaactaatggtgtttcttggatcctaattctttactaagggcttgaggccattataggaggattctttccatttcatatttattaacaattttgaatttgcaacactttcatggaagtgttgcctaaagcatgggtccccaatttgcatgtcaaggaccatgctaggaactgggcttcacagcaggaggtgagcagtgggcaagtgagcgttaccgcctgggcgcctctcctgtcagatcagggtggtattagagtcccataggagcatgaaccctattgtgaactgcactggggagggatctaggttgcatgcttcttatgagaatctaatgcctgatgatctgaggtgttacagtttcatcccaaaaccatcatcccttcatgctcttgcctctgtcacttccgccacacccctgtctgtggaaaaattgtcttccacaaaaccagtccctggttccaaaaaggttgggagccactagcctaaagagtagaggaactgtacattcctacatccaacttaattctggcccaggtatgctttcatggtgccttcaagaaaatgcaatatgcagcacctcattattcatacaaataggttctatttgttcagccgaaaaacattaattacatatagcagacaaaaacacagttcttttatatttgctacaatggttggcgtctaacatagtgttttgttgcacacatattagatgcttaataaatgttatctgagagtaatattactccaaacaactccaaaacaaacatttaacagttttgtttggactcttaaattagaggtcagtcagtctgtctatccttccgtcctccttccctccctccctcctttccttttccatcctccccctcacctttcctttttctgtaaacttttccatagcaaatagagtaattccaaatcattttttggaacattcttattagtgttcattcagcttccctttccactgaaatgaatttattgagtacttggagtatttcaaaccctatgctttgtacagagaagacagtgctaaataggaaaccctctcagtgttagagggaaaggaagatgatgtggagggaaggagtctcttactctgaagcattttcaaaatcaacattaaagagtgaaccaacatttacctcctttcttctttcatcttcttatttcatagctagagagctgctgtgcgtttgagacctaagtggtgcaattaaatcaatttctcttcctacagtgctgcaaggacttctggctgacctatattggggcactttgctcttcattagagagccacaaaaacaattcccaagccaattaaattcaacttttaaaaaggaatttcctaatataccatagagttggtgagaaggcaatgaatgggtcccacaagctttcatgtagccttatgggaagagtaaaggttaagctgtgtcatggttgtcaactgggcaaagccactgaaaggcaggactctctattagttgacgtaacaaaatattaataactagtgttatgaattagttgcagtatgagctgaggtatgaaagcatgaattttagacctgacactatccaggagggaaaaaagtggatgtttctgtactgatgttaatcaaaggttaaaaatcaaatgacattttgaggaaaacaaacctaaacaactcattaatggccacacaacttaaattattgtgtgcggtactatgaatacgttgattcactacttccttcccgcttaaaatctccatttctccctactccttagtatatttatagagtaattatatgggaacatagtataggcagtgtagtagtctgctctggctgttagaatgaagtaatacagactgggtggcttcgacaacagatatttatttacttacagttctggaggctactagtccaagatcaaggggccaccatagttagtttctggtgagggctctctttctcacttgcagaatgctaccttcttgctgtgtcctcacatggtctttgttctgtgcatatgtggagagagcgagctttgctgtttctttctatcaaggacaccaatcctattggattagggctctacccttatgaccgaatttaaccttaattaccatcttaaaagccctgtctccaaatgcaatcacaatgggggttagtgctttttttctttttttggcggggggcgcgggggacagagtcttgctctgccacccaggctggagtgcagtggcgcgatctcagctcactgcaagctccgcctcccgggttcacgccattctcctgcctcagcctcccaagtagctgggaccacaggcgcccacaccacgcctggctaattttttgtattttttagtagagacggggtttcactgtgttagccaggatggtctcgatctcctgacctcgtgatccacccgcctcggcctcccaaagtgctgggattacaggcgtgagccaccgcacctggcggggggttagtgctttaatatgtgaatttgcagggtgtcgggggcgggatgggggatacaactgtatcataggagtcttcactttagacagtttctttctgtgaacctcaggataaagaaaattacttttccacaggaataagtttttggagtttacattcctgcctgaggatgttaaaagaagcatctatagttaagttcaatttttttttttctggacacagtaattcaggatgatccaaaaaaccccttgtcccatttttgtcctgcactgaagcaattcagactttctgtatttatttactttgtgtatttactctatatgcttttagtatactaaacttgcatgtttggatcaagatgtctggagagtttgggagtagtttatcttcgaaggcagagttatgcttctcaaacattttggttttagaatctcctttacactcttaaaattttttttatcgaggacccctaagagcttttgtttgtatgagttatttctctagatatttaaaaattaacactaacattttaaaaatatttatttaataacaataaacaccttttacatattaaataaaatttaaaaaaaagagaattattattttccaaaacaaaaggattagtgagatgcattatttttcatttttgcaaatctttttgatgtttggcttaatagaatacaactggattttcagatttgcttctgcattcagtcagttgtaatagcacaagtcatgtagcctgtggaaaactctgctgtacactcatgagagaagtggagtgaaaatggcatataacatattatgatgaaatagttttgactctgaaggcctcctgcaagggtatcagggatttctaggtgtacccatatcacatcttgagaacattaatcttgcgtttttcaggaactggagaggaatagtttaggagtccacagaaggtagaaagtggagctgttggaattgggcagcaagtttcttaagatagatctaggtcacaggaggggaatgttctggccaggcatatttgactggccacattatcagatgccttggttatgtgcggattctaccgtcatttatttcagccctagatggtgctaaagtagagagagacagatttttcttaaactattgcctttaaaaatcatttatttttatccccattttttttgtttatatccaaagggttttcaacaagctgcccctttcccaacaccccagcccctcaacgaaaacataatagagacacatcatttaatttctcagccctttcatgatctcttagactaatcttagttttcataaattaaaggcctacttggctaagttcatttactttttttttctcctacttttcttgatctctggacccaggaatcccagatgatacaaaaccctttgtttcatacctgccctgccatagaatgatctagacctttaagaggactagaatcagccctctttttctgggctttctggggccaggaatgactaggattgatctgctttctcaagctttgccccgggcctaaccaggtcagcctgggaccagcccgtggggtttgactatacctggaacagatggttaatctattggcttgctataatgtaatttccatttggctggcagtagggaaaggaaggtacttcctgtaagctacacactgattttcatccaggtgttcacacataccgggttttatgaaagagagcttgaccctcgcattcctgattagcattttgttagtgtgaaagtaaggtatagacacagagacaggtataatcacaaaatggttggagtcttttattgtgtccttttcttagagcaaatttaatagaggagtttgattagcacctaagacttgcttaaaactgagttactaattctttttccattaataattgctacctctaccctccttctcccacgtttctcagaaacccagacatccctgaggccatttaaagtcctgtttatgccgtagaatacaatgacgtacaaaaggacattcactccctgcatgttggcttcccttatatgaacataatatgtggccaaataatatgttgccatatataaaaatgtgtggttctctcatttctaggattttcatgtgttatcttggcttttcatctgaaagttttctcttgtccatttgtatcttggtattttctttttcaattaaaatattaatttctaagaagcaaacaaatctatgtcttagtttatgtatactaattcaagttttgttttttactccagatgtgttgatagaggttaatataagaaatgtttgtgttggcataatgcaaaggttatttttgattctgaacccatagcagtttctaaccggtgttcgtcagtttgtgcttgcttttatccttgaggttaaggattgctcaccaagcctttgattactaggtacattgcagaataaataaaatcgttgctagtgtatactctgtattaatctgtccacagcagcattgtcagtgatctcaaggttctctgtagacattagtattgggttatggcatgctaaaatagagataattgagactataaagttccaagttgaagttatcaataacaaccctaaaactatcttccttttctttccttctaaaataagacatatggtaatctgtgatcagatgtaaacatgtacatcctgaaatgtaattataaggtcagctggcctgagctagaattctattaatatgaaagtagatgatatacctacccattctaacccattcattcaaaataccttgaaatacttactgacattatagaaatttagcccttcactctgctgatgtttatagttaagtgtcagaaatacttttatacagaagaccttgtatggttcctttgtgtgagtggacagaatttgtggagcaaagacctggaatccagcatatgagaatgtgcaataattgttcaaatgaataagcttctcagatttggcctttgtataattaaaatcagagtgctgaagtgttgcatattcctcattcttctcattcttgcaagtctctctctctctctctctctatatatatatatacatatatacatatatacatatatacacatatatacatatatacacatatatacatatatacacatatatacatatatacacatatatatacatatatatatacatatatatatacacatatatatatatatatatatatattttttttttttttttttttttttttttgagacagagtcttgctctgtcgcccaggctggagtgcagtggcacgatctcggctcactgcaagctccgcctcctgggttcatgccattctcctgcctcggcctccggagtagctgggactaccggcgcctgccaccacgcccggctaattttttgtatttttagtagagacggggtttcaccgtgttagccaggatggtctccatctcctgacctcgtgatccgcctgcctcggcctcccaaagtgctgggattacaggcgtgagccaccgcgcccggcctgcaattatgtttttaaaacttaaagcaaaacaaaaaatgacccttctatccctcttttcatacccatattttggcaaccactgatatgctttctgatattataggtaagtttatgttttctagaattgtatataaattgaattatatagattttatataattttatgtaaatggaatcatacagtgctcttttttggcctgacttctttgactcagcatactggtttcttttttaaaaattggtgaatagggctggacgcggtggctcatgcctgtaaacccagcactttgggaggccaaggtgggcagatcacttgaggccagttgttcgagaccagcctggccaacaaggcgatagcccatctctactaaaaatacaaaaattagctggatgtggtgatgcacgcctgtagtcccagctacttgggaggctgagtcaggagaatcacttgaacccaggaggcagaggttgtagtgagccgagattgtgccactgcactccagcctggctgggcaacagagtgagactccatctcaaaaaagaaaaagaaaaaaattggtgaatagtattccactgtacagatctaccataattgtttattcactaattcaccaattgatggacatttgttttcagcttggggctattacaaataaagctgctatgaacactctagtataagtctttgtatagacattcagttttgtttctctggggtaaattcccataagtcgattggctgggtcatctggtactgtaagttttaactttttaagaaactgctaaactatctttcaaactgtttgtgccatttcacatttccatcagtggtatatgacaatgctgattaatttagtaaaataatctttttaattttagccaatccagtagatgtggttacttgggtttttatttgcatttccctgatgacttctgatgttgactatctttgtgtagggacaaggagaagtgggttttttggccattagttcaccttttgtgaaatggctgtttaaatcttttgcccattcctttacattggattatttgtcatcttagtgagtggtaagaatacttcaaatattctgaatacaggcttatacaaagatatatacataaatatattacacaaatgtatctaatagttctctctatataaaaacactaaagatgttgctctatcattttctagtttccagagttttttttattaagaaatccatggtaccagcctggccaacatggtgaaaccctgtctctgccaaaaatacaaaaaattagccacgtgtagtggcgcacgcctgtagtcgcaccaactccagaggctgaggcaggagaatcacttgagccctggaggcggaggttgcagtgagcagaaattatgccacttcactccagcctgggcgactgcgtgagactccatctcaaagaaatccatggtaatgtgaattgttaccctgtatgtaatatattgaatttttttcctagctgattttgagtatttctttacttttggtttgcagcattttgtgtcttggttttctatgagtttattcctttttgaattggtacattgatgtcttttaccgtatttgtgaagtttgaggtgattgtttcttcagataatttttctgccccaatatttttctccagtcattctgggactccgactgcatatgttttagtccttttgatattgccctacatgtccttgaggcgctgtttattttttcctcaatctttcttttctctgtgttcctcaaattgaatcatttctgttaatctttaagttcactgacttttttttctttgtcatcaccattctgctcttcaggccattcagtgaatttttcttttaagaatttttgttgtctgtttaaaaattttattttggtactttttatagtttctatttctctgctgagaatttttactttcttgtttatttcaatatgttcttctttacctcgtggagcataattataataaccgctttaaagtattcaataattccatcatctggtgattgcgttttccattgaggattgtttacattttcttggtcctttgtatttcaagtagttgtggcttgcatcctggacattatgggtgttatattgtgtagactcttttatcctctgaagaatgttgatatttttgttttggctggcgatcaccctgctcaggttcagaccttagttctgtttcaccatctgtggccagtggctccaatgttagtttagttctcctagcctttgtatggtaggcagaataatggtctccaaagatgtccatttcctaatccctgaagccttggtaatattttaggttacataatgaagaggagttaggttgcaattagagttgcggttgctaatcagctgaccttaaaataaagaggttatcctggattatctagttaggcccagtgtagtcataaggtttttaaaagtgagaaagtgaggcagaagagtcagtatcagagtgacaaagtgtgagaaagattcagcctgcacttgtggctttgatgatgggaggggggcccaagctaaggaatgtaagcagtttctagaagctgaaaaacagaaagaaacggattctctccagaacttccagaaggaatacagcactgttgctatcttgattttagcccagtgagacccattgtagacttctgacctccagaatcttaagataatttgtgttgttttaagccgtcaagcttgaggttaatttgttatagcagcaatagaaactaatagactttgctatattggtttgagtctgttctgcacatatgtagctcagtgattattctgtaacttttgcaggttcatgcacagatttaagggatcctcttttctgattctctcccctctgggatttcccccatgctgtatagcctacagggtctacttctggtttctctggatagaaatatgggactcattggaattttacctgttggcatttccacaccactctgtgaccaaagcctgccttcagggcaaagtagagaaaggaaatggaacaatattaaaacagaaactcacccctgtgtgttttgcttcagcaagtttttgaccctataacctattataaagtgaaatgaaaatgtggacacctgtgaagcggtccgagtgcaaaatttgtctagactttcaatttttttccccagtcttttagagttgtctcctacctaattcaacaacaattttagtggcttgcctttttgagtttttccagtgatttcagctgatcttctcagaattgctttcttcatctattttgcaagttaattgaattacctaatagctataccaagcataactcgaaatgccacagctgaacttgggcaagctcctaactccactaagtacagaagtggagccgtacagccatgaatgtcaggcatgttgtggggactagttgtattagttttctattgccaccataacaaattaccacaaacttaagcaatatagtacaaatttatcttaaagttattggcaggtcagaagcctgatacggatctcattgggctaaaacgaaggagttggcagggctgtgtgttcctttctgtaggctctgggcaggatccatttcctgcacttttttggcttttggaggtcgtccacattccttggctcctggccctgctccttcatcttcaaagctaccaaaggtaagtcatgtcctttttcattatttcactctgatagcctcttttgcttttttttttttttttttttttttgagacggagtctcactctgtcaccaggctggagttcactggcacgatctcggctcactgcaatatctgcctcctaggttcaagcgattctcctgcctcagccttccgagtagggattacaggcaccggccaccatgcccagctaatttttgtatttttaatagagacgaggtttcaccatgttggccaggatggtcttgatctcttgacttcatgatccgcttgccttggcctcccaacctcttctgccttttaaggacccctgtgattgtattgggccgtcctggataatctttccatctcaaggtctgtaaccgtgtccctagggattaggacatggacattttgggggctgggggaggattagtctgttgaccataccagttaatcttatttacagaggatgtggagagtaatgattaatatgttgagctgatgaagtagacaagtggctgctgtatgtagaagtaatgttggaacaaataatacgtcccagaatagtttctgtaaggctgattttactctgaaattttaattaatttatagttaatataactacctctgtattttgttgtagtcttttgtgggtagagttgaggaagagataggaatgggattattttgacatggctcatgatcaccaaaatgtgatccttggtcagtttacctaaatatcaatgtaattatgtttatctaatttaataatttgctgaaatcttccttattttttactttttatgaagcttttagccatttatattagatggtgatttttaaaacaacttttgaagacttaagtgacattttagtagatatgattgatttaatatgattttagttttagacttttaaaatttgatttagctaaatccatcctctatagctaattctccatatctgaccaaagttgagtatctgaggattttctaaacttgggaagatctaaaatttttgattatgaaaatttcttgtgcatttcaaattataagtcttattcatggctctaatgtgagtaatagtactaaataatattcacatgtatatttcaacacattttaaattcagccaactacttttaaaatttatctttttttttttttttttttttttgagaccaagtctcactcttttgcccaggctggagtgcaatggtgtgatcttggctcaccacaacctctgcctcctgggttcaagtgattctcttgcctcagcctcccgagtagctgggattacaggcatgtaccaccacacctggctaatttttgttttttagtagagatggggtttcaccatgttggccaggctggtctcgaactcctgacctcaggtgatccacctgccttggcctcccaaagtgctgagattacaggcgtgagccaccgtgcctggccaaaatttatcttaattcagactttacaattgactttattaaataaatatttttaagtagaagaaatgtttactgactaatatatgaatcataattaaaattgaacttcagttacgctaacaagtccactgaaacgtagctggagtaactaactgcagcaaaacttggttcaatgtagaaatctaaaacttaaagcaacacatgcaatatgaattgctttaaatctttagttgttaattgaaatgcattttaggcaaattggtcacattctagggtgtgggttggcgggtttcattctctaccttttcagccaggatacagttctgtgtcccaacaagtatagtgtagtcagtgacttttccttttatgatgaccataaatctcttcagactagtgtttgtaagaagacgggaaaatagtaaaatatgttagaattatttgcaccaaaaaccaaattttaaaaattagtagttttatcacctaggcagaaaacttttctattagaaattatacagtctctcatctcaaataccatgttttactgttctaagaatcaaatagtgctatagtgaaaaaagagagtagatagtttttttctgaaactatctactatactgtataacatgagaaatttctcaaaaaatatgttttttttttccataatcatgtctggtctcttttttgagaccaagatgaaaccatgttgcttggtcttcaaccatcagcttatctgttctctaatgatttttgttgttctggtttggtcttaaagttttgagaattcattttattataaatgtgaaagttcatttaaatattgtgttctttttgttcctgtaaaggaaaaagaatatctagaataaagtaataacttgtaccatgttgtagacttgcttcagttgatgaatgcttctcctattatttgaaaaggattcacctttcaaaaacaaaacaaaaaaaaactgtctaccatgcaaaaacaaatgactttctgaggttgcttaaccatttcctgtaagtatgggaaagcggttattttcaaaatcaccagacagaatttgggtagaactaaacttagctgagcagttctgtgggttaaactcacttattgtttcacttctatcttcctctagagaagttaaaatttaaaaattaaaaaaagaaatctgcttggttcctgtcatttttactaactagctgagtatctttggacagaagctaattgttttttttataaatgtaataggattagagattctctttaaaaagcttacagttttttaaaatagcaatagctattttttaaaaaagcttctggtttttaaaaatagcaaaacaaagtgtcagcagcatgggcactgtgctgtacgttcatccctcagtatcctctgaggattggttccaggatcccctcccccctaccaaaatccaccaatattcaatccctgtatatttgcatataaccagtttacacgaatcatcccatttactttaaattatctttagattacttacaaaacataatacaatgtaaatactatgtaaattatactgtattatattattatttttgattttttcaatttttttaaatctgccattcagtctatagatctggaacctgtagatacagactaactgtatttggataatttcataattttaatgagagaaaggggagaggggaaagcctggtttactgcccatgatgaagtagtaatacagtaaatttagttgagacatcagccaaccttttttgaatacctactaagtacctggctgagagagttgtagaaaccacagtgtcaatgtgtttctacacatttctataattgttggagttgtgtttatctctagaatttgtggtactatcctaaacctccatgcaactctttagttgtgatgtagaggtggctctgtgaccccccagccttctccagaggctatgtagacatgaagcgtttagttggaactagggacttgatttgacattcctggacttatacccaaagtctaaaagggtgttaaaggggtatacgtactgcagtcaaaaaaatggtgggtttggaacttggctctgctacttaatagcaagttcttaaacctctttgtttctcacttcagctgtaaaatgtgaggattaaatgttaactaatgtgtgtaaaatgctaattaatatagacagctgataattttttgagtacacactgtgtgctagactgtgttctaaatgcttttacatatcatttaattcgtataactcaatgagatagataatattattatccccatcttataaatgagcaaactgagcttggaaagatgaagtaacttgcttaaggctacacaggaagtggcagagcagtctggttccagagatacccttttttctttttcttttctttattctttttttttttttttcaggctagtcaagtgaagcaatgagggtggagaaggaacaaataagcctgtaactggttgtgatccattagttgtaaataccactgcactgggaccaacttccagagatattcttaattactctgctgtgccgtctctttattgcttagctgggtattagcatatgatttgccctcagtgaatgttggcttttatcaacattgtcagtggtggtagtgacgatgatgaacttggttttactttttcagtgtctaacctggtcccgtgctaggaccccaggcagagcttcctatgaagtcacgtacaacaaggcctttgggcttaagagaaaaagctcacagctgcacagagggaggagtttttatataaagaatacaaaatgttctgaataccaagtgtttcattctctccttatgtttctgagttgaaatttgaagtaatcatgagacactgcatgtgttcccatttcaaagatgccacagaatcataaaactagtatgtagcatataatttcaattttgtcttaggggataaattagtctaagaatagtataccaaaacattaattgtgataatagtgtagtgatcaatttatgaatgaaatgatcctctattactgcatggcacatcataaaacttaatggcttaaggcaacaaccattttctttgctcatgattttttaggtcaacagtttggattatattctgccgggtgtttcctctgctgatcttgcatgaggtcactcttgtagcagtcatcatctggcagcttgacttggagccggatggtctaagatagtttcactcatatctgccagttgatgatggcttttgactgggtttggctttccatgtggttcctcgtccccagggagcctagcttagatttcttctcatggggctctccagtagtaaaagataaatgttgaaagctacaaggcctcttaaagcctaggattggacattccacagtgtcatttctgctgcattccattgattaaagcaagttacaaggctggattcagtggcgatagaaacttcacctaataattggagattaatagcaaattcctttttaaaaaagaatgttttgtttattaattttttaaattgacacattataattgtacatatttatggggtataattccatgttttgatacatatctgtgctatataatgatccagtaaggtagtatattgatcacccatgcatttatcatttgcttgcagtgagaacattcaaaagtttctattctagccattttgtaatatgcaatattttactgttaaacacagtcaccctgctgtgcaatagaacaccagaatctcttccacttatctaattgtaactttttatcctttgaccaacctctccccatcttctcccttgtcccctccccagtctttggtaactactgttctactctctgctcttctatgattgatatcaacttttttttttttttaagattctacatttgagtgagatcatgtggtatttgtctttctgtgtctgacttttaatagcagattgtatcgtgatatccttgtctcctgatttcactgtcgtggatcaattctaaaacatcctaatagcattgatagttttttgttaatttattaagatcttggcagatgaaaacatgatctgtacatgtttgagaggtttatttctattttttaatataaaaataaaatatagataatataaatacccaacataccgacaactccacctctcagaaatgaccagttaaccttcttattttcagtgtatccaactggatatttatttaaatgtttataacctgcttttctctctttatattttgaatacttttctatgtttaaaataggtataaataattttttgtctgcataatatcttattcagtatgaatatacctatcccttgttgttttaggtttttctctttttttgctatgtaaactatactgctgtaaacattcttatatgtatatctctggcacttactccaaggaaaaaatcctactatgaagttacttggtcaaataagtattttggacttttgatatgtattgacgaggcatgattttaagaattctctggtttaaacttattagtgagtataatgttgcagagctgaattcattatgtttgagatcatgtgaaagggaaatttctgaaagctaatttgaaatagcaaccattaagaaaaatatatttctttagcatttcatttacaaatcaaaatgtataaacttagttgctaatattttcttgtttttctggtgttgcagttttttgttgatacataatagttatacatatttttagaattgatgtgacattttgatacatgcatacagtgtgtaatgatcaaatcagggcagttggaatatccatcacctcaaacatttatcttttctttatgttgggaacattccaattcttctatctattttgcactgtacagtaaattattgttaatgggtatgaaaataaagttagaaggagtaagatctagcattcgatagtacagtagtaggttgtctgtagctaacattgtcttagtgaccaaagctttcattttgcatttgggtccactaattagagttcttcatctttctttttacatgtggatatgtgttgcctttcattcatctgtaatttccaggtccttaaaaaaaaaaagtagattgagaatgcaggcattttgaagactgggtgcaaaaatcctagaattctgcctcccaaccccaacccccaaccccaaggtattaggtttttcttgcgcatacctaatttggcagcagtgttattttgaggactcatttttgtaggatctttctgatacataactcagttttcataaaaacaatttttatatttttcatttaatgacacaatatttaattattataaaaccataattacaagtttaactaacataaatcagcttgagaacaaacaactaattcttagagtagagtgcctctggtgagagcatatgtgcttggaccttctggagagtagccctttagttgtgggcattcattgagcacttagcatctgaaaatgtcttacagagagaatggaagacattggttaatttggaggtttgttaagtcaacatgggttaaaagaatttctaccttgtttgttgtgatagtcatttttcttcttttactgaaggcaatgacttcttcctcattaaatttttttaggttttagattttatgattaagatttgtattatattatagttatttatttggtcctgtccttgatctttttcacagcaggattctttatgtgctacggtttttgtttctgtttgcaattgtccttggtcattggcattctctagtggaatttctccttttcaactaaaatgttctcctggatagatatttaaaacaatgtgcaaaattaaaccagaagtggctcatcttttctgcttcttttctttagcactgtaatgttgattttttgcttataggactatagaactgcacagctgcgattagacttcataaatataacgcagtagagaatttgaaagtgatggaggccaagtgtggtggctcacacctgtaattcaagcactttgggaggcagaagtgggaggattgcatgagacgaggagtttaataccagcctgggcaacatagtgagaccctatctctacaaaaatttttttaaaaattagcttaatatggtggcacatgcctgtagtcccacctagtcaggaggatgaggtgggaggattgcttgagcctgggagtttgaagttgcagtgagctataattgtgccattgcactccaacctgggtcacagagtgagactctgtcttacatatatttgtgtgtgtgtgtgtgtgtgtgtgtgtgtgtgtgtgtgtgtgtgtagtgaagagaaacctggccctaccagtgatggagtcctggctttaccacttagtatatgtcggaacctcagttttctcaaaggtaaaatgtggataataactgccctgtctacttatattattgtaggagtcaaataagataagtgggtcacaacacttttcaaactatgaagtgctttattaataaagagctcattgctattatattaaataattaggttagaagcttcaaaatcataagacaataaacgtgtctttaacttttcagcaaagcacactagtctttctctttaagattcattagcataatttccccctcatgccttaaaaatgatgtttcattgtcattcacagcacacattagtaggtaaattcttaaaatatgaaaagtccagaaaccttgttttgcctttaacaccaaaaataccaaatcacttacgtaagcaacaactctggcctcttgacgtcttttagggtcagctggaacaatgtccgtggagaaccctcaggtatagtggaactttagatattatctgtttcacagagattttgacacacagattttacattttaagtcatctgacttctaagacatttgtcaaatggctgccttgatataaaaacactataactgctcccaaaacatccctaagaattaagtgtctctaaaggccatgttcatgtactatactgcatttacacagtaaaactcaacgtactggatgacagctacaatttgtagcctggctattattattattttttttttttggtagaagctgggtctcactgtgttgtccagagtggtcttaaactcttggcctcaagtgatcctcctgcctcagcctcccaaagtgctgagattacaggtatgaaccactgtgcctggcgtcttcactatattttatgtcttctaaaccataattgacttgaattatcaaccagctttgaggaaagaagaggaaaagtagtaagtatataaaaagtagttctcaagaatcagtgtctagtagaactgaaaggcagtgactcagatcccatagtcactgaaatactactaagtcctcctgatttaagatccagccccacagcaggtattagaaggaccttgttaaccttatagacagtgtatgaattttatcttattccaagcctccagtaaacctggattcagcccttgaagagtttatgcatggacatggaggtaatttttgtttatacttcattttaatatattagattattgctactttcatttcaacatttatggcaggtttcttccctgctaggcaccaggaatacaaagatgaatgaggttatgaacctctccttggaggaattattcatatttggagcaaaatttataattgcagtttacttatgcagaaattctttttttctacagcataaaccgggccttgagagtttcctaaaccttctatcctcaacttctaattcttgaacagcaaaaagttaccaggattgaaatgtatccgttattctagaaaagtaaatgtagagcaggttttggaactcaatatttcatcctaaatgtgaaagactgtataggcaaatagtgtgcataatttcctttttccagggttgaggggctgccagtggtgtgtagtggggagagagtgaagtgactcataattctggaatgattgttttgatctcctcctgtagcctctgtaggatactggcagggcaaccagcataattaacactacacagtctaattataaacaaaactctatgtacagtggctaccaagaagcaagcctgtactggataatcccccaagttggcaggattacttttagaatgattattagatagtgtcgtttactataaatcaagttgtttttctttgattgtccagggacttaccctggggggaaagtgaatataataatatttgtggaagtcttctgggttatttttttcagggcccatttaaggatttctttattgcagttcttataacctttttgtcttaagagaacatttgtacatcttactatgtatggcgtactcttttagggagagtaggaaaattggtcagagtaagacatttgttccaataatagttggattggtttttttaaaggtgaaagaaactaggaatttgaaaagattacattggaccggtataataaataaagagggagaaaaaaagcctatgggctgcagagaagaggatgggataaggggacaaagtgaagtggctatagctgccatgcatgcttgagagaaaccaagatgtttgtaacatgtgtatggtctcacatgctgttcagaggcagagcaggcactgtgcgtggttgtatgtgctttagggatttgtggaagcatggctgagagctgaggaccaatttagtttgtttatatacagggccactgggtctcttagatttagaacaaagatcctagctgtggagatttgtttcacatagctgtgacctgaacaactgcagaatggttatatttatgcaaaatgagcctcagaattgtgattacctcaaatgaagtaagaattttaaatcagatacttcaaaatgagggctttttttcctatccagaaaaactcagttaaaatttaagtggacacttaaaaggagtttccctttttaagaaagaaatacagaaatccaaatacaaaaatgaatgttaagtagttttttgcttaagaatgcttgctttttttttttttaacttttgatgagctcataagaagtttcctttaaatagcagttctgtagttcattttaaatatttggatttacaaagaaaatttccctagctttttacttgaaaggagagggagaacatactgtatttttctaaatttgggcataactggtattattactggctaaataattttgtgtttgccagatagtcttgaaagagggacagatgtaagacggctgggcttgttaaaagatctctgtctctagcctgtgacccagttctgatttgtccctttaaattacctaactagacttttgagaagtgaaaaattggttttggagatgcaccaggacaatggtatgtgtggatttttgggccagtttctaggagaatatgagttagagccgtccacactactttcctgccctctagcagcattttttgcattatttttcagttgtttatctggtttctattttgttgatttttgccctgttttttttttattattttttctacttaggtttaatttggtattcttttctaggttcttagggtggaaatgtcgttatttttaaaccttttcccaatataggcatttaaagcaataaattttcttgaattttgatatattatgtttttattattatttatttcaaatattttatatattccttgtggtttcttctttgacttatggattacttaaagtcttttgtttttattttccaaatatctagggattgtttacctaatttactaattgattttttaattgtttccattgtgtttagagaacaaagtctctaaaaagcatatttcagtcttttgaagttgattgtgatttattttattttattttgctttattccatcttggtgaatgtttcatatgtatttctgcagttgtttgattttatattctgtgaatgtcaggtcaaattagttaatagtattgttccgatcttccgtgaccttacttatttgttgtctacttgttctatcagttatgaagagaaaggatatggttgtggatgtttttgtttgttctattcttcataaaaaacttctttttgaaacactgttattaggtatacatatttaagattgatatcctgctgaatttctccttttatcatcataaaatattcttctttgttaatctatttgtgtctaaatttaaaatgcatctcttacagacagtgtatatagttgtttcttgctgttttgtccccattgtgacagtctctgttacaatgtttaatccatttacagttaatgcataggtcaggtttaagtctaccatgttgccactgttttcatttgttccttttgtttttgtttatctgtttctcctttattcattttttttggattaagtgggcaattttagtatttcattttattttctctattggattcttaactatgcatctttttaaaatcactttttcagtgtttcttctaggattaataatatgcatcattaagtctgtgtatagtcagtattgtaccatttcacattctatacctgacccttcttcctttctgcttaatttctcttactcaacttctgtattctctgtgcttttgttgtcttttattttttggttttaagcatacagtttttaaagatagtcttttaaggaaattataagaagaataaagaatgtacaccttttattttaacatgtattatttctggtattctctccttcctgaagatctgagtttccgtctggtagtagttcccttcatcctgaagaacctcctttaaaatttcttgtagtatacatctacttgaggaaaatgtgttctaaatgaattctgtaagctgtcatttatttgaaaatgtcttttactcttgattttgaagcatattttcactgtatgtgcaaagttgagtttagaattttctttgtcttccaactctttaaaaatgctctatcatcttcaggcctccaccgttgacatgagaagttagtgtatgtactgttgttcatctgtatgtagcattgtttccaggttctcttaaaggttttctttttatctttagttttaagcagttttgaccatgatgtgcttaagacattattatttgtgtgtgtgtgtgtgtgtgtgtgtgtgtgtgtgtgtgtatttatctttttgggggtttgctgaacattttggatctggtaagtggtgtttttcatcaaacttaataatattttaactattatttcttcagatattttcttctgctgcattctcacactccttctgtggctcctgttagatacatgttagactgtctgatactgtcccccagatccctgatgctgtgtttatttttcttcaatcctttgtctcattgttcttcaaattggtaatttctaatgatctgtcaagtttatggactctttcttttgctgtctccaatctgccattaagtccatttagtaactttttcattttatttattgaacctttttctcctagatttttcttttttccctctcatttagttcttttttagtcttgatttccccacggagagtctcatctattcacatattctcattttttcctttttaaaatacatcttcctgcttaatgatggggatacaattgaaaaataataaaacacgtcttcttcagggattcttttttatttataatggctactctaaagactcactaaatacaatgcaatatctggaccaccttaagattgctttctaatgattttgtttacttagggttcacattttcttgtttcattaaatgtctagtaattttttattacatattgaatagtgtcaatggcacatggtagagatgctgaattaaaaaaaactctgtaaaatgttgatttttctctctctgtctctgtagacagcttagttactggctgatcaccttgtgtaggcttatttttaaggcagatctgtggaaagcctaaggtgtttatcaggctcctctaacttagtgagactcatccttaaatactttttcccctgtggattttattagggcttggttttaggctttgttactatggatctagagtaggtcttattctagggtgtcacctttacttctacactgaggcctttctagtgtttcaagctgatgcctagggtgttatgagttctctttgctctggctgggttgacctgccactacttccctgcactgcttgacctctagtatttctgttctgtcttaaccttattgcagctactttcttctacacctcatgtcctaaattggctaaggactctcagaaaaccttgtgcaaacttctgtgactcccctctgcacgtgccccccttcaccagcactgctctgcttagaccctagcttgctgaactacagttgggaaattgtccccagagaaccagagtgattgtgggctcacctgttccttcactcagaggtcacactctgttagctagtatgtgcaaacaggtgtattgttttgtctagtttaatagttgtttatgagaggaatgataatctggtaccaattactctgttatattgaaagttgaagtctctcccagtatgctcatggactgaatcattgctcgctgatcttctcgcctcccaccctcagtcatccatttacttttctcttcacaagggagacaaagtcagggtgaggggcagcagaagaaagaccttacttggatcttgctccaatgtcatgaccttgggcctctgaactagaaaattaaaggtgttgtgaaaaagcacaatatactaggggtaaagtagtaatgcatgcgggactttacatgttcatattttatgccactgcttatacattgaggtgttacacaaacaggtgtcaggaaaagggacgacttagatacatcttcaaaacttgtttgctgttaatgactgcccttcagattctggtgagataagatacatctaaacttgtaacttctcatgagcactgtaattaacaggaagagattttctttgagtatgggtttagcgggggttgggtagtgttttgtccatttggacctacccagaaaaaaatcaccttttttttgttctaaattctagtgtttttctttctttttaagcttaaacttaaaaaaaatagaattttttttgatagaagagtattctcattagggaaatagttactttatatgatacttagtcatcactttggaaatttatctagaaaatattttaagtgctgtcccatacttggaacttatagttctatataaatatgtcataggggactcagaagaatattagacttttttccttgttactattctctaaaaaataacagtataacaactatttatatagcatttacaatggattggatattataagtagtctagagatgatttaaagtatgtgggaggatatgcaaagattagatgcaaatattacagcattctgtagaagggacttgagcatttctggattttggtttcacagggagccctggaatgaatcccccacagatgcctagggacagctgtacatcctattacattttctcagaaaatgtgatggcagcttaaagctttaatccttctaaagtctgtgagaagtttgcttcttttagttcaagttgctgttaatgttgtttgtcatggcttcgctttttgtcctgtcttctaaattgtatccctcaattgatgacttgctctcttgccggtagcctctatgcactgtaaatttgccttctcaccacatcctccctatatgtttaaccctgtctctgtctcctacctctgctttctctaccttttataaacattttgtttaacttttattgtggtaaaatacacataacacttctcttcttttagacctgggctggtaagaagtgctgaagatgttttttagagatttgtggtatgacaaattccactggggtttctgaccttctcagtcatgcttgtcttggggtcaccactccttggccctctcctatggcacctgtccctcattctgctcaagcccctatgccttcccaacaacttgcctttagctctgggcagatgtctttgcttgcacttgtcacagagaacatgaaggctctctgctgttttgtgcccatgcacatgcctcttctctgtctttacctcctgtcctccaggcttggagggagagcacctagctcccatcattttcttgtacactctccctgtccctctggatgctacgccagcattttccctcccctactccttcacctccacattttgtctttctttactgttcctttcctgcagaaatacatgcccaagttgttcccatcttaaacacagacaaatgaaaaacaaaaggatttaagttttgtctataccacattttcctttagtttatccctatgttttttccttgataaactactacataccttcaaagaatagtctgcagtccttgttttcttttgttaactttccatttcttctttgggcccctggaatcaggcttctactctcactattaaagtcactggttccctggttaccaaatgtaagggtctctctaggcctcattttacttgacctttctaaaatatttaatgctggccactttcatctttatgaaagctttaggtttctgggatgccactcctgattttcctacctttggtccatttcttctcctttgctgaccttcttcctctggccacccagctcttaaatgctgatcctccctgagtctccctttcgatagtctcatttatctgcatggttttaatgaccatatctgcacaggtgattcggaaacctgaatcttccacccagatcactctcttgagctctaaacccacgtaacataatccttttaacaattctacaaaatagcactgtttcccacatttataggtgaggaaattgaggctaagaaaggtaacctgtttgaagtcagtggaaaagccaggattttaacgtctacctaaaatcaggcctttaactctattaatcaaacatctccacctggttatctgacagatatatcctacactgaatgccatctcataatcctgttctccttccttgcctcaaaaaaaattagaaaatgtgaaagactatattctcaatctcagtgaatgacattccttcttttcagttatacaagttggaatgtaaagggaattgacatagacttttctctgtctcctaccctgcaggtccatctagcccgaggtagtatcagttcttgtgcatctacctttttgacgtgacttgtaatcataccctcctctttattctcactgctactgacatagttaagaactttatcttgactgttattgccattatagtgacagtctaactcactgcttctcacattatctgagctgaagaaccagggtttattgtttctgtttttttaatttttaatctgttgcagaaattttgtagcatataaaaaaattaattagaaaaatgaaatgaaaaaagacatacaaaaatagctcagttttatacattattaaattcaatacacataaaaattactctgtcaaattgtcataaaagtttttgggtactaatagtctatgtatatcctgtcccagatgggtcacacttttgcacattggcactggtccacaaacaacattgaggaatgctagttcacagtatctgatgaaaagaaatgtcttcagttctcttagattataaccacatgggcctatgttatttaaaactgaaacatttcagtagaaggttctttgctttgacttatagatagcttctatatgtggatttaagaggttttagaaaattccctgtttctttaggatcccttctttcagtaggaataaatcccatcgagcaaggggtaatcatgtgttatgttacaatttaatgccaaaatcaaagtgtactgacttaagaatcaaatcaacattttcttaaataggcttgaagtaccttcatgtatcttcatgggatacctgtaataaaagtgattttccctgatttgatatatttaacttgatatgattgtgcatacaaaaaaaaaactgtgcttctatattgcacagtgaaatatagcaaatgggttgatgtgatctccatttctgaaagattaaaattctacgttggtattattctgactgggagtgaaataataaaagtaagttatttggatttaggcaggcatctgactaagcccttgtcagaagatttgaaattaatgacatgcagacaggagataccaaattgtcaaactgtagaatatctcttggctttaaatggcatggcagaagaataaaaaaacacagcaacaaagttctaaggggacagaattgagagattggaatgctctaaatattaagctgagattgtacctggagttagttcagaaatatagtaaataaaaccatgctgtacagaacccattgttgtctgcagtaggcctgacacagaacaaaacacatggggcaaatgcctgagagcataatcttcccatgtgtggtaaaaaagtcaaaaaaggcctttttagacatttttaaattaaaaaaaaaaattaagctagtctacagcagtgtgccaggaaccaaaaaactactacagaaactttctaatcattaagagttttaaaagcaattttaaaaaattgaatacagcaatatttgctctgttaatgaagtgtatgacccaaaacactattaactatcaaaacagaacatactttttttttttaacaagaaattggggcactataggaagtttaggagattatattcccaaaagcagtatgttagaacccttcttctttcatagtagatgggtagatggcagaatgctaaactcatacctagaaaatgattagaagttttattcaaataaaaattttaaagtagcataacttgtatacagttcaggttggagaggagtcaggaaaaggtaacctcattgtgatccatatgctccccaaagcagaaatgggtgaagtgaaatgaaaagaaagtttattttttaaaggtaataaagacaaaggaaaaacaaaaaaacataacttttcttaatttgtgttgtagcaagttaagctgaggtacggaataccaggtggatgggcatgggaaagggagatgatgacactgcaagcagagggaagagaaaagaaaaagagacatgtggaggatagcgtggaatagctgcctggcctgtgctcaaaatagtaagcagtttgggatggccagagcatactcaggaatggtatttagtgctggctgggatctgaccatggaagatgcttataccagtgcctctcaaacttaagtgcacgtgagcacccgaggatttgttaaaattcgtattctaggtggagacttcagaggctgcgtttctaacaagctgcaatgtgatgcaaatgctgcagggtcacaggccacactgaacagcaaaactgcaaattttatcctaatatttatcaataatatgttttatggatgaagagtttccaccattacagtgtttgttgaatagcacaaaatacatagcatttatcttaagctagatattcagtagttttttgtaagctttgctctcctgatggtgaaataatactcttagcaacttcattgccaggtatgaaataaataattcagggctctcatcttttattgaattagtttgagtagagggatgcaatataatgaaaagagcataaacttttgaatcaaatttttagacctgtgctttaatatcagttttatgactaaatagctgtgtgactttatgaagacgaattaatctatttctctttttctattttctcatgtctaaaatagaatacttgccattttataggattgttgtaagggttagaaatgataggtataaagtatcttcccttgtagggaagattagtggaggtttcaatttgataacttttgagatcccttaaaaactaaaattgtatgaattttaaataaaaaacattgaacgatctaatcctaggaagtactgatatatgggggattatcgacccttctacttctagagtcttttttctcagtgattttggcaaatcggaaggtgtggtttgttgtagtttgtaaaagctcccactgagatccactaacactcatggtgtgcagtatggttgtttcccatggaaatatgttgtacttctgaaagccatggaagcatgaaaaacagattgaattataattttatctgacttttattgtcttttgatctttttaaaaatcatttcttgcttatggaaatttcccatataatttgctgcttcccatttgctgtgggacagaaacattcctctttcaggggaaaacaataacccatcctgttgcttagccatactcaatcttagaaatgggcataccagcttgtggtgctccctagagagaatgagactcagggatgagacccacaaataccttggaagcagatttgaggcctgttggacagaaattctgggattgcagtgcccaaaccctagaaggggaaccgtggactgtaggtgggcacatccctttgatcctactgactcctcgcctggtggggacagacatagtcagaggaatgccaaaacagtgccctctcaagcccagggcagggtcccaggttgtggggcaggagtatattaaggaaattagtatattatctcagctaactttttaaaaatataatagcctgtttatttagctttcttgtttcataactgtggtatacttttatttatgttttagtttttaatggatgactcaatggtataaacatcttatttaattcagtagctctgagatggaaataagtcttagtgacttaaaaaaattcttagtttaaatgtggtctaggtagaagacatgttattaatattatgagcttttttttttctaactctgtgccttgttcttatgttttggttttttagatcggcttcagctccccaggaatatgattgaaaacagcatgtttgaggaagaaccagatgtggtggatttagccaaagagccttgtttacatcctctagagcctgatgaggtggaatatgagccccggggttcccgactgctggtgcggggtcttggtgagcatgagatggaggaggatgaagaggattatgagtcatcagcaaagctgctgggcatgtccttcatgaatagaagctcaggccttcggaacagtgcaactggttacaggcagagcccagatggggcttgttcagtaccctctgcaaggaccatggtggtctgtgcttttgtcatcgtggttgctgtttctgtaatcatggtgatttacttactgcccagatgtacctttaccaaagaaggctgccataaaaaaaaccagtcaattggactaattcagccatttgcaacaaatgggaaattgtttccatgggcacagatcaggcttcccactgccgttgtgccactacgctatgaactcagcctacacccgaacctaacctcgatgacattcaggggttctgtgacaatttcagttcaggctcttcaggtcacatggaatatcattcttcatagcacaggtcataatatttcaagagtgacctttatgtcagcagtttcaagccaagaaaaacaagctgagatcctggaatatgcatatcatggacagatcgccattgttgcccccgaagcccttctagcagggcacaattatacgttgaagatagagtactcggcaaatatatctagttcttattatgggttttatggcttctcctacacagatgaaagtaatgagaaaaagtaggtagccctcttaaatgattctggttttacgctctgataacttctgcaatatagatccctttgtccacaccagagacacgaattgtgatttttttttttaatttaggaagttatatacaaaatagtagaatggtgatttagaacaatatattatctctcttagtcaacgccttgagcatatatcatggtggggtggagataggggtgtgctggtggaaaaggatggataaagattatatccaaaacttgttatcttgagtttttcacatttttaaggtgaatctagttttctgtcacctcatgaagtctgttgggaagcagagtaaagaggagttattctttaagacctattttcctaatgtgcagaacttttaggaggtacttagtgaaatacagaaagagggcatgaagaagtgtgaagtgtggtgtgcttacatatatcatttttaatatccttaatctttactggtttattattttttaaaatgccagtctattttggatttctggtgtaaattttttttaaggtctaggagagacttaatttggttcagaaaaaaaggtgagacaaaatataaaattattcagctccctatttggactatatatttagtactttaatcttagcattcatagcatgtagtttgaaattctgggaagatggagttcacacagtatggaggttattcttaagtagcagtgatatcagttgtcttgtgcacaaaatcctcacgacatctgctttatgcaattggaacattctctcatattactctgtaaaacaatatgtgaattactgatgctgaccatttggctaatgtatgttgacatattaagagaaatagttagaaatgagtattctacatctaaaggaaactttttgatccttcttaaatggagaaagagaccaagcaagatccataattctattcagataaataatttttattttattttccctctatgtaatacttttaaaataaatggcatactggccctgcatttcaattcttgcgtgagatctgggattgaacacaaatgtataattgcaatgggaacttgaaagttcttgcctttagttctccttctataatgcctattatccccaggaaatgtaagctatgtgtaaaaacaagaaatacatcccttaattactttatctaccagtataaatatgtattctaatcatacctcagagaagaaaaatttataaaagcttctctaatagaactaagcaaaattaaaagagagaaagacaaaaaaatggctttgaattatagttttcagacatcttgaaaggtataaataatctaaacatttacctggaatcaagatatactatcacttgggggattcattttactgatacttttattttgttttgaatagcagagtttcacgtactaatttattttaataggttgtaaaatactgttttataatactctatttcttaatcttaaagaaacatatttcatttttctgacattttccacaactcaatccagcccatggcaagagtcaacaagtggccgtaccaaaaatcaccttactctgctgtatttattcctcccattaaatagttaacgagtacaaggattccagggtcaatattctgatgggaagagatggctagggcacatgtcctaaaagtctgtttgcatactaagaacatatttcttgttgattggaaaaccattgtatgtaaacgtcagacaccttgcgtagacactgcttgttgtaagggaacttacctttacccatgtgatctaagagacagagacagtcagtaaccttggagttaaatctcaaagttgtttatgataggcttaaagtcctagataacaaactgatactaagaactagtaaacaaattcaggatagggatgtgtttcagcagttcctcgtttctaacagaatttaattcaagaccgtttttgatctacccttgttttttctttctcatagttctcacctgccatggtgaactttctgatgataataatagccagtattcacctggaactgaagggctggaaactgttccaagcctcttacgtgtttagtcttttattctgtcaaactcactaagagatagatgttaacattatattcattttacagctaagggagcagaggcacataaagtaacttatccagcatctcatggcaagcagatagcagagggagaactcaaactcaaggtcattttaactgcagaagccacattcttcaccaccatggtgcactgcctctctagttcatacttgctttcctttgtacattgttatctccagtgtttgaaattctcttatccccagttaatttgtaattgtcttgaacactacttgataaagtgttcaactttagtatttcagaaaggaaatatactctccagtgaaagaataagcttcaagttattcagcatagatagaacaggttataagtattatcaagcagcagccttctcaaagggatttttatgtgagatagttatgattggatctcttaacaacagtttaaggctttttcgccttagtgtgttatgatctaatttttatccaaaagtggtgggtctctcttgtatgaatagtagggataacatcaaactttattccctggtcccttatgcttctcttccaaaatcttctgttaactacataagaatgttgggggtgggttgaagaaatgaaatgttagaaacataatatgtgtaaattgtttcatgtatgttgattgctacctttcttgcagtttacccaattcgatagcaacagttatttgggcacacatccttaacagaaaaaaagcaaaaacaaaagaatacaaaacaaaaaaagtacacaaattttaagtgtggaagaagttaggactatcttgcatttgtaataaatatctatttaggaccatatgatatacaagtagtttttattataaatagttttatttgattctaacaaaaatcctaatctttaggaccatatggtatacaagtcgtttttattataaatatttttatttgattctaacaaaaaccctggtgtttggcagtggattctatctcagtcctaatttaactattaaggacgttgggatgtatgagatgtaaggacattgagatgtatgagatgtaggttactgatttgcccaaagtcatgtggttagtaaattatagagtctgggtcttctgactccaaatctcatactctttcttttctccttatcttctagtagtggaaactaagcccaaaatgagagaggctaccacctccaagtggtggttgtatatgtgctatattgattggtacctgaaatatgcacaccagggccatatatttgccgtgattatagccacgctgggatgatctcccaagttcagatctagttattcttttacttaactgaaaatctgcatttctccttgtttctttttatgcttttccaccaacctgtaatcgaggacttttctttttttttcccttgagacagcatcttgctctgtcgcccaggttggagtgcagtggtgcaatcttggctgactgcagcctctgcctcccaggtgcaagcgattctcctgcctctgtctcctgagtagctgggattacaggcatgtgctaccatgcctggctaatttttatatttttaagtagagatgaggtttcaccatgttggccaggctggtctcaaactcctgatctcaagtgatccgcccaccttggcctcccaaagtgctgggatttcaggcgtgagccacctggcctggactgtaattgaggatttttctgtgtcatattctcaactgttgttggtgtgctacagaaagaggaggaaattttttttaatctctgaggcgagtaaaggaaaccagaatactacaggacacctaattttttcaatcttcatgaaaatgcaagctgtgaatttgaggtttggtatcgtgaagccagagtctgtacagataattcgcagcaattaatgaccacccttcttaataatcttccatcagaaacctttttaagacctcagtggccagttgcagcctacctttgtggcttcatctccagccacactggacagccacccccagtttctgcacatgcactgctctcttgtgttcccggaccaaactgagggtcaggctgctattttttgctgccccaaaacgagatgcagatgaactgggaagagactttttatttctataaccagttatatagggagaaggcctggaaattattgccagaacaactcaaaattacaaagttttccagagcttatataccttctaaactatatgtttacgtgtaagtgtgcatttctctaaagacataagtgattaacttcttttaatccataactaaggtccgagtcttgaagaccttcctcttgagcctcagtaaatttacttaatctaaatgggtccaggtgctggggtgattacccttatgttgtctcctgctaaatcacggaggtttggggagttccttcagacctccagtaattgtttgtggaggcctggggagtttcttcagaccctccaataaaacttatttaatcctaaatgggtcctgttaaaaattccttcattattttgtcatgctttaagacccaggcaaaactcttggtgggcttttgttaaattccagcctttgtataagggcactggcttttaatatttaacttaaccactcagccagtactgaaacagttgttatggaggcctgcattagtgagatctggcttgccacacttgtgttacccactctttccagagtatactttcttcccttcttcaccttttcaaatactcatctttttaggccctcttcaggttttctgcatgtttccttataatatcttcaacctctagtcagaatttgtttccttccctttgttcccactgctttattttcattgttaggacatgacttacagcctgatgtaagtttctgttcattgtataaacctctgcctttcccagtttattgcagatcctttagtaactaggattgtaacatatttatcttagtatacttggcagggtgccttgtacagtaggtgctcagtaactactggattgaatttgtgtttgttttaggtactttgcagcaactcagtttgaacccctggcagcaagatctgcttttccttgttttgatgaaccagcatttaaagccacttttatcatcaagatcataagggatgagcaatacaccgctttatcaaatatgcctaaggtactgttctgttccttgaatgtaaaaatctttgaatgggtctctttctttaagaacacttaaattcctctttgccagactacagttgagaatgattaaaatcatatacattaatattcttccttaaaatacttaaataaaaattaaaatatattggcatcagttgggaagtcaccttgaggaggacttgaggaaagagaaagacctgctggacttggaatgtgtggataggaaatgtgagtgtgcattgtatattaagttgtgcaaatattaatacaatgaactagcaaaagattagagtaatattttctgagacaggatgaatttgctattctaaactgttatttgagagtgttgaataataactctttttggtgttttattggtaaatgaaaaaccaatattgttataatatggagattgacaactagaacaggagcctctttcttagatgttagctctgtgtgggatgcagtgagggtgaaaccaataattgtttttatgccaaacaaaacctggagcctagggggtctttttttgtttttttttttttggtcttagacacctgagggactgtgcagcttgataggagcctcctggacccatgtggctaagggagaggagcagcagccatacccagcaggctatggagccaatcctgtaggcagcagagagcataatctgtaacaagacagcactgtaccagcttactctgcacactcagccatactcttcaccttcatctttctctaaagaggcagatgcctactttaatttgtggttggaaaattctataaggttgcctacattccctcattttgtgtctgctgcagacttctctaatgacttactactgactttgttcccactaagctttcttgggggtcctcaacatggcaccccatgaagccatttcagatcatttgaagggatgtcgcagctagagctccttctgtggatgtatttgtagcagtagagtggagcaatcccaggtcataaggaaggattttggttttggaggtgttctaatgggagaagcagaaccaatgtgactatctttaacttaacatttatttggtcatctttgggactaaaaactccttgaggagtttcactgtgctccatatgtcctcaggatgaaggatggtacaacagactgagactaggagccatgctctttgcagaaattcatactgagaggttataatatgctagcatctttaccatttatttcctatttgaattttcagtttctcagtttgtttgttattgccatttattcctatagttacagaactgtcttttcccctttgcttgtagaagtcatcagtcgttctagatgatggacttgttcaggatgagttttctgagagtgtgaagatgagcacttacttggttgctttcattgtgggagagatgaagaacctgagtcaggacgtaaatggaaccctggtatgttgatgtggtaattgtctgaaagcctgtgtcacaagaggctcagaggacctcttgctttaacgattcctggtatttgctgtgtgaaataaataagcttttagatcacactctgacattttataccagaaatgctacttttttgcttagctgttatttactgttactagtttaatagctgaaagtcaataattttcaagttttaaaaaattttacttttaaagagaattttagtaagacactatatgtatactaaagcttttagaactgagtggtagccactagccttagggggaatatttagatttaaataaataaaaattaaatacaatttaaaattcacttcctcagtctcactaaccatatttcaagtgttcagcagtgttcatgtgactagtggctacatattcgatagctctaggttgtaaaaattagatgagtcctcccttttttcaaagcaaatcctgatgagattcctcttcctaatgaataagattgtctatttagttaagggtctggtttatctgtattttgccaaaattagactcttctgtttttctttatcatttgtacctgtttgtaaatgattatttgattggactttatactttgatttcatagtagaaacctaataaagttaattttttcaaatactgacaacatagaaggagaaaaggcattctatcatatttattaaactaaaaacaattattcttgatgatagaaatatgatagaatgtcttagtttctgttttcgtatttttgagctctaccagggaatatactgctagttttgggtttcctttctagactaaagagctttatattaatcacaggatacttggatcttatcattttgctacttcaaaagggtatatgtttcctattagaaaagactatcacgtctatcccatacctttcagagataaggacagagataaggattctctggtgatttatcagtaataatactgtatgcctttaatgatgctactcaaaaagtaaactaagtttttaatggtaagtgtagactgtaatattaagcgctaaataatggttcactcacctttggattgaaagactttatgtcaaggatttttcagaatcctttcaaaaggatattataactggcttaaatctgaaataattcaattaattccacttcaggtgttgcactacatatttagcctttgatttagagtttgcagccttgataaagcctaagaagcccaatctaaaagagtcaggtttgctgctgcttcaagactcagctgaatactacgttctccatgaagcatttctttctttccccagctggaattaatcattccctctctgatctttcatagcactttaattatctcttttttgtagttcttaatactcattggtataaaacccccagcactttttatgtatcccaaaatgtatgcagtcttggcattttccccccttcttttcttccttcctcttcactctctctcttcctttttccccctttctctcatctgctgtgtttgcttcacactacctgtaggattacattcagattcatcatttgataatcaaggccttccttataaattcagcaatatttcttttcttgtttaaaatttattttttccacccatctgcacactgatctttcttttttctttttcttttcttttttttttttttttgagacagagtctcgcactgtcgcctggggtggagtacaagtggcacaatttcggttcaccacaacctctgcctcccgggttcaagcaattctcctgcctcagcctcctgagcagctgggattacaggtgccctccaccatgcccggctaattttttgtatttttggtagagatgaggtttcattatttggcctgctggtctctaactcctgaccttgtgatccgcccgcctcagcctcccaaagtgctgggatcttttttaaaaatttttttagtgacagggtctcactctgccacccaggctggagtacatggtgcaatcatagctcaccgtaacattaaagttctgggctcaagtgattctctcccaagtcattgggactacagacaggcacctgccaccatacttggctaggtgttttgttttgtttttttaattttttgtagaggcatcttgctatgttgctcaggccagcttaaactcctgggctcaagcaatcctcctgcctcaacctcccaaagtgctgagattacaggtttaaaccatacttctggcaaattcagctatatttctaattgcctcattatgaattctttcatctaggcaagctgaattattcattgcccacatacacactgcattctcatatatgtgtgtgcatgtgcatgcttgtgtgtatgtgtgtggaaagaggaagagatagagaagttttagatgactatgttttcttttttgctttttattcctgtattaggaaacaacatggttaaacatagactctggagtctaattgggttgaaatccctcctagacagcttactagctatgggcccttaagtagactgctctcatcctttctcagtatatatatatatgtgtgtgtgtaagtgtataatatttgtgtatatatgatatatatattatataatatacaatatattatatattgtatataatatataattatatattatatatttatatatattattatatattaagtaagaaatagagcaaatcttaaatctgttattgctcagtgttaaccttctttgagagctgatcagggatctttctagttgtgtttttagaaatctcctataagatctttgaaagagatctgtcaagaaaagtttcaggttgtaagttttaaggcctgagtgccgattgacttttatttaacaatgtttagagtactcttaccaagtccagaatgctgttcaagactttctttgctgagctatgttgctctctctatttcttactgcatctgttgctcttagaaaagctttataataattgtaatgaccagattatttatctctcgtaagaactcattacagatgttcttttaaggaaaagaaaaagaagtagaaaggaagagaaagtattaaactacattttttcctaatcattgtattccagagatgggaataagtggaccctttggtcaaagttcagtttcatgtgaactttttctcctggcttgtcctctaaggaaaggtgctcagtgatgggagttgccaaatggtgtgtgtggcagaagaatgttttaggagtaatctggaggtatgagtgatgtttctattggggtaccatcttctagattattgaggcaactgtaacacaagatatgtttgtctggaaagaataggtacagctaataaagacttgtcttaaattctattgatcttgttacagttatttataatgatagctgaagatttaaaaattgtatgtcaggtgcacgtgcgtgtgtgtgtgtatattaaaactgacttctgtaggggaaagatgcaggaaatgcagtaagtaggatcagcttgtaggcggtgactgaattcagtaagctgtggtcacagtcctgtatcaagggcttcaggtgttagaaggctgggctaatgaagtacggttggctacataatatgggagaataaatttcttcccttgttactttagaaagctacatatttttaattggttaactccagttctatacatataattcttccagtagtaaccacaaatattctgttcacacatattttgcctcaattccgatgggagtctatttgtaataacaataactaccatttattgaacacttagacattgtgtcacgcactaatctaagttctatacatgtattagcttaatcctcacagcaactctgtgagggtaggagccacttttatccccattttatggataaggaaagtaaggttaactagcctgcttaaggtcatacagatagcagagatttgaaccccagcactgtaaatacagagcctatatatttcattttttgttcatttacttaaacattctatattgtttaatttttatgccacctccatatttctatgattaatgcatatgttctatagactgaagcctcacataaagacaatatggttgaaacctatttgacctcttagaaattgttgacagttttttgctttattttaagaggtttttggggaacaggtggtgttcggttatatggataagttctttagtggtgatttctgagattttggtgcacccatcacccaagcagtgtagactgcacccaatgtgtaatcttttatccctcactcccctcccaccctttcctccatgttcccaaagtccattgtatcattcttatgcctttgcatcctcatagcttagctcccacttatgagtgagaacatacatacgatgtctggttttccattcctgagttactttacttagaataatcgtccccaattccatccaggttgctgcgattgccattatttcattcctttctatggctgagtagtattccatggtatgtatatatatcacaatttatttatccactcattgatcaatcccagtagtgggactgacaaatcaaatgattcctctacttttagttcttgaaggaatctccacactgttttctatagtggttgtactagtttacattcccaccagcagtgtaaagatgttcctttttcaccacatctacgctaacatctattattttctgattttttttggttatggccatttttaccaggagtaaggtggtatcgctttgtggttttgatttgcattttgctgatcattagtgatgttgagcatttttccaaatgtttgttgtctatttatatatcttctttggagaattgtcttttcatgtccttagcctattttttgatgggattgttttattttcttgctgatttgtttgagttccttttagattctagatattagcctttgtcagatgtatagattatgaagattttctcccactttgtgggttgtctgttcactctgctgattgttgaataagatgtcctttccccactttatgtttttgctttgagaaattgttgacagttttaaaatcatttaatgagaaactaaaattggagttaagagttcaccaatgtgctttttccaaattatgaattgttcaaaaagtttccattttccacctgttgagatcttcattttgaggtttttgttttctactgtgtctaatctacatcccacttttccaggtgagtatagagggctttttaaaatcaattagaaaaaaaaaatactgttttgtaaaacccattgctttgaacatggctgtttaacacttgccttttgatacttcctgaataaaatgtttatagtttgtcgcatcatatatgtttaatttattcatttagccaaaaaaagagagagtgagcaagaattgcaatttaataataaggatgattccatctgccttgtctcttagtatgtacccgggagtgaatgggcagtgggagacatgaacctgttgttcccttggttggttttagttctgtgtacaactcataaaacaagtgtttctctgtataatatatttatttttacaacatgacccttaaaaacaagccaacaactgaaaaaaaagttagctgtccgcagcattggaagaaaaactggctgtgccatacttactggaagagaatatgttggtctataattggtttttctaggataatttcaacaaatatgcaatttatgccttatatgttaactttagaactaactccatcataagatgtgactcctcagtgttgagtgcctgctagatgccaggcacggtgaggtcctgaaaggatgaaaatttagttttgtctttcaaataactctcaatctttttacctcataagtaaggaagggcagctacaggtaatgggagagaaagagaagagtatcataaaattaaataggcaaatacttataagttgctataagatgacctaaagtagttattttggatgttgctagcttaaaaaaaagcggggcgggggtggggcggggttggaatcagtaagtctttcaacaatgttgtatgtgtggaagggacttggtaaactctgttgggactaaagtaaccataagcaagtgtttctatccagaaggatctcatacaattctatagaattttcagatatgctagtcttgacagtgctacttgagtatcatgccattttaattgtacctgtccttgcatcatacataatgttttcctttaggtttctatatatgctgtaccagaaaagattggtcaagttcattatgccttggaaacaactgtgaagcttcttgagttttttcaaaactactttgaaattcagtacccacttaagaaattgggtaagaatcaaatagtgtgtctgatttttgttataattagaacctagatttattttgtgaatttttttagaaagaggttctgcccaagttgtttgcagagaaaaccaaaaaccattattaatgctttaaaaattgtttgtatttgttaagattatttagatttcatgaaatctgaagttggagcttaaaacacttaagtttatagggctgctaaaaaggtgctgtataagtgggaatttgcttatggcttagtctgcaatttgactaattctaacttccaagaaataccctatttaaataataaaaactgagtaacgggagctcaggaaagcaagaacatttcagtgctgttcaacatggagctagtcctagagagtagagtattggccgtgaactttgtccttcttgctctgggaagctgattgattgtaaaggaattaggcatctctttcttcactaagggacagtggaacagtgactctaaaagggtttgaacaggtcttcctcagctgacatgtgggtagagagcatacagagctagaataaggaagattccatttattgtgagtataaaaagaattcattgctttcacagtgataaaccattgaataaaatactttgagtagaaaatgcctaagatgagggaaagttgatcacttatttcctgttatgtccagatttggtggctattcctgactttgaagcaggagcaatggaaaattggggtttgctcaccttccgagaggagacacttctgtatgacagtaacacttcttcaatggcggatagaaagctggtgactaaaatcattgctcatgagctggcccaccaggtattagcaaccaaggctgttctgtgtcacacctgtggtctacttcatgtcctggagttattgttagcatttagatgctaataattctttttttttttaagcattgccttcttttataatagaaagatgctttttaaacacaaacttcattttcaaatgaaaatgctatcagatgtttgactttacaggttaaagcattttcacatctgtcttacttcgcaacttctctaaggtgggtattaatcacattttacatatgtgaaaactgagactcagtttaaataaatggcttgccataagtcatacagctaataagtggcagcactgggccatgaagagccactatctcttcaagatctctttttccccctcagtaatacacagctgcatcacctatgacaaatgcccattgcccagtataactttgtggggaagaatctctttccctaagttgcacccttctgacaactcaaactgtagctgtcagggctggatttttttttttttttcatctcctgccggaatggggttctctgttaattttggagagggggtttctgagaaaatggcaaagggtactgtttgtatgacatggagagaaagaaagaaaattatatgggtacatagcacccccattcttccctaacaccttgtctctattttgccctagatgaggtgcttaactagcattgggtatggtttgggtgatgtcatgacagtggcaggatatgaataggatgtattctggtcagcttattttctacatcaaacaccttatatgaatctagcctttgtgaagacttcatgacaagctggcatatgagcacattctcatttgctttaaaaatagggcatgggccagatgcagtggctcacgcctgtaatctcagcactttgagaggcggaggcaggcgtatcacaaggtcaggagatcaagaccatcctggccaacatggtgaaaccccgtctctactaaaaatacaaaaattagctgggcgtggtggtgcatgcctgtaatcctagttacttgggaggccgaggcaaaagaatcacttgaacccaggaggcagatgttgcagtgagccgagtttgcaccagtgcactcccgcctgacaacagagtgaaactccatctcaaaaaaaaataggtcatatagataagatgtcttttgggggatctcctctaggtctgttatttctgaagccacccatcaccatttgggagtatttctctgttatttcctctttaggacttagaaatcatcttcctctgaaacaggttttaaaataacatcttagaaaaatgttattgtaattctcaaaggtgttttgttttatgcagtaacctcgtcctttcgctgctgatttgagataagcccaagaccacactgaccaaattacatattttacaactacttttcatttcaaggatttttttagatacattttttaaggagaatctcctattatttttttcctttttcttttctttttactacctcatagaagaaaatatttaaagctctttctgacttcatttgtttatatatgccatctttttttttttgtttttaaagaaacaagatctcactctgtcacccaggctggaatgcagtggcatgatcatagctcactgcaattttgaactcttaggctcaactgatcctcccgcctcatcctcccgagtagctaggccaacaggcatacatcaccatgcctggcttaatttttttgtagagacagagtctctctatgttgcccatgctggcttgaactcctggccttaagcaatcctcctgccttgccctcctaaagcactgggattacaggtgtaagccacgatgcccagcctgtatatgtcaacttagtcttaaggaatgttgtttgaattctgttttgaatcatgcatatactgtcttcaatttgggcaactgaggagaaacaaagtataggctttctgattacaggaaaatctctcacatagagactttttagttgtcatgggtggttgtagatacaatggaaaataatcttactaacttgatattagaaggtagaaaaatgtcattatcttggaaatctcactttatgaggtggccgaaaaaagtttttatttccctatattcatgctatattgcatgtttgttacattgataaatatgctaataacctttcttgcttgtttcccattcagttaaggtaaaagattaaaaattatattttatttttaaagtaaatttatacaacttttgtaagttctaaattaatttgaatatagtttgttttaactatagtatcagtatatctttaagatattgtaatcaggttatagataattaatatgacacttcagccaattatttaaaaaattcctgaggctgtaaatatcctgtgggttaattgttttctctcccccagtggtttggcaatctggtaacaatgaagtggtggaatgacctatggctaaatgaaggttttgccactttcatggagtatttctctttggaaaaaatattcaaagagctttctagtgtaagtacagggtttctttggcctactatgaatgctaggaggaaaaatagtcaaatcacattttcatgtattttctgtgcatctggagtaatgaaaatgtttctaggaaggtatgccaaacttgactttggttattgatatctataccttttgagatttgacaatgaaagggatgctattatttactgatgtgtttcattcaaaactgaaattatataagattattttatatttttgtcattaagatgaacattttaaattgttttgcaacattttcttttaaacagctatagttcttctgcttgcaggaatttaaagttgcaaagtctaattaaaatttttttatcctgtgtaaaatttaaacttttttatcctgtgtaaaaattagataaaaaattaaaacattttatagcaatactgtttctctattatcactgtgtacattcttgtgatagtgatatatagcttggtacaaataaataatttgccctttttaaggtacaaaccacattttatgcctttttccaaagacaaggaataccgtttcagtacagagaagtataatagtggtgtcactatggtattagactcttgggaaatatttccagtacttagggatattcaaacacactaggccatgatatgacagatattgtcaagataattcaaacaataggtgggaaagtgtaaagataccttccaacccccaaattttttgactttctattaaacttcctgatgttataatccaagatggcttttaaaacagaagtactcttaagagcttttgatttgaaattttagatagggcttgttgaaaaatttcaagtggtaggggaaattaattgatgttaattaatatcaagtggtagctagaatactaagaaagatattctaaatccatgtatactacttaattaagtaatgagatacacagtttgaccacttggtggtgcccagaatgtgtaaaaaggtctaatacatgttctaggggagctcatctgctgagctcttaaagaattatttctgtttaagagttacattttatttaaaaccgacctcaggtaagggaaatgtatattttcttagtagaaattctagactatatataagaaatcagcgtaagaaccagtttttgttctttctctttttaaatttcaagtttcatttaaaaaaatatatgctaacctttttagaatattcatcttggatactcagagttggcatttgtttactttggtaatagattcttaattttcccatatgctgttgtttaggaaatgctaattttaatgtggccaggttataattgtatctttaaatttaaggaatattcatgaagtttacaatcttcctacatttttgaaagcttatatcctgaagtttagtgacactggtcattttttcctaatgatatttcacactaattagtctaattcacataaataatttactatacttttgcatttgatactacttgtgatattctaatcttttcattttttgacagtatgaagatttcttagatgctcgatttaaaaccatgaagaaagattccttaaattcatctcatccaatatcatcatctgttcagtcttcagaacaaattgaagaaatgtttgattctctttcctattttaaggtattgctgtgaacaaaaaggtagctggagtgggtttaaaatttcgtataatttcgtatgtgagcaagctgtgtgatttagattattttaaagattaaatgtttttcaggtattaatggtaaactataaaatgtttgcttctgtataaatcttggtcataacttttttgtgggtttttttctttctctgactctaacttaagttgtatgactagtattccagacaattaaccagatcttatagcgatgcatcttttaaagtcagtttactctccagatctacaggtagaatatgttcagagaaggtcctaagtaagctcttggctgtgttactcagaattgaggtatgctgtcaggtcaggactgccaaaacaagtaagcaaaaagagattttaagaattgaagattcgattttagaatctgaaacacacgccctgggtttcaaggtaaagaaaaagcagaatgttaaaccccattcggatcaccataggtcggagaatagaagaatagtgataacggtgtcattcacatttatgttgtggggagggatgaatgttatggctgtcagacaagatagagaagaaaatacacaaaatgtgtgagatacagtctatgtcatcaagtagctgaaagttcagatggttggtacttgtggagcaataagagaggtaatatgtgctgagtgggacagaatttttgcctaggataatgaagagaaacttttgggaggtaaatgggaattgagttggcttaaataattaaaatataggtaaagaggaatgtgaagtatagggtagggcaggaatggaacaatgaggtctgcaaagaaaatgaagtactaatgggcaagtgatgttttttcagagagtcagtgtttgaccacagtggaagccacacgtgaagagggaaaagaagagaaagttgagtggggcccagttgtagaaggctctggataccataaggaattatttttttcctatgcaacaggaagcttgaaaagacttttgaacagaggaatgacttgattaaagttactatttaggaaaagtattttggtttcagtttataaagtagatttaagtggggagaaacgtaaagtcaggaaattgctgctaaagtccaggcatgaaatggtaaaagtttgaaatgaggagtgctagtaagggtggaaagaaaacaatgggtataaaaaatactgggcagggaaagtacttaaagtattagtgacagggtaaggccagtaaagaaagaggcagaaatgtttttcaggttcaaacctgactgacaagaagaattattgtacaggtactattaacaaacaagaaaatcaggagttcagttagctatattaaatctattccaattagagctactggtgtgatttttgaagaccatagtggacctgtcaataaagaaaatttaaaacttgaggttctgttattataccaaacttagagcagttatttcaggatttgaaaacctgcttaaaatgctctaagtttattatataataacagaacagagtcataacagagttctgtctgccactgacccaaaccctctaaacccagaattcagtgtcttctgaatatgtagtttccatatcattgtcaacccctgtcaacatggtaactacttgtttcagaattgggaatttggcaaaaatattctgtgtaattaagagaagtgggatactagataacttatcagtattgtgtgcaagaaggtaagcaccagcagggaaatacgtttagcagacatattctgtttggtctttataatcatcaagcctaattctgatgcaggttgccttgcaagaattcattcatttagcaaatcttacaaatactaaccatataccagccattgttctaggtgctggggttatatcaggggacaaggtggactttgtctcttttgtgaagtttccatttcaggggtcaaaggtagagactgactgtatacaaatgaatgaataagtaggtattgtgttaagtaataagtgctaatatgaaaataaagcatgataagggaaatgagaatgacaaaggaaatggtgtttataatataatgtggttgagaagccctcctgtatggtgacatttgaacaccatctaaggcatgaggaatgtggttttcttggggaagaatattccaggtagaagaaataaccaatgtatagtgcttgtgtgcagaaaagaattaatataggaggcctgagactgctattctttgaaagacctgcttgcaaggttggcccttgggtggcatgtgggaacttgggttttgggaaatttcccactattgcatgataagagtggctcactgtgcctaaacaatgtagtttatgctgaaaatgtgatttccttctgggtgtctggagttttggtatgtgctaggcagaaggtaccttcgtgactagcccacagtaaacagcctgggtgctgaatctctgatgatcatccgtggtagatggcatttcacacatgctgtcacaactttctggaggaattaagtgcatcctgcatgattcactgggagaggacttggaagtttgtgcctggtttcctctggactttgtcccatgcatcttttttcttagctgattttacttcatatcttttcaccgtaataaatcatagcagtgagtatgactatatgctgagttctgtgaatccttctagtgcatcatcaaacctggaactggtcttggggacccccacatgagatatgagattgagagagatacgagattgagataaaaggttgctttgcatgttcaagcaccagcaaggatccagtgttatctgaagtagagtaagcagaggagaaagtagtagatgaagttagagggactgtaagaggccagattattatagggtctgctaagccatagtaaggaccttgattttattctaagtgaaacgaaaagcaatttgatcagggaagtaccgtgatatggcttattttgtaaaagatcactctagtcttcaacagtacatggagtaaagaggactagttaggaagttattgtaatagatgggtggcgagataatggtagcctggacaagggtggaagttgtgaaggtgatggaggtacaactggacttggagtgtgttttaaagattgatccagtagaatttgttcatggattagatatgaaatacgagagaggggtcagggtaactttaagatttttacctgaacaactggaaaaatggagttgccatttgctgaaatggagaagactgctttagaagtaggtttagggaaagaagggggaagaaacttccatttctaagtgactatgagatatggattagatatccaaatggagataccacacaggcagttggatatgggtctgaaattcaagggggaagaagtctgattagatatataaatcaggggatcatttggaaaccttggagttgggagatcaactaggaaggaaatttagatagagaaaaggggtccaaagatcagatgcaaggacacactttcttcattggaagatgaggaggattcagtagacgagaccgagaaggatggccagtgaatagggagagaatcaagagtagtgtcttgcagctctcaaggaggagcaggtgatcagttatatcaaatgctatcaataggttgataagatgagcctgagaattcacatttgtatggcaccaggaagtttaccagtgaccttgataaaaatacttccggccgggcatggtagctcacgcctgtaatcccagcactttgggaggccaaggtgggtggatcacctgaggtcagcagttcaagaacactctgtccaacatggtgaaaccccgtctctactaaaaatacaaaaattagctgggcgtggtggtggtgcctgtaatcccagctactcaggaggctgaagcaggagaatcgcttgaacccaggaggcggaggttgtagtgagcggaggtcgcaccactgcactccagcctgggtgacaagagtgagacttcatctcaaaataaataaataaataaataaatacttacagtagagtgatgattagaagatggctcaagagaaaatggaaagagagcaaatggagatggcaaattgaggacaactcttttgaggagttttactacaatgggggaacaaaaaaacagcacggtaacgagttggtaacgaggagggtgaagttagggaaaggtagagagtcttttatttgtttaaaattaggaatgttacatcgtttttgttttgttaatgggcatgttacagtatgaagggaaaagttggtgatgcagaagagaaaggactgttggggacaacagtgagtacttaaatttatagaacaagtaatagctatgaagtgtgatacagaaatgagagtaataggtaataatttagttatgtgtacaataatcttgacattactacatttttatcaaaagtgaaattcattcaaaaactactagagtgcctactatgtagtgggcattgtttttgtcattggagttgagttttcactttttcctctcagcttactgcatagatgaggaaataaatgtgtaacagatacaggatgccatataaattgtattgaagatggagaaatgtgatttctatttcaaaccgggaaggtcttcacagaggaggtggtgcttatttcaggattgggaatgatgacaagcacatcaatggatatagtgtggccttaatattatgctccctgccctatacatttgttagttccaagcatttgaagtgactctgcaggaagaagagagattctggttacttcacaacacaatatactaaaataagaaattaatgacctacctagcagggagacttttgagagccttgtcaatttattgtgtctccagcacacaataaattcaatgggtgatttaagcactggggatggaggtgtaggtgccacagaaaatttggcatgtttttctattaaaatgtttttataaatacttagcttttcaacactaacattgaaacagtgagtataccaatagaccacacagaatgactcatggttagaatagtgcacatgggaatctactcattaattctttttcaaatcctttaaaataattttaagacagttgaacacagtccacatctatatgagactaagtagcagtatattataactaagttctacatatgaaagtaaatttttagaatgactgtagtttgaattttagattcccaattcgataatctatagtattctattattttctttctttttcctcacttttttttttaatagggatcttctctcttgttgatgttgaaaacttaccttagtgaagatgtgtttcaacatgctgttgtcctttacctgcataatcacagctatgcatctattcaaagtgatgatctgtgggatagttttaatgaggtaagtgacctgggtaatttatttagctcttactgtaaaaagagaggagttcgtctatttatactttttagcatgtgtgtaagttaatctgtggtacaaagcatagttatttaagaaagggggggatggagcttgctatataaatatttatgaatggagcactaaattttatgtcaagaaatgggagtgctgttcttagttgttggaaaagacgtgtgtgggcttgggtagccagttttttttttttttcctgtaccttaacttctattcctattttgtaggaaagttgtcttctccgtattaatgaatattactatattttcattatttgactttttttccagaaatctcttttcctatccttacccttttagtttttctgcctcttttgaatgattctgtactctgctctatgaatctcttgcctttgtgactgttcctccagagtagatgatacatcacaagctgactgcatattatccttggatgattttgctgttggaattttgtcattcctggaaatattctagcaagcagtgtaattatgtagaagttacacttcaaagcagcacatgaacccgggctgcttcatgcatgtatactgactgcaaaacccttataagcatttgtgtttgttaccctgatttagattgatgggtcataatactttgaaagatcacagatttgactgagcgtggtggctcacgcctgtaatcccagcactttgggaggccaaggcaggcagatcatgagatcaggagttcgagaccagcctggccaatatggtgaaaccccgtctccactaaaaatacaaaaattagccaacgtggtggcacatgcctgtagtctcagctacttgggagactgaggcaggagaatcatttgaatctggtaagcagaggttgcagtgagccgagactgtaccactgcactccagcctgggtgacagagccagactctgtctcaaaaaaaaaaaaaaagaaagaaagatcacagacttatttggaaatttgatgaaagttctggccatattactcagaaaaaccacatatgtgcagaacatcacacacagtttcaaagttttattgactctaggttaggaacccctgctctggatctttctcatacactctttactgcttctttgcctcatctgaatcctgatactttctagctgttagtcttttgcccagaagatataccttccctactctctgaattctctttgagaacttattacctaacagttgttcccaaatcattgtttttttcctctgatcatatagtagtatttcaattgaaagccacattgtttactttatacttactgtcttaatctgttggcatttagaacatatttctgccgttctcattgactgcaacttttgcatcatggtgtttttccatcccaaactagttcctaacattatcctcaggtttttcagcacccacatcaaattatgcattggcctcttcacttcaatactgcttcgacacccaaaagcaccttggttttaggcaagcttattttcttctaatcctctggttcagaaataaataggtcagagccatgataaatacaagtttaattaaaatgggaagatttgctccatccttttgtgctttaaataaatgggcatatggtgattgaggtgaggcctgccatagtagagtgattttatcaatttaggtacatcatgactttgttgcttacaattcaaattcatatataatctagaaaaataatttgaatcctgagtttaacccacctgctttaaagagactgttgttcaaaaattgcttcttagttattgatactagatgtcttaggggctttgggccttagagggtctgcaaagctctgacactaggttctagattttatagataacttcatatattttctgggaaagaagggctgtgaccactaaagtagtttaccactgttttctagaaagacttaaggcaactgacctgttcatatgtcactcttctgctgccgctgctccctggcactcccacagtattaggtcctaagagactatcattgtggaggtggagggtaggagcataaagagaaacccagactcaggtgcttcacaggattgagtagcagtgtttctgattctagactgtatatcattattcatatcttgtagatgttagtattgtgatttgaaagaatacttataccttcttagggattttaacttgatgaatttagggattttaatgaattcttagttggttgatatatgtgccacttctcaacctagtgcctccctcactcccttagctatcacttagctctgttccaggttacattccttttagcagttgctcatttacctagattagaagtgtaaactcaacattcatgtttcttttttatattaacattaaatgtagtctttatagatggtaggaaaagagggaagggtacagataaattaaaatgtaaaattttttaaaccaatttttatttttaaggaaaaagttttatatatatatatatatatattttgtaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaaggtacatgccctctttcttttcatgccatctcttttgcactctcaggtggaaatatttttaagtgttttataatcataagttcttgtgaaacctaacaagattatcccttcctaggaatagcttaaccttcctaccaaattaaaaaaaaaaaaaatcatatgtaactaattttccaatgttttctctttacagctacctgtggcatattccactatcctatgtcactgaaggaagaaattattcaaaatatcaatcggtatcattactggataagaaatcaggtttgactataatgacagttctgattggaaatggcataattttaaaaatctgatcagagtgcatatataagattacactttccagtgtgcacactctctgaactggttttatgagttgcatatgcaagatgtgactaatgtgagattgattctgtatatcatgcacaaaactggcttttagccatgtgaaataaggtacaaaaatttgcagagaatgtactggcattcctgaaagaaaatagcgaatgccatgtttttatacccaagattaatattttgttacaaaataagaggagtttcttaaagtatcctctgctatctactgtctagggttgggctgaggcaactgcattttaacaagatacaccctaaatgatttgtgtgtataattgaggtttattcatgattggatttagagtaaatagttattgcaatatgccctgcagacatagtatatgttttggggaacaagaaaatggggcatgaaactatgataggaagggggaggggaatagtaaaatataaacgtggtgtatgctgacctacaatataaaaagcaattgaaatgtaattttgggccatttgttaaataccactatgaatgtcacaccacatatcttccttttaatttacatcctaaagaaacacaaggctcttgggttctgtaggacccgttagtgatgctttggattgaagaaaagggaaaatttctcgtttgaatttggatctggtgtcaaagcctatatttttgaggggtgagtgtagcttagtggtaagagaatgagactttagagactgccgggttcaattcttagcagtaccattgatcacttatatgattttaggcgagttatgtgagcctcattccctcagctgtacaaaagagatagtaattatacttactttatgtagttgtggtgaggattaaatgagttcatttatatgaagcacctagaacaatgcctggcacatattatgtgctgtattaatgttaactatcattaacgttattgaaaaagtaaatctttaatatatctatattacataaaaccttgaaaatggagagcaaatcttattaccctatcaaaactattcttatgattatttgtttatagtcatttttaataaatatttgtacttagtcaaaatcattatgtatatatgatttctgtatcttgccttttttaacttaacatatatagtaattgacttaacctacttgattcaccatttgttgttataaaatattgccttaattaaatatttcaaatcttaaaggtttttccattatatgaaattttttaaggaatgcttttcaaaaatgaagactgcggtaccttttgtgatttggtacatataaccaaatcgccctttttattgtgtagttacagttgataatgccacctgaaatacatgaatgtgccagtttcattgcagttttaccatagtggagtgttaaagcagcaacaatctaattatttaaaatcctagtggtagttggtaatgtcatcatatctttgatagcatagctggaagtacaaggaattgctactgtctttgagtaaacaaaactctaactttgaatgagccgtaaaaggatagtctctaacccaagagagaacaaataaccccatctccctatatcctgaagcacagctaaaacatggctggagtatttgcaagaaactaataaggaaattttgcaaactttctgatagtatattaattttcagtgctattagaaataattgggcaataagaaatctgcttttattatctgttttttgtttcattggttgatttttttgtttgttttttcttgttttttttttttttttttttttgagttggagtcttgctctgttgcccaggctggagtgcagtgacaatatcatagcccactgcagcctcaaacccctgggttcaagcaatcctcctgcctcagcctgccaagaagttaggaccacaggcatgtatcaccatgcttggcttaatttttgtattttttgtagagacagggcctcactatgttgcccaggctggtctcaaacccctggcctcaagtgatcctcctgctttggcttcccaaagtgttgggattacaggcatgagccaccgcacctggctcctctttactctttttttttttttttttttttttgagacagagtctcgctctgttgcccaggtgagagtgcagtggcgcgatctcagctcactgcaagctccgcctcccgggttcacgtcattctcctgcctcagcctcctgagtagctgggactacaggcgcctgccaccatgcccggctaattttttatatttttagtagagacggggtttcaccatggtctcgatctcctgacctcgtgatccgcccacctcggcctcccaaagtgctgggattacaagcgtgagccactgtgcccaccctcctctttactctttacctgagtttattctgagcttgttgagctctttttgagagtttaaccccatagactagctcatattttactgctttagccttctaggcccttacctggcattctgtgcttttgccgcacaaaaattctatcagcaactcaaacatgccatactgcctctttaggtctttgcatatgctattttctctccttaaggaacacccttgcctcctcactccctcggcctactcctgtttattcttcagatcttagctcagccattgcttgctccaggaaacctttccttccctgaagacagtttagatgccctacttaggttttttaataacattctctacttctccactcataatatactgtaagtactgttcactcatatctatcctcatattaggtatttccccccattgacggtagtgatcatggctatatgaatcactgtaaatcacttttagcacttagtaggcacacaaaaacttaatgaattagtaaattttagtccataatgaagtgactccagtctcactataaaaatttctaggaaaagaacatgcaaagcctgataaaatgatgttttctttttctcttcctcttcttagtaaagaggaatatacaaaattcactagaatataattgatttaatctagagctggaactgggccaatacatgatgaaagtagtgtctgttacttcctcttctcaactgtgttatttcccttgctgctgctgctattttaattcctgccatttcgggtttagagagtccacatgaaaacttctgtccttacgtttgaccctgaggacagctgagccttcttggttcctaatgctccagtgagaattactcttaatttaactgcatttttattttttctattctcaaaagaaaggtagcagagagggtgacttcaggcttcttttatgctgtaatactttagtatagtgtattattttgatgcttgatggttggttaaatctttaatatattttctttctttttttaaatatattttcatgtgttctaattcaagggttgttgggttagttcattagttcagttgtatataggagttatgtttggtcaatgtatttgtctccttttctcacatacatgagttttgaacaattagtatttattgtgcacaagaaatgctgatggggccatttttccagtttacatattgaggaattatattttttaaagtttccctcttccctttcttcctccctctctctctctctttcttatccacattttactcagacctaagatctttaactataggagattttcgtattaaatctaatgcaaaacattcatgtttccaaatggatatcactatcagaaatactgctgtgaaagttaaagatatgtcattggaagaaaaggtaattaggatgaaagaaggaagggcatatagtaattaaaatatttatcatgtgccattctctgctcttgcctttttttcccctaataaaggagaaagaaaggggtattagagaagggaatgcttttgaacaggagtgataaagttcaatagcatgtatgatgctagccctctggagcaaactgtacaggaaattttgtaactttgtagtaaaaacgtgttttttagtttcagaactttagtttttttgtaaaacagtagttgattttcgtagctcattgacaaatggtttttaaaaatcactgttagattacttcatctgggcttctgccatttaatattgcagttgctcactcttttttgctactcaatagactgaaaattgaagtgttaatctgttgatgactatagtaaattaaaaacatatgagggtagcttcatccacgtttgagctgtaggatgtagttacttcccttgtgtgcaaagctattatttttcaatacctgtggttttaaggtccaccattctggatcattcagaagaactgaaagagactaatgatgttgattctttaaatgataactctgtctgtctttgtgctgttggctgtactgctttatgttgtgtcatctcgatgacagtaataatttcaagtatattcccagctgtgtccctcctctttaccatctggacttggctaggtttacaacatggcaagctgcttatcaaccaaggtattccgtatgtatttcaatgttttctgcatccatctagtggaacaattgtcatagccatcatttcttgtctccttttatgggcaagggagacttgggtctctgtagcccttctttctggggttgtttcttttctttacgtttgtttttattagagacagggtcctgctctgtcacccaggctaaggtacagtggcatgatcatagctcactgcagccttgacctagtgatagttgacctcaagtgatactcctacctcagcctcctgagtagctgggactacagacatgtgtcaccatgcgggctaatttttattttttgtaaagatgatgtctcactatgttgtccaggctgctctcaaactcctgggctcaagtgatcctcctgccttggtctctcagagtgctgggattacaggtgtgagctgccatgcccagccctagggttctttcttgataaaagctccataggatatagtgtttggtgacctggagagtgttgatatttttggattagctaatgataaagttaatttccttagtcataggtttgctaaaaatggcttcaacttggagcagccactgctgccatcacaagtatcccttaaaactgcattctgcccttgaaaaaggaataaaccttatttaactgatctttcccatctgttgctgtatcagcaatataacagaaataagtacggaatttttttagtaagaaagactgcttagcttattatgtcctgttaagacatgatcagaatgtctttttcatcttaaacatcttttgcagtatcgatataattggaataacaaagatattaagggcatctgacacatttgaataattcatgtttttgaaattgataaatcctaaggtttcaggtactaatatataatctttagtacctaagctaaggcttcaggtactaatatataatctttaggttgaaaacatatttataaagcattttatataaaaaaccttcactacagaattataatgatagtgaacattttaaaacagcctaaattgttcaaaatagattggataaacttgaaatgaaatattatgaagatatttgaacactgcttatgaagacaatggaaaaatgtgcggggggatctgataggtgaaaaaggataaaataaatgcatatagatctgctgtataaaatattaaaaacaagtataagacaaaaacttggcaagaagtacattccaaaatgctatcatcgtctgagtttagattattcttatctctactcttctttttcttacaattaaaaatttttttaagtatttgttactttaaaagggggtaaaaattatataataaatatctacaaacctttgtctacacttgatttaaaactatttattgtgacatagtcattatttattcattcactgactaattcagcagtatttgttgagtacctgctaggtcattgttataggggctgaggcgttagcagtaagcaaaatagtaagcttatgtagcttatattctattaaataatagtaaacctcaagatgcttagaagcataccccattataattaagtctacatccttgttgccaactttaaaagacatttcttcattagcagttttaaggattttaaaaattcatacatatattttgtggtcagttaactctcagcgcttcattattggtacattagttgacataattccatggaaatttctaacagttctctcagcatttatagtagagaccccagaagtgcctatcctttcctattgttttaacccaattatttcttatttgtcccttatgcaatcttaagccttccctaatgtttattttgctagctttaaataatgtgacttttctaaatggctttgtttgttcttcctttgctaacatgacaaaagacagaggccaaaatgggacacattttacacagttctctcactgtcttcccctgctgcctcatcctacacctttactttctccctccctctttcctctagccataatgaacttgggagccagttcagtgcatggataacatgtatactttctctctgggccttgagcacttgggttccctactatatcttcttcacttggccaacacctacatattttgaggtctcttagaagaatgacaacttagatgtcatttcttccaagaaatcgctcctaactttccctaggagagggaagcattttttctatgtgcattcgttgaatgctgtcttttctttttctgtcaatagcgcttgtatgatattgtacttgcctgtttactttagactgtgagatctctaaaagcagagacatatctaccttgttcaccatttgatttccagcacctagcttacagccaatattgcacagtaaataaataattgttaaatgaatgtcttgaccttcactaacgtgaaaataactgtacttggagacaggcatttttttcttactagaatgattaaatataaaaataaactaaaaaacaaagcactcataatttttttttcttgtccaattgtcttctctctcaatctctcatttttttggtttccattaggtgtcatcaatcttacagaagaagtgctgtgggtcaaagtgaatataaacatgaatggttattatattgtacactatgcagatgatgattgggaagcactaatccatcagttgaaaataaatccttatgttctgagtgacaaagaccgagccaaccttatcaacaacatctttgaacttgcagggtagagtatacttagtttgagattttttctttttttaaacaaatgtcattgaggtaaagaacatatatgaaaaacagtttgaaagaactagcatgtattggttggtacaatacattttggaggattgggaaaatatgtgttctttgcctccagggactttataaaacattagctacgaacatactgaacagttaaatgaaacaggatttaataataattcaagactagatatcaaaaacaggatacatattttgttgactaaacttgatacacgagttcaagctctattttattttataagagaattattttcaaacagcagttggtttaagcatgaagcttagtgcttatgcattggttttgagggacatctctgatggctggagccaccttatctgtactgcttgcctccccaaccacctcatgcattatagaatcccaaagccaaggatgacagtgacctcatgtaaacatattctctgaatagaatattaccaatttagattgatgataggcttaaaaacactgacgtgttccttctcatctccctgggcatttccattttgtctcgttttttatgaagtgcccttcttacgtcatcctagccattgctgctgtgattcctataaaatggttaattttaaaaatgtactcactgtaaattcacaatagaccttgtcataacaagtttgaaaaacaaattcccattaaaccaacaaataaaattaaaaaaaaaaatcagatactctctatgctatactctctttcctggcaaatataactaattaataaataaaattagtactattcatcttttctaacccaagatattatacttttgctgagttagtagcaatttacaggagacttaggaataaaaaaaaatgagctattgtttatctttctcttgaaatgcctctttaatcttgggcctcatgaaattaatcagagataatcatatttagcttaactttacaaaatgccactgtaagtttaaatttttggtctccaagactcaccatctaaccctaagtttctcttttagcatgcatagacttcttctgtgtgtctctgcatatttacttttcctgttcttttatcctttagcctaggcaaggtacctctcaagagggcctttgatttgattaattatcttggaaatgagaaccatactgcacccatcaccgaagccctgtttcagacagacctcatctataacctccttgaaaaactgggatacatggatctggcctcaagactggtggtaagtctgcctttttgccagcttcttgctgtttatctttaatattgttattcatggttccattttcagccagtaataggctgaaaaagcaaccagttaaattccattttcttcactttcctgcttgtgaaatctttacttaaaatcaagatgttgcttatgatgaagagctgataaaggcttagtatgatatggtcttgtttgaatatcaaaatacagacatttgacaccactgtcaaaatgaggtcacatgagaataatatttctctattcagatcctgttttatttctacatgatgaatgtttgaaataggcccttttgcaaagtagatctccccattaattttctagtggtcattataaaatgacagttacgtttgtattgagaatattctgtttaagggttcttactgataactatctaaaggataatgatgctggtggatatgtttctttgcaaagcactaaaggagtcttagtattagagaccattttacctttcttaatatcaactgcctgatcttaacagttgttattttggatacttttaatattaaactgttgagagactttaaaagcttggaagagagtgaaaaattatttgtttttatctaattctctgaatcagcgcattttgacaacagagtttgctttataaactagtgagatttcccagggacccaggcaaaaggcagcttttagggaaaggaaggcagtattagaccaagaattagaataagtcttttggggttttggtattctcattggtgaaaggaaggggttggattaaatcatttttttaacattttttttattatactttaagttctagggtacatgtgcacaatgtgcaggtttgttacatatgtacacaaccttctttctgcctctgttactgccttaccctgcgtctcctatgaacagttctctcatcacctgcatgattctcagtgaatggagggaacgcagggcagagtggatgtatggagcttgaaaagcttttctcccccaaaagtttctgatctgaccccaaaggagttaccccatccctatccataagcaagatgcttaagttagatgattttctgaggtctcttctaatggttaagatttttatcattttctatttcataaggctttcagctagcagccttaataaaaaccagtgcctggaacatgacctggcctgtagtgacactcagtaaacgttgagtgaataaatgattgaaacacaccagaaacaagtgcatttgagtgcttttacacactgtgcttagtgcttaatgtagattacctcatttaattatcacacagtgccaaggtagatatttctacccccattaaataaacgaggagacggaatagcttctttaaagtcacttacctagtaagtgataaagctgaaattcaaacccagataaatttcactccaaagacttctgtttctgttatattgctatttgtaaaatcaatttgtgtcctagcaacgtcgtctttccaggatacctttagaaaaattaaagctttcttcttgtcatattcttttgaaaagcttgcagaccatatatttaaggtttcaagtgactggcccacatctagttgttctcctaaaaatgaaattgtcaacttaagagattttttttatatctaaaatgctaataatgactttttaaaacaatatttatgtgcctttccaagaagtatgcaaatagcttactcatctctttagggcaaactgggaatccaatatcgactttctagtgttagtgtagtaaagagattggccattagttaaccagttcagctattgttgatagacatttgcgttatttgtagtttggagctatcatgaatagcactgctatgatgtcttcgatgaatgtctttatgcatttctatgggatatatgtctggaaatgggattattgagtcataacacatgcatagttaatagtgtactatcaaatagttcttcaaagttgtaccaatttacacttagcagtatatgagaattctaggtgctctagatcttttctgatgattatcattcacactaaatcttttttattttagccatgtggataggtgcatagtggtactgcaattttgacttgaatttacatttttctactgatgtgaagatgattttctttttgatatatgtattgaccattagatgttcttttgtaaaatgcccatcttttgcttatttttctattaaatcgtctgcctttttcttgttgatttgtaagagttctgtatatatcctagatatgaatcttttgttggtcatgtatatttgcaaatatcttctcccactccatcttgcttttttttactctcttaatgattttttattaatatgagttttaaattttaatgtaatctagcttatgaaatcttttcctacccctagatattctgtgttctcttctgaaaactttatcattttatcctttacatttagatctgtgatccatctggaattgatttttgtggatggtgtgaggtagacaccaagattcattcttttcagtatggatatccagttatccccaggaccagtatattttattgcatagaattatgtttgaggtaattagtatgatatcaacaccatttggggtagtatattaattttctagggctattaaaacaagttattgcaaacttgatgtcttaaaataacagaaatttattctctcatagttctggaagccagaaggccaaaatcaaggtattggcagagtaaggtttgctccttctgaggaagaatctgttccattcccctctcctaacttcaagtgattgccagtaatccttggtattcctgggcatgtaggtgactaaccgtggcctttgtctctgtcaacacagtgttctctctgtgtttctgtgcccaaattgccccattcttagattaaggcccaccataatccagtatgacctcatcttaacttgattgtacctgcaaagaccctattcctaaatgaggtcatattcataggtcccaggcagacacaaaatttgaggggatactattcaacctagtacaggtagcaataaataagattagtgcatatcactcactttttttcactattaaagggcaatgttagttctgaatataccctgtgaggaggcagaatatctcccgactctgaagctgcccagttaaacttcataatggcagaagtcagtcttctgcttgcctctctgttaactctgtttatagcttagtgctcaagaagcacttgatacttacctcttctttgaactgcatcttcatcccagatgatttccagctttctgggcagatatgtgtttattaggaacatacttcaaggagggatctagggactgatggatagagaggaagggcagaagacttagtatgtgtttccaagattggacgcccttttactgctgtgtgtcttcacatggttagctaaaagcccagttaactttagctcaccaagagggagaatgtgtcactttaacattcttattctaatattagggtgaaaattctggtagcatcaatactctcaaactaggaaatctgacattctacagttaggaattgggataggagacatttatgaatccttggatatgacgttcaaatgtattactgtctaagactgatttctaattaacttctatatcattggaaccaaagcattatgtacatttattggtcattttgttatgtaggctgcacatgacatatgctgcattttgtgatgctgtagtgttgtgatgggtagggtctggaggcacatttcaattgtgttaaattgttcacatctgatgttaacatctgatcctagccatattcctgttttatcacttacaaatctgtcattcttttacatatgaggcattggtgggataaaccttttgcaataaaaactgacatttcacttttaagaaactcagttgacccaggaaagaactccctgggcatatcagtgtaaaattaaagcagtaaatcaaaatgtaatatacaacataagtgctagcatctttccctgttttatttttaaaataattttatattgttgttattgcattttattacaaatccagtgtttgtagcttgtataacccatcaatttatttcctctctccacttgccatttcactttgtaaaatcatagagttgcattctattgttgaaagagcttaaatttcaaaaaaattaatttggatccttagaaaaacatttcattttatttctaaaagggaaaggtaatttgaagcacatgctatgcctcattaatattaattaatattaaaaataaacctggattacttataaaaatgatattttgtaacaggatttttctaataatataattattctttcttaaaatgttttactttattatgttataatttgaaatacatttaaacaactattttgagaacttgccttaatgatttcatatggagactaactagtaaaattgctccctgtaattcggtggtgtaactgctcaggaattagccacagccatcttcaagtgtcagatttcctttgcttccaggacttcaagtgccattctttccattgctgcctttgtgttttagtaaactctcaatgagtattgccattgttcttcactgattttttttttaaataggatttcaagcatgtgattttttttctcacattcttcatttgttcctatttgacagttatgagtaggatttgaatttcttttgttctccagtcatttggaatggttttctatcataatgctattgagaaggtaaggccagtgaagacaccacatagcaatgcagttaggtatgtcaagtgggatcccctgcattgcttgtccgttccttgcatcgtcagcgtagcaagtatttttctacttcatgtcctcccagtgactcaaaagctttaccacttacacattccacaaggtgtctgttctgtgtttcattgcttttgaaacaaacacaagcgagttgacatgttatacaaaccttgagttcttttccttgcagattctttttttctattctcatattcaactccacaagatgcttattcacagtaagtcattgctaggataatggtcttaatagtttaaaaatttccaaataggattcattttaggtattgacagtggtactcagtggtactcactgtcaatacctaaaagaaaggaagaaagcaatgttctgtgaagaacttgagctaaacttctgaagttaagggttttgcttgtggtcatctgtggtacatgattacttgagatgagatgccacgatggtggtggaggtaaagaagtaccagcaggaagaaatcttcctgtgcttattccttcagagggggtatctgttgaatttttttcattttggtccttcttatgtagccatgaaggttttctaaagaatacctaaaaacggccaggtatggtggctcacgcccgtaatcccagcactttgggaggccgaggcaggtggatcacgaggtcaggagatagagccatcctgactaacatggtgaaaccctgtctctactaaaaatacaaaaaaattagccggatgtggtggcgggcgcttgtagtcccagctactcgggaggctgaagcaggagaatgacgtgaacctgggaggcagagcttgcagtgagctgagatcgcaccactgcattccagcctgggcaactgagcaagactccatctcaaaaacaaaaaaaagaatacctaaaaacattttttatatcagaatttttattctttctagtggtattcataaaagcatattgcatatgatgctttttaaaatatcatgtgccctcaccccccacccgccatgcacaacttgcagaatggaaatacttcaacatggtattaacaggtttggtgtttttattttggagagagatgaaaaaggcgtctgttagtaccttaataccgcaagtatacgtttagcaatgacagccaataccaatggactagattggatgatattaatgaataactattagttttcttcagtgtgataaggtattatggttctgtaagagaatgttctgatatctgtgagttgcatgccaaagtatttataaatgaaatatcgtatctgtatatcacttttatattgttcagctaaaacaagaaaaacaaatgtgtgcgtatgtgtgttatacacacttgaaagtgaagcaagtgtcagagtgttaaaaaactgttgaatctagatgaacagtgtatgggtgttgtactatctttttttgtaggtttgaaagttctttaaataaaaacttaggagaaaaaataagctataaacaactattcttccctgcaggtctcattttcttgctaatttggttaatttgttataacatcaaactagttgataatgttaaatatacctttaatattggattgagaaacatttaaacattaactatcaataaagaagtttatttttctttcattgctttataggtttatagattgtaaagtcacaaggtcaggaagtcctgacatccttccagcagtggttataagtgatactttttggcaggaaaataacttctagctgagtatatgcagcataaaggttccctactgcacagaagtcattaatttttttctgagttaacatcactaaaagtcccccttagctatagcagccttatgcatagccttattattgaatggtttcatcccagccgtatgtgggtttcatatgtcagttgatatttaatgagtaatatctatgcctttttttttcctcattggataaatgttggggaaaagagatctaattgtcctggggttttttttgttttttgtcttttgttttttttttttttttttttttttttgaggcagagtcttgctctgttgcccagactggcatgcaatgatgctatctcagctcactgcaacctccacctcctgggttcaagtgtttctcctgcctcagcctcctgagtagctgggattacaggcacgaccatcatgcctgcctaatttttgtattttctacagatgtcgtttcaccgtgttggccaggatggtctcaaactcctgacctcaggtgatctgcccgccccagcttcccaacgtgctgggattacaggcacgagacactgcacctggctgtaattgtcctgttttttttctgattgtcctaattattatgaagccattataatctattttgtctctctagactagggtatttaaattacttcaaaaccaaattcaacaacaaacttggactgatgagggcactccatctatgcgagagcttcggtcagccctgctagagtttgcttgcacccacaacctggggaactgctctactactgccatgaaactgtttgatgactggatggcatccaatggaactcaaaggtgaagtatacctctactcagatgaattatcttctttttctttatttcacatcatatacagtatccagggtattctcatcctggatcataaatgttataaaactgagtgtcagtgtaggtgaactctatgtatctgcattctcaaacaagactttttttttttttattatactttaagttttagggtacatgtgcacaatgtgcaggttagttacatacgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtcaaacaagactttttaaaaaattgtggtaaaatacacataacataaaatttactgtcttaaccattttttactgtacagttcagtagtgttaagtatattcacattattgtgtactatattttcagaacttttacatcttgcaaaactgaaactctgtacccattgaataattcctcactccctctccccaccagcccctggtaaccactattctacttcctgtttttgtgaggttgactacactgtatatctcatataagtaaagtcatatagaatttgcttttttgtgactggctcatttcatttaccataacgtcttcaaggttcttccatgttgtagcatgcattaaaatttctttctttctttcttttcttttttttggagatggagtcttgctctgtcacccaggctggagtgcagtggcgcgatctcagctcattgcaacctccacttctcgggttccattgattctcctgccccagtatccggagtagctgggattacaggcatccgccaccacacctggctaatttttgtatatttagtagagacggggtttcaccatgttagccaggctggtcttgaactcctgacctcagaaaatctgcccacctaggcctcccaaagtgctgggattataggcatgagccaccatacctggctaaaatttctttctttttaaaggctgaataattttccattgtatgtatataccacattttgtttatccattcattcctggatagacctttgtgctgcttgtaccttttagctattgtgaataataatgccatgaacattggtgtgcaaatatctcctagagaccctgctttcaattcttttggaaatacacctggaagtagtattgctggatcatatggtaattctaattttaattttttgaggaactgccatattgttttctacagcagctgcaccatcattccaatttctctacatccttgccaacacttgccattttctgggtttttgatagcagccatcctaatgggtgtgaggtgataaacaagtctcttaatttagaaataaaacatagcaggtagagttagcagttaacagaaaagcttttgggggtaattagttctctccagctccttaccgtgcattatggagagaagattcaagcatcagatgaagagttggggtggaggatttggataacgttttgaggtctttcccagctctgagatcttaataaaggcagtagactgtgttttctccctgcaccccatttactgctatagttctaccatgaaacttatcacactgaattgtaatgcatatagttattgctctatacttcgtagtagcctgtgagttctcagaggacagaggctctcattccttttccgctccctagtgtccagccagtcgcctgcctggttctttgtgagtactctgtgaatattaaattgaactgatgtatccatagacacactactaggaagatagcagtcactgaattaaactttttctcaaccctaaattgtgtactcaaacttgttattattaccaaccctcacaccagaaactccaccacagccaactcttcgcctttgtattcagaatattttcttgttattctcatgtttgaccacctctcttacagcctacctactgatgtcatgacaactgtgttcaaagttggagcaaaaactgacaaaggctggtcattccttttgggcaaatacatttctataggctctgaagcagagaagaacaaaatactagaagcacttgccagctcagaggatgtgcggaagctttactggtatgaaatcaccgaggaatatgatatacagaaaccaaaagaatacaaacactgtgctcttggtcaggagctcatttttgaggggatctcttttccccacttctgttacaggccaggcctaagttggacagtgtggtgaggagactacaggtgctgggctttatctttatggacaagcagaaaatcctttgcccaaaagggattacaagatgtcaggagtcacagccccctcctactccttgctcaaaaagtcttcctccccttggaatgttgtcttatacaccacaattggtactccatagtttaggaccaaggcattgctttgtgcaagctgtcattttaaaaatgtaggcatttcagaaaaaaaaaatcacatattaaaccttctaggttctacgttcatatgaatttatttgtcagacttttcctttttaatatgtagtgatgaaggcccagaagtaggagtgtcatatggatgaaggtagggcagtaagtagggcctcctgacaggaagaacaggcagtggtggggtagaggagctctacatagccaagaggaatatagaggtatctgctgtagagagcacaggtgttagaagtcgcactgaggatagaaggaggcttctgggtctcattacttctgttgtatgattttgctcagataaatcttaatagtgtcccagagatgtcctcagtacctgtccagacccacttaccaaaagatacgctgtaaatagtcattttctttaaagtattagccagcctctgacttaagcaaatagagaaaaatcactgtttttaaactatgctagtaatacactaagaatgcccatgataaagaatttaaacagtacctaagaatatagagtaaaatatgaaagtatttctcatgatccttcacttccattctcgttttctctgttaacaacagtgtcagtcctggtcttcgtattcatctgtgggaatggatatttgtacatatgtacgtacatacatacacacatacctacatatttaactgcattttaaaaaccatattaggtttataccatacccagtgttttgtgaccatctttttagtgaatgatcagtctatgagattttccatgtcacttcatgaagcctgctttatatataaaaaaaactaaagtgttttatgggttcataatattctgtagtatggccctatcataatttatttaatccatcacgttttgttgggcttttgtttttttctcttctaaaaatactgccacagtcttggagtggggcgtggtttctcactataaacagatagtatagcatagtagatgagaactgcttttgttcagatgtcgggctttggtatttattactgtgtgactgtgggtcaattagataacctcagtttcttcaactataaaattgagttaggtagtattaataaatacctactttatagcattgttgtgtcaaggacttagaacattatttagtacatagtgtcagtaaatgtttgctacgaacattaataagagtatattctgaaatgtatcctaattttcaaataattcaaatgacctagttttttttaagaatagtaatataattaacctgcccattcaaatcaaataaggtttttaccagaaaaaaatacccacctcccgaattgtaataaattctaccagaacttatttcctaaatgtttttactatttaaaaactatttattgtcatgtgacaatataggtaaatgcctattttattggtgagttctttcttcatttaaaaaaaatgacattttcaatctatagatcaaccgtagactaatgcaacagttatttctcaatttgctacacagctttaattaggaaaccatactaattttaatttaagttcagtcatcacttcttcatgaataataattttggaggctaaatctgctttgctcttcaggttaatgaaaagtagcctgaatggagataacttccgaacacagaagctgtcttttatcattagaacagtgggtcgacattttcctggacacttactggcatgggattttgtcaaagagaactggaataagcttgtacagaagtaagtttctcagagaattattaacttttagtattctcaagttgtgcatttgaaaaaagctcccagtgttttggctcacagaagttaggatttgctgtgagaggaaaaatacttccatgacagtttaactgaaacatccggaaattttcacatttgttaacataattccatagcatgaatcatttaacagtagcattccatctaagttctaattaagcctagccttgcttggcaccaggttacttagctcagcgtggctacagactatttcatagcaaccatttagctatgcatattgaaaaatacctctgtatggccgggcgcggtggctcacacctgtaatcccagcactttgggaggccgagatgggcggatcacgaggtcaggagatcgagaccatcctggctaacacggtgaaaccccatttccactaaaaataccaaaaattagccgggcatggtggcgggtgcctgtagtcccagctacttgggaggctgaggcaagagaatggtgtgaatctgggaggcagaacttgcagtgagccgagattgtgccactgcactccagcctaggcaacagggcgagactctgtctcaaaaaaaaaaaacaaaaaggaaaatacctctgcattgccaaggcatcagttaagaactcacattcagctagatgcagatgtaggttttttgcttctttctctcttttaaatcaataatggcatttctgggtgtacagtgtgatcttcgacaatgttaagcggattaattgtctgcatgttctgaactcttccctttttctgcccacctttccttcccaccgacaataagtatgcatagggctaccccggtttcctcagttgcagttccgggaggaggattccactctggctttggcattaaagacttttccttgcactcaggaacaacgctttaccagcagctgcctaatttttttgctcttgtttttgtgtttcttcaggttccctctggggtcctataccatacaaaatattgttgctggatcaacttacctgttttcaacaaagacacatttatctgaggttggttttataaaatgataatacagagactgggcaaccctccgcacacccggaccaggctgctcagttttagtgagatggtggattttcatgctaattccttctcttatctctgtcttcctttatcagtactaatgattctgcattgtgattacttctagagggtggcatatatgataatgaggaaaaaatctgattccattctcttcccttgtctccctaatacaaataatttaagtggtcataaaattgtttggaagaattgcattcttggggtgaattcatagcaccaagcctttggactctactttatttattgttacttaaacatctccttggttccattttaagttagaaaaatgtatctgtgtgggagtaaaaagatttcctttttaaaatcatttcagatatcaccatacttgattgggaactccatgtagataccttgaatattaaagtacttctttctactgctttcaagatagcagcacagccatcactaagttaaagcttattttaaaagctggggttacctgaggtttattgtccttttcttcttttgaaattcttctgtgtgaaacttacaggttcaggcattctttgaaaatcagtcagaggcaaccttccggcttcgttgtgtccaggaggctttggaagtcattcagttgaatatccagtggatggagaagaacctcaaaagtctcacatggtggctgtagcatgcacaaccgcacctcattttgttgcccattcagagagcttgtaagcttgggctctgccgcttttgcaaaagccaaggtaaagccaggatcgctgccaagttgtttgcactctttggagttctagttagctcagggcctgactgtatttttcatccatcttttctgaagtgtctttgggcagtatgtagttatttattacaaaattatattcacgtaaatgccaaccatctacaaaaacaatgagtaatttttctactttgaagatacacagatggggacaaaaaccctgttttggaattctgttctattcctcagtatccagaaagttactgacacagtaaaacaaggaaagttctaccctaagagccgccatcacttcaggccgctggtttgtcagccatctgttgcttcttattgatagatggcattggaatgtggtacaaagttagctctgaagaatatggtaacgaagacaataaagcatgcactgtaagaactgacctcaggtgtgcagatctactttgatttggggttttgattaattctttatttttctgaaaaaaagtttaaataatgtctgtaactattgtgtttttttcctgccgaatagccaggtgctacagatttttaaaatttttgttgtattgaaaagctaaacaaggccaaaaggttaaattttttgaatatttaagactttctttttcatcttttatagcgttaccataggaaactgttccaaactgagttagctttaattataattattttattcataaatggtgatagtccccagatctgtacacctttatcactccctgccgtagatatactttaggttagtatttctacattcgtggcaagcattttggtaacaccagtggttttcattgtgacttttatcactatcactaagaatgcaatttaagttgccttttggcatcatagatcatagaaactttctctctgaatcatacccatgtgtgaattttcattttatatgatagtgtagcatattagaagcatattttaaaacagagcctttgagaaattgaaaaacaattatttgaagttcaccatagtaccttaaaggaacaaagagaatgtgggataggagtaacttgaattcgtgtttagtatggtgggctttgaatttttttcactatcaaaaatagtgcttttgtttagttaaaaattgtagtttttctttttttgtgtgtccaaactaacataaaaggagtggtcaaagaaggaaagaagaaaaatgagggaggatgtccgaaactgtatggcattttactccttctgaaagagaaatactgtacttgaatttttgagctatgcagacttatacctagattgttgtgtttctttgattcttaggagaaaagctttcttcctaataattcttgagaactttatattttgtttgaaaacagtttctatgtacataaaaagggtatttacccatttgtgagcacttaaaacactccacagagtcagacagtgggaaaggtcaccctttttttattcggcaggtatcaagttagaatgtatggaattgtgaataaaattatattttattttatgaaaatatttttatataataaaatttaaaaggctggtaagctaaaaaaatagtcttctttaatcctagtgtgttttccccaatttagtcttttctaaaatttatctgttttagagtagaaaatattatatcctgagaatcacagaatcatctaaatatgtcttattcaactgaagtgattgtaagtctttattcttgtgctttggttaaatgaatgataatttagttgatagtgaaagttaatgtgtttttatatttttagagtgagggaaaaatactaaacttttgagagttttgttgtcgttgctggttttttaccatgtggtactaaattccactttgatacaaaatttaaattttgtaacttctcaaaatcacttaagattcttcagttttacctgtgcttcttgacatcgctcctataatgtatgttagttaactctgcatatggcaaatcttgtcttgaattatatcatttctctccctctctctctctctctctgtgtgtgtgtgtgtgtgtgtgtgtgtgtgtgtgtgtgtgtagtgtggggggtattgttatgagtaaaactttatcaaaacttggcctgaaaaagagataactcatgatccattgctatctttattactcaaaggctgttcattcccataataccagatccataatagttgtagtttttttgatgttgttgcccttaccttaattatttgtagttttagtaggccttgcctcagtttttcccacagaattccataattttaatgttgaactaacccatctatataggacttctaaaaactacgtcaggaatgtaaggttaaatgagaggtagaacttgtagtgtaataggtataatggtagctttcaaagttttatcttctcaaaacattgtcttagccagtgtatttctgagaactcagactgaagcacagaagtcacagtatgcttcttttatttaagcacacagattcatgacacaagtacttgttgaacaagtgttctcattgcagagagatctacttgaatataaaagggtcatcatactagattattaaaaaagaattggaaatcttgagttgtggaagaaatgtttatgctttggagatctaaaaaagttatgaatgtaggaattagataagtccagtttgttctgttaatataaaatggttagatatattaaactgcaagtagtatcagcttcaccataagcttgggccttcctccatcttgttttatttaagtctctttaaatgaaattttgttgtcattgtttcagcattcatgaactttcttactatcacaggttctactttaattttccttgccatatgtgtttccattttgtgggacattagccaccacaggaacacaagagttgtcagaagactcctgggtgtacagagcaaatcaagctgcatcagtattataggataccaaacagaatcctttctattaggaaataagaaatcagttaagtgttggctgggcgcggtggcttatgcctgtaatcccagcattttgggatgccaaggtgggcagaccatttgaggccaggagttctaaaccagtttggccaacatggcaaaaccccatctctactaaaaatataaaaattagctgggcatggtggtgcacacctgtaatcccagctacctgggaggcacgagaatcacttgaacccaggaggcggaggttgcagtgagccaaggttgtgccactgcactccagcctgggtgacaaagcgagactgtctcaaaaaacaaaaaacaaaaaaaaaagagttaagtgttgattttgttggattactgacagtttgttgagatggattttaaaaagagtctatttaaaccaaagtacctggaaccataatctgccatcagattgctaaacattcacataatccccatgtttcatggggcttcagggaaggcaaatacatctgagatgagccacctccaaggacagcatttcctgggctgcaaaactagatgtggattttgttacttaggcctctctaaaaactgaggccatggatatgacatagcttttcttctcacctatgcctttgttacttttgtatttattggaattaaatctctttttaaagagcttccttcccccttcatcccatttgtatttttaaaaactaagttatatatatatttgcttgtttttgcattcttttattttgtgctccattccctgctttgccagttaagtactacctgaaaagtagcggttcaaaagtatggtaaatctcctcccttaaccttattgcctgtgtgggtgacagctaatggaaaagttgatcgatttttttcagtggtttttttgggagtatatactttaaaaatgtacatacatgtttttgatagtttttatattatttcattttgtatatttttttcctgatgaagagtgatatatcatcctatgaaaatttcatctacccttcccattttacctgtatgggcagtagctacagactagttatttggtttccttctttggaagaaggtggtgatgttgagaggagagcaagctatattcttttaaaagtgtgtacagatgtttttgctattttgtgttatttcattttgtatttcattcatccattttgtggacgtgtagataaaacgcggtggtccaaaagcatgacagatgtcccctttgcgtttctccttattgttcgcatggacaataactgacagagtagtcctagttgctgttgttttgatctagtcttggggctggggttgtatattattctttcaagtgtgtataaatattgtgccacctttttatacttcattttatacttgtttccttgtatggatgcatatatacttaatgaaaattgaggttcagagtatgacaaatctcttttcccttttccttactgcctatttaggcaatagctaatagagtagtttgttttgttttggggtgtgggggagagtggagtatgtacttaatgtatataaataaacttgctactacattgtattactaatttggttcacactgtgtccttctcatggatgtgaaagtaccaatgaaatgtggagatctcgatgtataacagtctcccattctcctcatcccttattgactgctgggcagtagctaacagagtagttgtcaagtggcgtatttgaggtgagggggagggacggggaaggtaggaaaatgcacttaatgtatatacatgtttttactactacattgtattaattcatcgggtgcccagactgaaaggtacctaatgaaccatggagttccggatgtataacagtctcctcttttccctttcccttattgcccatgtgggcaatacttaagagtagtttgggtttattgaagattttttgctaggagagagaaaattttttgctaggagaggtttcaaggtaagagtatatactttaaacatgtatataaatgtttttgctacttttctgtcactacctttcttaccttgtcctttacatggatatatgaagaaaattgaggttcagcctgtagcagctctcctcttctgcccttcccttagattgtctgtgtgggcaggtgtctaagagagtagttgattagcttcagggattctttggtgggtgttggggtatatacttttgtatatgtatgtacatatttttatttctttattatagtgtttcattgggtacccggtccttcacttggatgtgtaggttcctaatgagccatggagttatggatgtataacaatctgttctccctttacccttttaatgtatatgggcaataattttaaagtagtttggatttttttaagttttgaggggtgggaggggtctaaggcagaatatatcctttttaaaaatgtatatatacttttcattaactatattgtattatttcatgctgtacccagtccattgcttggacttacgggtacctaatgaaacgtggaggtccggatgtatgaaaatctcctcttttcccctttccttattgcctctgtaggcaataattatagagtagtatagatggtttttcttttttatccatctgcctatctccaggaggatggggtgtgcacttttagaaatgtatataaatgttcttgctcctttttcctgttacttcattgtgtgccaaggcctttccatggatacttaggtacgtaatgaaaattgaggttcattctatgaaaaaatctccccttctccccttcccttattgcctgtcttggcaatggccagtagagtagttatttaagggattttgtttttttgtttttttgttttttttttggtaggggaggtggggaatttctgggtttgtcttttttttaatgtatataaaagtttgctagttgttgttattgttgttctttcactctcaacacagttttttgtttggagttgtaggaatcaaatgtaatgagggacccagacccgagagtgtggtaaatattctttgccttcctcagagcctgtatacacaagcaagtagtatgtgagcactacagggcttgggttttggttttttgcttttgagggttttaatgaggagtgggattgttgagaggaaaaggcaagatatataatttttttaatgtatataaatgttttgctcctttttgatgttaacttcattttgaatctggtcctttgtatgaccacttaggtacttaatagtaataaagttgagattgactctatgaaaaatatcccatactccccatccctcattgcctagggggcaatggtagaatagatgtttggtttcttttgggggtgtctgagtgtatatgtgtgtgtatatacacacaagaacacacatatttatatactatacacacacattttaatgtatataaatatttgctacattctgtgtgttatataatgtggtacccagtcctctgctgggacatggatgtacataatgaaacatggaggtccagacgtatgataactctcctgtttcccttccctcattgcctacaggggcaatagtttcatatcttgggttttttattgtttaatttttttttatgggaaggggttctttgggtgggtaatagtcagggggaaaggacagtgtctatactttttaaagatgtatataaatgtttcatgttattggttttgtacctagtcctttgcatggatatataggtacctaatgaaaatcgaggatcagtgtatgacaaatctcccatcctcccctttccttattgcctgtgtcggcaataggaagtagaatagttgtgtgttgtttacttacttgtctgttttagagagatttctatttttggtaggggaatattcttaatatgttttcatatctttatttcattttgtagtcttttgcatggctatgtagggacctaatgaaagtcgagtttcataatatgacagctcacttcttttcctacatatttcctcacttagcagtagctagtgtagttattttgtggttattttatttcattctctaggatctattccattaaggatgcaagtgtgtagatgcatatatatcatttgcttctttcttccgccattattttcctttaacacttagtcccttgcaaggggtctgactatacctaacaaaaataaagacctactaaatccctgccatctggctggaaggtgtagcagtgtattaatgtaactaatagcaacaggtgtgcagcagataagacaggagaagacactcagctatggttgagttgtgaaagctaattagatccagcatttcttatgttgattcagattgaatgaggtagtgaaaagggacctgtgcttttgtaaattctagaaaggcaagaggacaatattgaataaagctgtgtttaaacttcattgctcatatatcttttagtaactggtaaaccggcgaagctgataagccaataagagtgctgtctagaacgcatttgcaaaccgttaagagtagcttctttttgaggcctggacttctgattcatctatagaagtctattatgattccatcaattgcatagcttgtgtacctggtagaaattgtgtcttggaatgaccctttcgagttattgacatggctctgatgaatagaacatgagccccaaaactaaatccaaaaggaattttctatctttcatcccccacatgtggcaagacaagttggccctttcttacccagaggtcttttgtgtgactgcatctttctcctccgttctccattgtgtgctttccattttgtctttagtgcctatactgttaggtgttttcttcactggcattcacaaatttaagccattgctgcctcattagccttgtattttgtgtgcatatcatatatccagacctgtatgttcgctttaagcattcttatatcacactgtctcctcatctaccatatggtaaatgttaaaactccacatttgtctgcatcagggaaaatgcatgggcacacatcctccctccctccctctctgctctcctcccttccttcaggcctcttagcattgtttgttttcccatttctgatactactactccatgctgaagatttgccatattactattttggaaacattgagtgatagaactcctagaaaatttgcaaagaaatgttacatactgtatatcaaactctcagattctagtgttgaaaaagtagcctatactttgctattacttatacctgctgccatagaaaaaaataagtttattcatgacacatttacatttgatcataaataaaagaaaaaagggcacctttttggagttagtcatggtagtcattagtgatatttctgaacagttcttaatttaaaatacttcaaaggaagtaaaggtcatggcttagctgaaggaaatgctccagaaattggactgtgtaaaccatcagtacaataatacgctgtgtatgtatgtgtatataaaatgagaattatggcataattggagcatttgcattaatcaacaaactcacattgagacaaaacttagttttacagctgtcttgattaaagccaagtgttccatgttgctgtgaagaatagcctctttcaaatactttggaaagtagttacttggaaacttgtaaaggtattacatttttatatttaaacacctatagagatcttcaattccttgagtctgagcttgtgggtggaattctaaatttgtatcataatctgtcttttgtgaaacattttgaaaatatgtatatataatattgtatatgcaaattgtgttgtttcacttgtaaagggaaaaggcttatttttctttatatttctgataacttgttttgcatatgaccagcactgactgaaaggcatgtgtagctgcaaacactgttgctttttttgtgaaatgaaaataaaagtatttaaatacaaacattgtgtggactctttggattaatgtatatataaagtggtatctcttcttaggttatgacctctaccagggcagctcctgtactcattgtcttctgtggttagttttttatttcaccagtatccagtgtctttattgcatatacctcagttgacatttgacattcggaggtggctaattctttgttgtgggggctgttctgtgtatcataggacatttagcaggatccctcccatgccaattgcaactagttgccaatagtaactcttgtccccagctgtgacaactaaaacctctcctccagacattgccaaatgtcccctgaggttagggttaaaactttgagtggatgcatagggcggatagctaacagtcacgggagctccatcaggaccattatttactttttggactaaagcagttcttgtaaacactcaggtcacctaagtagccaactgatgcagtagtcatacagtacctaaatcagtgtgagaaatgtcatacgtgtcgtatgccagtgaaaccaaggaacgctgtcttactttgaaggtgagacattggatgttatcagggaaataccccttgcgttgattcacatataagtaggagtatgagtgcacctttttagaggcacactgccacggttacattcctggtcaggtctacaaaaggagtttcttggttctgtctgcatgagtagccttgaggaagaactgagaatttcttaggcttccagatatatgaactagaataagtattcttttacagtaattgttaggtgggcgtttgaaggcaaagtaagtcttaactcccatacccaaaatcctatttctgaggacacaaaaccttgatgcatgcccttttaaaatctcttataatgatcattactaatatataggggaaatgttcttaaaattgtgaagttttgatcagaagcttctggttaaattttttgtgctttttaattcacagataccagcagtaaacaattgaactaaaacccattataaatgtaaagaacactttgattctgatagactttttggatggagagtaacaataacctatttttctaaattatttttagaacccatggtacagaagaatgattcagttgtatcttctttttgcttcttctgttcttacataaagccccccgaccccccaccgccaacacacacacaaaggctctggtgtttactaaaacttgtgtgcaagttgaacagttgacttacatgcttaaagaggtggttttctgctagagggcaaaaacatacttttaagtcgttaatttcacccacctactagatccataattgatatgttcccaatgctctgtgcttgtttacttttatcatttctcttcatggatgacctccattcaactggccaaagtccagttgaattgaaatgcactttgggtacccctgtaatttctgttgttggctgagctgaataatcaggaccttggcttacacagaataagtttgattcttgctttcctattcccatttgtgtttataaaagaa

SEQ ID NO: 1853 - DNA, 4052 bp, Homo sapiens
gtttatttatggtctgtttctggaatgtccgctcctgggactgggaccatgattttctggcgcagtgcgggtgtctcggcgtccgggatcgggcgggtcgcagtagggctccacatttgttgagtgactgaacaccgttcccggccggggagagcgccgcagccgggtccacttcaggtaggggctgggctttcccggccccgcctaggccccgcccccagcgcgaacccgctcccacctcgcctgtccacggagcagcagggggtttgactgtgcttttccctcttgcttccctcgctctttctgcagctgccacgaaaacccggaacggcggagcggcgccgcccctcgcggcacctccctggcagcccttggaggccgcgctgggcatgctcagtcagctgggccgcctcagctctcggagtaggaagctcgggcgctccggctgtaaggagccgcggcggggggaaaatggagcccttcaccaatgatcggcttcagctccccaggaatatgattgaaaacagcatgtttgaggaagaaccagatgtggtggatttagccaaagagccttgtttacatcctctagagcctgatgaggtggaatatgagccccggggttcccgactgctggtgcggggtcttggtgagcatgagatggaggaggatgaagaggattatgagtcatcagcaaagctgctgggcatgtccttcatgaatagaagctcaggccttcggaacagtgcaactggttacaggcagagcccagatggggcttgttcagtaccctctgcaaggaccatggtggtctgtgcttttgtcatcgtggttgctgtttctgtaatcatggtgatttacttactgcccagatgtacctttaccaaagaaggctgccataaaaaaaaccagtcaattggactaattcagccatttgcaacaaatgggaaattgtttccatgggcacagatcaggcttcccactgccgttgtgccactacgctatgaactcagcctacacccgaacctaacctcgatgacattcaggggttctgtgacaatttcagttcaggctcttcaggtcacatggaatatcattcttcatagcacaggtcataatatttcaagagtgacctttatgtcagcagtttcaagccaagaaaaacaagctgagatcctggaatatgcatatcatggacagatcgccattgttgcccccgaagcccttctagcagggcacaattatacgttgaagatagagtactcggcaaatatatctagttcttattatgggttttatggcttctcctacacagatgaaagtaatgagaaaaagtactttgcagcaactcagtttgaacccctggcagcaagatctgcttttccttgttttgatgaaccagcatttaaagccacttttatcatcaagatcataagggatgagcaatacaccgctttatcaaatatgcctaagaagtcatcagtcgttctagatgatggacttgttcaggatgagttttctgagagtgtgaagatgagcacttacttggttgctttcattgtgggagagatgaagaacctgagtcaggacgtaaatggaaccctggtttctatatatgctgtaccagaaaagattggtcaagttcattatgccttggaaacaactgtgaagcttcttgagttttttcaaaactactttgaaattcagtacccacttaagaaattggatttggtggctattcctgactttgaagcaggagcaatggaaaattggggtttgctcaccttccgagaggagacacttctgtatgacagtaacacttcttcaatggcggatagaaagctggtgactaaaatcattgctcatgagctggcccaccagtggtttggcaatctggtaacaatgaagtggtggaatgacctatggctaaatgaaggttttgccactttcatggagtatttctctttggaaaaaatattcaaagagctttctagttatgaagatttcttagatgctcgatttaaaaccatgaagaaagattccttaaattcatctcatccaatatcatcatctgttcagtcttcagaacaaattgaagaaatgtttgattctctttcctattttaagggatcttctctcttgttgatgttgaaaacttaccttagtgaagatgtgtttcaacatgctgttgtcctttacctgcataatcacagctatgcatctattcaaagtgatgatctgtgggatagttttaatgaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaagctacctgtggcatattccactatcctatgtcactgaaggaagaaattattcaaaatatcaatcggtatcattactggataagaaatcaggtgtcatcaatcttacagaagaagtgctgtgggtcaaagtgaatataaacatgaatggttattatattgtacactatgcagatgatgattgggaagcactaatccatcagttgaaaataaatccttatgttctgagtgacaaagaccgagccaaccttatcaacaacatctttgaacttgcaggcctaggcaaggtacctctcaagagggcctttgatttgattaattatcttggaaatgagaaccatactgcacccatcaccgaagccctgtttcagacagacctcatctataacctccttgaaaaactgggatacatggatctggcctcaagactggtgactagggtatttaaattacttcaaaaccaaattcaacaacaaacttggactgatgagggcactccatctatgcgagagcttcggtcagccctgctagagtttgcttgcacccacaacctggggaactgctctactactgccatgaaactgtttgatgactggatggcatccaatggaactcaaagcctacctactgatgtcatgacaactgtgttcaaagttggagcaaaaactgacaaaggctggtcattccttttgggcaaatacatttctataggctctgaagcagagaagaacaaaatactagaagcacttgccagctcagaggatgtgcggaagctttactggttaatgaaaagtagcctgaatggagataacttccgaacacagaagctgtcttttatcattagaacagtgggtcgacattttcctggacacttactggcatgggattttgtcaaagagaactggaataagcttgtacagaagttccctctggggtcctataccatacaaaatattgttgctggatcaacttacctgttttcaacaaagacacatttatctgaggttcaggcattctttgaaaatcagtcagaggcaaccttccggcttcgttgtgtccaggaggctttggaagtcattcagttgaatatccagtggatggagaagaacctcaaaagtctcacatggtggctgtagcatgcacaaccgcacctcattttgttgcccattcagagagcttgtaagcttgggctctgccgcttttgcaaaagccaaggtaaagccaggatcgctgccaagttgtttgcactctttggagttctagttagctcagggcctgactgtatttttcatccatcttttctgaagtgtctttgggcagtatgtagttatttattacaaaattatattcacgtaaatgccaaccatctacaaaaacaatgagtaatttttctactttgaagatacacagatggggacaaaaaccctgttttggaattctgttctattcctcagtatccagaaagttactgacacagtaaaacaaggaaagttctaccctaagagccgccatcacttcaggccgctggtttgtcagccatctgttgcttcttattgatagatggcattggaatgtggtacaaagttagctctgaagaatatggtaacgaagacaataaagcatgcactgtaagaactga

SEQ ID NO: 1854 - protein, 1025 aa, Homo sapiens
MEPFTNDRLQLPRNMIENSMFEEEPDVVDLAKEPCLHPLEPDEVEYEPRGSRLLVRGLGEHEMEEDEEDYESSAKLLGMSFMNRSSGLRNSATGYRQSPDGACSVPSARTMVVCAFVIVVAVSVIMVIYLLPRCTFTKEGCHKKNQSIGLIQPFATNGKLFPWAQIRLPTAVVPLRYELSLHPNLTSMTFRGSVTISVQALQVTWNIILHSTGHNISRVTFMSAVSSQEKQAEILEYAYHGQIAIVAPEALLAGHNYTLKIEYSANISSSYYGFYGFSYTDESNEKKYFAATQFEPLAARSAFPCFDEPAFKATFIIKIIRDEQYTALSNMPKKSSVVLDDGLVQDEFSESVKMSTYLVAFIVGEMKNLSQDVNGTLVSIYAVPEKIGQVHYALETTVKLLEFFQNYFEIQYPLKKLDLVAIPDFEAGAMENWGLLTFREETLLYDSNTSSMADRKLVTKIIAHELAHQWFGNLVTMKWWNDLWLNEGFATFMEYFSLEKIFKELSSYEDFLDARFKTMKKDSLNSSHPISSSVQSSEQIEEMFDSLSYFKGSSLLLMLKTYLSEDVFQHAVVLYLHNHSYASIQSDDLWDSFNEVTNQTLDVKRMMKTWTLQKGFPLVTVQKKGKELFIQQERFFLNMKPEIQPSDTSYLWHIPLSYVTEGRNYSKYQSVSLLDKKSGVINLTEEVLWVKVNINMNGYYIVHYADDDWEALIHQLKINPYVLSDKDRANLINNIFELAGLGKVPLKRAFDLINYLGNENHTAPITEALFQTDLIYNLLEKLGYMDLASRLVTRVFKLLQNQIQQQTWTDEGTPSMRELRSALLEFACTHNLGNCSTTAMKLFDDWMASNGTQSLPTDVMTTVFKVGAKTDKGWSFLLGKYISIGSEAEKNKILEALASSEDVRKLYWLMKSSLNGDNFRTQKLSFIIRTVGRHFPGHLLAWDFVKENWNKLVQKFPLGSYTIQNIVAGSTYLFSTKTHLSEVQAFFENQSEATFRLRCVQEALEVIQLNIQWMEKNLKSLTWWL

SEQ ID NO: 1855 - DNA, 49753 bp, Mus musculus
  misc_feature (1)...(49753): n = A,T,C or G
agaagataaaataaaatataggagataatctattctgatagagatgtgaaatacactatttacttggtttctgcaaggtggattttaaggaattcatggcacccaaatctgtaggatttgagctattcagaggatgaaaatcagcttaaaaggacacccatttgatttgagaagcaatgagacaggattttgccaaaaaaagagggggtaaatttatcagttatggaaagaatgtgaaccaaagtcataaactaaagaaagcaaaattgaaaggacagtgagttagaacaacagacataggaagctgaaataatagactatggcaagggaagctgcgaggactggggaggatgatcagatgatgtagaaacccaaaagggatgagctcagggaaagaaagtatatctgaatgggaggcagcattacagctgatattacagaaccagtgagaaaccaaccagcctgccaaatgttgaaacaaaagctcactggggctaggaagccatccactggggagtaacaatgggaatgtaaactaaatctgacatggggtgttagtagaccatgttagtaaataattgttgtacagcaagcataaaattgaatatttaattatattaaataaataaaaaacataccaattattagttttcaattaactaattgtatataattggttggtattaacaacgataagtaataaatgtctgattaggttaatcaattgttttaaaggtgctggcctgaaaatgaattgaaaattaaattcacaattttagacatttaaaaactgatttccagtatgaaccaataaatgcaccattcgctcagaccaattcttttaaagtcaattataaaatatatgtttgaagtctactatttgtctatcctgtttttcttatgtcgttacaaaaaagttttagtatacaaaaattaggctagtgctatgcagattaattttgaattaaatgaaatgtttaagtgaatgtttattcctgtactttaaatcatgaagaactgggcgtggtggcgcacgcctttaatcccagcacttgggaggcagaggcaggtggatttctgagttcaaggccagcctggtttacagagtgagttccaggacagccagggcttctcagagaaaccctgcctttaaaacaaaacaaacaaacaaaacaacaacaacaacaaaaaaaaaacaaagcaaaacaaaacaaaacacaaaacaaaaaaaaagaaagaaaagaaaaagataagacattgaggaaatttcacaggaatcaagagttcccaatatatttgatgaagttactattactttatattaagcctagaaaacaaaaccagaagataataaattatataaaactgactgtgtgaaaaattttggtatagtatatttctacaataaatataaactgacaaactgatattcaaaatagtttagtgttgcctcaaattgctaaatttagaactgccatatcaagtcagtctcctcctaacaacgtgtcttaaacaattaaaaaaaaaccctagttactcaagtgaaatcgtatgtatatatatttacttgtaagggtaattcataagagatcaaaagtgaatcaaatcaaatgttggccaatgggtacgtgaaaattgcctgatacgtgttaatatttttcttgcacaaaaagtatgatggtatataaaatgatgtggataaacttcaaaattgtacacaaagtaaagtggacaacaaaaatggcatatgatgcatatttccattggtgtacagttttaataatatgcaaatatggagacacaataatcaaattggttaatttagagctcaggaaaggaaggcatggagaatgaatgcttactcaataaaaggcttttttttttctaagcagaaattatataggactagtgataacataatgactatactaaattaatgtgtagttctacattataatacatatgtttgcaatgtacaaatttcacttaaataagaacccaacaatgtgggcaatatacaccaataccacaccaaactgaggttagccctggtggttagtgctgtaaagacacttccttgtttctatttttatgtcatggcttcaaacagtaaaacaggaagtgaaatattaagaaatcagtaagatcagaatatcatggaatattgaagcaaaaatatgccaagtggtacatttgacaagatctccccctcctgctcataattcttatgacactaacatcatttgtggattttcaacttatattcaggaaggtcaatcactccttttctttttttcatcaagaattcccactgcattagccaaaacactagcatctctacatatgcatgaaaaactctcatatctccattccacccatagccttcaatggaagagatgatgagtctgatactctagttaagactttagtgaagaaggacaacctcaactgtccaaactcccaatttcataaatattgttagacatagacattcaggatcttgaacttttgcaggtatgttatgtaataaggacatcatcacatgaataagatacatgatgctgccccagtcattcttaattattcgaaaacatatgtcaggctgggcatggtagcacatatctttaaccccagcacttaggagatagaggcagatggatatctgtgagtttgaggtcagtcagggcaacataatagagaaatctgctccaatcaatcaatcaactatcaatcattcaaacaactaaaacccaaaatatgtttatgtgagaatatgttggtaaatctcataaaacggctcctagtaaatccagacaccataagcatgaacataggaacatgacacagctgcacagggactatgaaataattttatcatatggaacatgagctcctgaagcatgggtttactcaatacctggcctgctttctcatcatcactgctttggcttttataaaccacctcctttactgtcttccctctacaattctaggatttggagaattttatctctcagtttgaagactcaggttttgtccttgtggccctgggctccatagcaaccatgcatcagaccatggaaattattaaggagatgaacagtgcctttgctcacctctctcaaggggtgctatggacatgtaaggattctcattggcccaaagatgtctgattggccccaaatgtgaaaatagtggactggattcctcagaatgacctgttgggtaaggattgtccagatctgccatcttactcccatttcatgttttgtagactcacctagtgtctcattgggcactgatattcacagaagatgctgatcataaagataagtctccagaaggcaggaaagaagctggagttgttagggagccaggctgtgcttcagaccagatatagcagcaatttctgtttcctgctcaactcaggaaccgtcttaggtttccaaaggaacttcttccttgaacagtatctaagctgaatatagtcattctaatctgaccctagacttgtgaagtgcaagcacagagtcctgcttgtaggcttgcggtgactctatgaatatttgcatggcataggcttagcatgattaggagtgcaaacattcagacacaaattacttgtctactgaggttgaaaatgcaaatctccttattgaagtcttcagggtttaaggacactggaatttacctgcatattaacccggataacctcagatataatactgagactttgagtaattgggcaagagagggttctttacatttcaggtccttgttcttgcttctgtactgccatgtgaagacccaccactaccatactggctagatcagagtttcaaaaaggagattatggctgaaagttagttgagaaattttggacaaagatgctttttagtaaaactgcagctacatgacagaggaaggacttactttccagggaatatgagtagattccatgtgaaacacattctgagatggattctttataaccatcaaaaatgtattagcttgttctgagcatggagcaatggggaagccctgtaaatacagaagtgaaagtctactgtgcccatactgcaagcttctctccaaatagagtaggcaatacacagaggatacagttagtgagaaagcagatgtgcacagcaagagaaagcatggatgcgaaaactgaagaaagcattaacgggaaatggatgagggcaataacgggggatatgcctgtctttgtcactctcctctgtagctgtccctggcttctcagttcagagaagtcagaatctgtgtggtgagtcaagtgaactttgcattctgggatatccccttttgaatttctattttttcattcaattaaaatatgattgcattactttccccatccctcctctttcatctactctgcccatatatcacccctcacctacctcctccccaagtcacagagccttctcttctctaattattctgctacatatacgtacaagtaaacatataaacataacttgctgtgtctggccagtgttgcctgcaagtatatgtttctagtgttgcccatttgctattgaataaaaccaatcaggagctcattcctggggagggaggaagctaatgctccctctctcagctgttcattgcctgactctttacctagtgatgggtccatgacctctcatgtatactgcgatgccaattgatgctattattgttgttcaggttagaaagctgtgctgttgagatttttgcaggtgtaatttacttatcaaagttacaaggatgtcctgactccttggtcttaggatcttgccattcacttatctgggatgtgtctggagccttacgtgcaggaaatgtattgtaggtatgtcagtcagagccagacaccccacagtcagctgttctatacattttgactagtggtagctttctggaatggtttccctgtgcttctgaaagaagattctttgataaggagtgagaactatgctttggaatgcacttaggaaaccacactggttcaggaaagtgacattcttttcaggcatttttgggtttttaactggtatttcttggctctgctgttttacctgttacctggacctttttatactgaaatcttggaccatctttctcttttgcaacagctcaccctagcatccgtctgtttgtcacccatgggggactgaatagtgtaaatgaggctatcgagcatggagtgcccatggtggggactaccatttttggagaccaacctgacaacatggtccgagtagaagcaaagaaccttggtgtttctattcagctacagacgctcaaggcagagtcatttttgctcaccatgaaagaagtcatagaagaccagaggtatgcagctctctgggttgtggtcccttaggctgaatgcaggcctgacacagggatctgtgttgtctgctttccagtgaaaccagaattttgtgggatgtgttgaaacacctgcgtgattcttgaaggccctgcctttcctttgctattaatcgtaattttgggtgaagtgcagagagtatgttactacctactgtggtgtgatgatttcttatctacacagtatctttcagcttatttatcagatacctacagacttccagttgagtcagaagaggattgtctcagttactaatctactgtgaagaggcaacaaataaaataaaataaaataaaataaaataaaatatttaattgggggctggcttacagtttcagagattagggatatgggcacagtcaggcaggcgtggtacttgagcagtagcctagagtatacattctgctctgcaggtaggagatagaaagagagcaagactgggcctcttgtggacattttaaaacctcctgtgacaaactttctccaacaaagtcacagctcttaatcctttctaaacagccaccaattgaaaaataagcattcaaacatatgagccttcaggggtcattctcattcaagctacaaggccttttcttatttttcatatggctggtctctcctcctaaggtcttgtcatgctactcggaggaccatctctcaaatgtcttcctcttaggagaccatgcacttagctatgatttctttctacccttgaattctctcattatctgtcactttctcttcgacacttggaaagatttgcaacatttccaacaggtgtgtcattattgtctgctctacactagcacctagaaagcatgtaccacgaagaagcagtttccactctgttcctagggctcaggacaggtctgttataaaggaacttttcataagtctagcacaagtgagacatgcacaggtgacccacatatcacttgcctacctagcacagtgatttcacaaccaaataggattaaatcctcaggtttcaatgtcctaaccgcttcatcagatgtacatcctgtcacatattccaatgtatttaatgtgagcacaccttcagcaccataggagcaatccttccagacatagtcatttttaaaacaattcccttcaagggttaattttgatcctttctgtataaggattttatttttagcattttattaaacgtttagttggaactcaggtaggtagtgtcaagggtatgccaacaattttgtttgatgctgacctatgggtatgtccttggaaaaaatacatgtgtgtgtgtgtgtgtgtgtgtgtgtgtgtatgtatgtatgtatattgcattggtaacacatcctctctttatctgctcataggtacaagtctgcggcaatggctgccagagccattaggcgctcccaccccttgacatccacccagcgtctggtgggctggattgaccacatcctacaaaccgggggaggcgcacacctcaagccccatgcctttcagcagccatggcacgttcagaacttgctggatgttctgttgtttctggtggggttcactcttggcaccttgtggctatttaagaaagtgctgacattgttgctaaggtccctaagtgggaccaggaaagaaaaggaatcttaatgttaagtttgattggggtaggatattgggaactctggctccttaaaggcttttcctcacccggcacgaggaatttccattttcctctagtcatggtggacttccagttgtcctcagtatttctgtctttcataattctcatataatacactgacttcctggcgactcctcattatctggatccctatgctctagtacaaatcttcctttcccagcattttctttcctttcctttcctttcctttcctttcctttcctttcctttcctttcctttcctttcctttcctttcctttccttttcttcctttctttcgttttttttttttaagttttacttattattactatatgtgagtacactgtagctgtccacaccagaagagggcagcagatcacgttaaggatggttgtgagccaccatgtggttgctgggatttgaactcaggacctttggaagagcaaccagccagtgctcttaaccactgagccatctcaccgtgttctgacagcttcttcaatcctctgtgagatcttgttcttcaattcttatttctcctatcatttgggataaaactcccacgtatttgacaagttatttttactcctatacttttcttatctcataagctctcctaatagttcagaatgcctcctctgctgcattgcactcttcccattggatgggaccagccactctcaggatataatagaaaacgttttgccggacaatggcaacatgtgaatgaatttttttttttcttgagagaaatcagtgttaaagcgcatgggcaattgaaaactttggagaaatgatttttgataaaactgtgatatggaagatttatttcttgatgtctgagaaattaaaatcaggaaataaaagaaattacagtttatctactcattggaataacagctatgtgaaaaatggaataaatcagagattaataagttggtacagaatgaagttcaatattgttaactaaaatggtacaaagagaagtaataaatatagaatgtcctgttttttcaacatagtaggagttaaaaaacgatgaacaatatgtgtttattaataaaaattatataaaacacacacgaggaaatgctgtgaggttcatttgcagtgcatggatgaagctattatagttcagattacacacagcctctggatgtgtagctgtgctaatattttatatacagaacatattaaaatagaaaaaatggttgagtgtttaaaataaaacatatatggaaaagatcgtacttctcttcagcatttttataaccatgaaaaacataaaaatgaaaatctatcatgacagttgagagatttttatttagtttttagattttcagatggaagagaaatatattacaaatgaccttgcaatgcattatctgtatttcatagtggtgcagattatcatttgagaatgtattaacttggcataggattgagaaaatgagtaaataatttggaaatgttgagaggtttcatagctactaaaaagagaatcagaaatgtggtttgaaaagagcagtagcattactgtatgggcttaagagctgatcaagaattcataattttatttgataaagataggaagagctcaacacagaggtacagagaagtgatttttataatcacagttaacctgtttattctctagatctgaccaaatacacacacacacacacacacacatcccaaacaaacaaacaaacccagcagtcttttattagcaaggagtgggcctaggcaccatattctaatctctaaataggatttcccatgaggagctatgatgccttgggaaactgtgattggaagaacccatttcctgcactctagtccagacccttctgtctacctgacttcactccaccctaatcacatccaacttctagacccatcctttcttctgctcagggccaaactatttgctgatgatacatcctgggagaggagaacgattgtcttcagccatatatccactggtgacctcaccaggctccaatggatggttccaatccaatgattacacagccctccttaaactaaatcggaccaaaacaagacagagaggcatgaatctggaagtgagaagcatactgaatccctgcccgtgtccgcactttcccttaatttgttaaataccatgccctactggaaggagacttggaaagagactaagggaagttttgaggcaagtgattattaatgttgaataaatctcatttgatgtttatgtcaaatctcagaaattatactgttcatttgaatgatattaaaaatcaactaccacacttgtctgagtaaaatgtgtaacaggaagtggaccagaggcctttctagaaagttctgttcctagttttttggatgactccagggtagatggagcctggggatgggagtgtggtaggccgttggatgttacagatactcagggtagaaaatgtggcttaatttactcccaaagcaaacaacaagcctgcttttgctctggcaaacatattgctaagaacaagtgtggagctaatagagaacaaagggtaaagttacagaagctaaaacaccgtggggaaaggtatcttcttagtgtgtgaatgtagaatttaaaaaacgagggcattgcctataattgctgctacttgctcctaagggttgtggtttcctgattcacctggcaataagtcaccagggagacagccttgtagagtcagaagggagccgcctgaagcaagtatggcaatttatcaagcatttccttttaaaacgtgggataccagttttgatgctgttttagaaaccaaacaattgccagtagaacttccgcctaccatttcttccagaacaaacagcttgttgggttttcacagtcactgggatttcctaggtaacgaggagtgtaaacttgagaaaaggcagaaccagcatatgaatgacagcgagcggagccaatcagagcatgactttgcttcagcgttcccaggctatccaattagaactgaaagccttgaaaggccaggacagcaaaggaagacaggtaagagggagacacaggaccatgggaggagactagagtccccagggccagaagtccagagtttcaccgtgaagcagcctgcggctacagacgagcatttcaggtaattcaatgctttcatttgtttaattcactgtcactgtttttgtttcatttttaagatgaggatctcttatctaaaaagaaaagttaaaagtcagtgagaatgcatgtcctgacgaagccatccctagactctcagtgcacaaagagcacagctggtccccaggtgtagacttttggaatagatgcttagacaaaaatcaatttcatttagcaaaggcaaaagagataacactttcagagtggtgcctatttgctgggtcattggatgagaagtttctttgatgacttgcagtaactatcccgatggccacagacaaaacagagcttagaattctgtctccaactcacaaaatgatcaacagatttagcattattcccatttattctgtgagataagtttgtactgattataccacatcctgtgaatccatgacagatgcaggataaaaatttagagtttttaatttagcgttttttttttgttgttgttgttacttgagaattgaatacattagtactatatttatttaatatctaccctccactctccactctttaaattcatggcctcttcttttttaattctctcccttctcccccctctctgtttcacacacacgcacacatacacacacacaggcacgcacacacacacacacacagtgagcttatttagtgatgcccatgagtacatgcatgtaagactgactgcttcgtgtgagatgcgttatccagaaagtcctccctatagaaaatggattctctctgtctcagcagccattgattgactggagctcttttttcttatgattaaaaaaacagaaaaccaaaaatcacttctttgagatcataactgtattatgcccccatcccttaacctctccaatccttcccatatgccctctttgctctgtttaaaattggccatgtgtttcttttttttttttcattttttattaggtatttagctcatttacatttccaatgctataccaaaagtcccccataccgacccacccccactcccctacccgcccactccccctttttggccctggcgttcccctgtactggggcatataaagtttgcaagtccaatgggcctctctttccagtgatggccgactaggccatcttttgatacatatgcagctagagtcaagagctcccggggtactggttagttcaaaatgttgatccacctatagggttgagatccctttagctccttgggtactttctctagctcctccattgggagccctgtgatccatccattagttgactgtgggcatccagttctgtgtttgctaggccccggcatagtctcacaagagacagctacatctgggtcctttcgataaaatcttgctagtgtatgcaatggtgtcagcgtttggatgctgattatggggtggatccctggataaggcagtctctacatggtccatcctttcatctcagctccaaactttgtctctgtaactccttccaagggtgttttgttcccacttctaaggaggggcatagtgtccacacttcagtcttcatttttcttgagtttcatgtgtttaggaaattgtatcttatatcttgggtagcctaggttttgggctaatatccacttatcagtgagtacatattatgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttctcctgtatttctttaagtgatttattaaagtccttcttgatgtcctgtaccatcatcatgagatatgcttttaaatctaggtctaggttttcgggtgtgttggggtgccctggactgggcgaagtgggagtgctgggttctgatgatggtgagtggtcttggttcctgttagtaggattcctacatttacctttcgccatctggtaatctctggagttagtagttatagttgactctgtttagagattgttcttctggtgattctgttgcagtctctcagcagacctgggagacagattctctcctctgagtttcagtgctcagagcactctctgctggcaagctctcttacagggaaggtgcgcagatatcttgtttttggacgtcctcctggtcgaagaagaaggcccaaaacagggcctctctcagaagctgtgttgctttggcagttcccagaagctgtcagcttctgtggtgcagactctcacctgtgcagactaaaatcctaagttccagggagtcctggaacctagatggtgaccgctgctcctgaggctgaggccgtctcccgagccaggcggacacctgtcctctggtccggacggtggccggctgtctgcggcccgccaagggtgctgcctcagcggctctgtgcttctgcccgtcccagaagctgtccggttctctggcgcaccctctaacctgttcagactaatttcctaagttctgctgagtcccggaaccaagatggcgaccgctgcttctgaggctgaggccgcctcccaagccaggcggacacctgtcctctggtccggatggtggccggttgtctgcggcccgcccaggctgctgcctcagcggctctgtgcttccgcccgtcccagaagctgtccggttctctggcgcaccctctaacctgttcagactaatttcctaaattctgctgagtcccggaaccaagatggcgaccgctgctgctctggccatgtgtttctattgcactaatataagtagaattttgtatataaacacaaataatattatggtagctctgagtgtgccatcttatgtgcactattatgcagaggagactacaggaccacagtactgtggagtgtgtccacaactgtaagcatcttagtgaacctttggaaggattgtgagtaaaagcacactatatgactctgatccagaccagcaactgagacatctttctctttcagttctattaagtaagtatcattttagtaacggtttctatggtgacagtggtgaagggaatgggcaaatttgtgataggaaggcataggtgcttacctttaacagaaagaaaggagaaaggaaggtatgagtgtgatctctgtgaggatgaagcaattttgactcactctggcactactactgcttatgctgtcagggaaggaaaaggcacatgaagtcaatgatgtacagagggatgaagaaaccgtggtttaaaaaccacccttcatcacagtaggcagactggagacagacttcagtttggatagctcatgtttctcattgggataccatgcttctagaatggtttatctcacctctgttagcaacggagcgcctgtagctctgaacctagctttcttgagaaatttcatcaagcacattgcaaaaattagaagctttgctgaaaagtgttgagatgacatttacaaaattataacagaggcttgattttagtaataataagttgagaaggaccttaaggaatgtaaacccctttcaatcagtctggaatgtaacttaattattctaggtatcaagttcttcttttcagacctcttcacttttctctctcaaacatcttgctaccacaaaaagctccttggtttattaatagcttcccatatggaaaagcagatttcgattaatttgtttttgtcttatgtgaacagatgatagtgatgatcaaagctcttgcagtgaagacacatcatgaccatggtacctcttataaaggaaaacttttaactggggttggcttacagttcagaggtttagtccattgtcatcatggtgagaagcgtggtaaagcacacagtgctggaggaggacctgagagttctacatgcagatctcctgcaggcagcaggaagagataggcctgaatttagcatctgaaaccctaaaacccacccccaatgacacattccctccaataaggccacaccttctaatagtgccactccctattaacccatggggaccattttcagtcaaaccactataacatctattccaacttaatactacagcatcatattaagtgctaatatataagaataagaaaaaaatgcaggatatagtttttgctccaagaactttacaacctaaacggacatgtagtgcaatatggatgctatctcagttttggacagagatattcatagtgcatcacaaaatatttcagagtgggggcaacgactgtgggaggcttcaccaaaggaaggcctatcttctctaggccaatgagagaagatgttcctgaactgtgactgtacttacaaagacaaaaagattataattatatcatttccccctatcctttcttccttcaaacctctcccatgtatctctccttgctcgctttcaaattcatggcatttattttccattgactgttgctatgtttatctgtgttcctctggccatcccttcttctgcaataatctctgagccttaggtgcaggagttgtgttgtatagatacatccactgggaccatgcctcacgactccgcattttgattggttgctttttctgtctgttgcaaagaggagtttctttcatgaggcataagggctgtgctcacttgtgggtgtaaggacaaatatttagagtgttgttagggattgtgatggtttagtgaagtggtggttgtaggttctcctccaagatccatgacttcaccagccctggatagttggataagcttccagtatcaggaatgattttcttcttgttgaataggcagatcttcaattagagagtggttggttgctgccaaggtgagcatgccactaccatggagaggtgctgcttatgggcttgttcatcatggcttgctcaacctgcttttttatagaatccaggaccattggcccagggatggcaccagatagtggtactttctctgacccaccagcggcataaataatgacacagaggcttttcaatattttaaagcttcggccttctagctagagcagtctcctagccagctatctagcttaatccaactaatcctggtactgcagcccaccatgtggttctacttcgatgctcagctctggactgtctgttcaccaccttgtcttctggcaaatctcttgcatctcagcatctcatatcttctcccagaatccatccatctctctctgtctctctatctctctgcctctctgtcgtctctctgtctctctctccaaaacttttgacctcaatagtttcttttatccctttaatttttaaaaaataaaactatattctactggcattttaaaataaaagtttgtttttgttgttgttattgttgttatttattctgagctgacaggcaaatgtgtatgtgtttgcatataaaataattaagagaatttagagaggcagttttctgtgttgcagagacaagcaggtactcactgaagggatcattgtaaatcacctggttactgtgggacatgccacaggatgtctttggtattccctcgagattcactttattcctgatagcctgggaagattttctcatgtgttttagggacccaacatctgaggatggttgttccccatcttttatattttgcacaatcgaagggcaatcgataaagattcctaagcactcttacttagaaggtgtgctctgagagcagggcagtcctcagttagagaagatgtggcaatgtgtcactcccttggaaaatgttccctctgtggctgtcaggaggagggccaatctcctccaggagcctatgacattacctgatttgctaggcatgctttgttcaaatttttggtcctagagtttatatgctaatattctgtgcagactacaagagctctttgttgacaaaacagtattttttaaaatgttataatgtgtatgtgactattgttaaagtcttgtcttgttctcaaacccttgaacattagttttcttattttgtaaaatggggttaactatgtttccactactatatgtaactgtacattgaaaatgctaagatttagtatcaagatatactttataccaaaaactcctctcttcttcttcttcttcttcttcttcttcttcttcttcttcttcttcttcttcttcttcttcttcttcttcttcttcttcttcttcttcttcctcttcctcttcctcttcctcttcctcttcctcttcctcttcctttctcttgctctcctcctcctcttcctcctcttccaccaatttatttcagttgggggcatgatgagtgtcttggcatgtttgtggaatacaaaggaacacttgctaggactgtctttttttctttactatgtgggtcctatattgaattcaggttgccagtcttggtggcaagcagctttacccatgtagccacctcactggcctcagattaaaaataaaacaaaacaaaagaacagctctgtttctaatagactggttgagaattatctgcaaaacagttttgttgatagcaggtgaccttgatatagtttaaatgctaaataatgtttcccattgctcccattgctcttatttttctcttttacaaacttttcttcataaacccaacaataaacatcccaggctttgtgtcataaagtctttgatgcaactctttatctttgtaggcccagcaggaaggtaggcataggtcctgtataaacaggtttgtaaactgctttccaataaatccttagttacagaaacaggtgaagggtcagatttggtgtccgagctttgtctgttcttgggtgaaagtcatttttggttatgtttgtatgaacccagagtatcttgttatgggttgatcagagattcaccacgaccatgaatacattttaatgagtaagaggctttatcaaataccaggcaaaccatggatactgtccaggaacatgctagagatgctcagagtatggctctgacacgttgttagtacagggttaatagaggaaaaaaaaaaaaaaccacagagacacacaaagttacaaggcttttgggggtcaaattagctcacattttacagtgcctaacttttacaacagacattctacagatgtctcagttatctccagccagcaaacagtatttacaataataaaaatagcagttagttccccggacccattgtcttgcaagaacaatggagacagtaaaatttatgacaaagggtggtttcttaagattgcttcaactattctggggaagtcatctatcttagatcagttcattgacaaggtgcctgtcacaagccagcagcttacaagctgaaacaaatttcttacggattcttgaagtacagtagacattgtgaacatgctactcaccaccacagtctcagctttagaacactgaacagcctatggtttgaaaaaacagtggttggaaagtgtgaagtcattgctgtgctaaattctgaatttagtcttcagcataaaggtcttccccatgcctgtacaattctcagattgcagatcagtggttctaaaccttcctactgctgtgaccatttaatagtgttcctcatgttataggaccctcgaccataaaattattccattgctacttcataattgtaaatttgatactgttatgcatagtaattcaaatatctgatatacaggatatttgatatgtggccctctggggggtcgggacccagaggttgagaaccactgttgaagacagtgttgaatgagctgctctagaacagcagtagtctaatttcctgaaatagctgcttcttctgccatcagtggcagaaactataggctgccagttcaatcccaaggctcttctttatgagcagaaacttggtgtgggagttggggtgaagtgctcaggatttctggtccatagtagaattttctggaaggcacttacgaggggcttggcttatatggtcagggtctcttgatctttcctgcttcttggagtgtggatgtactggctggtgttgcttctgttattgtggacttttatcccactttgagtatagaagtgactagtatcttgggactacagtgattgagtggactgcttccagactttcatacattgagggagttcaaagtcttactctctgctgtgaatagtggttacaccagtaatacatccagatataccaacctctaccaatgttctactctgacattcgatctctatctattaataattctccattttctggaagtatacattaaggatacaaaaaactcatttgatgtgtggatgtctatatactgaatcttatataggcaaatggttcccagagaaacgctgtacacaattgcacaagtgacttagtgttttaggcgagtaatggccacaaaggcataaatgctaactggggttgtggctctttctgcatttgaaaatgttgaggaaaatctttgtccttgaagtggatttgaaaccactgcctgagaccaaatcttcaatgactctggaaaaatgttgcttgcttgttcacattagcatagtgttgaaaccagggagtttggaaacattcattttgtttttccttcctctaggcttcattaatctgtttactgtcctgtgtacaaatctggctaggtctatgttcaccttgggtaaaattacatacattctcactttgtttctttaagagttttcatgtgtcaggctgattagatgcagaataggttgcaagttatgttctgatcaaaacccctgagactcgaagccagtccaggaggagagagagatggtggaggaacaatgacaacattctcctcaggcttcctcaacactgcctggcggtcccacaggagctcagtgtgacaggatctgagtgcaagctctgtttgatgaagcctggattttcacttcaagtgtaagtcacaggagccctcaagtggcatgctaaacagacttctttctctcccatggtcaaaaatcttaaagaggctgatatgtaacattctgttgcaagaagaggtttataatggagcagtacccaaacccacccctgcctcagcctaattcttagagagaacagtttatcttcatagtctgcatagccgttttacccagaatcgcaatcaatatctagaaacaacttaaataaagtcactgtgggaataagtatttgccagttatgtcaaacatgaatactttgggtgcaaacctcagaagacctgaccatcaaccgattaaacaagcaatacaaatcgtgtgacagtaccctggagtcaggcagttgtggacactggtgaaacagctctatgatattagtgttctaaggtgttgtagatatgagcccatgtctctaccctattatatgaaaggaagagggacatggagtggtggctaatcagtttccagtgtcaacaaagtcagttgtacttcaaactgcagagttgaaactttccctaagcatgcaaaggtcactgagtgtttcctacattgttactgagtagcacaggctagatattcaaataagcatgttgagtgcaggatgaagaccaaggtgagacaagggaagtgcatggcacaagagttaaagagatagatactcattatctctcttcttagtggtagacaaatgtagggttgatttttgtggtcttgaaaatggagtgattccttacacattgtgctctagaccctatgtactccttagacattactccctgtccttgcattaggagtcctcagccaagttgaatgaatttaaaaaataataaaaataaaatgaagttatgaagtagatattttataatgatgattatgctggctagttttgtgtccagttaacacaatctagagtccatttagaagaaggaagctcagttgaaaaaatgaattcacttgattggcctatgagccaggccttggtgcattctcttgattgatggttgatactctgggcagtgccatcctcggctggtggtcctaggtgctatacgaaagtaggctgaccaagccataaagagcaagccaaagcaacactccttcatagcctctgcatcagtttctgtatccaggtttctgccctgtcttaatttctgccctgacttccctcagtgatgggctgtgctgtgggtgaaaagacaaattttcccccattgctttggccatggtgttttctcacagccatagagtccctgagacaatgataacttaagaaatctttttcaagtatgttccatcacaaacatgaagagtagtacttaattttcaccctggtattaatagaaagaataaagaaaacacttctgaagaatatagagttcatagcaccacactgaaagaacagggagagtctcaccagtcactaaactttagcacattgctcttggccgtctatcctctagaactctaggaaatgaatttatttctttgtaaattatccagtctgtggcattttattaggagggaggaaaggggaagaaagctgaagagaccagtagcaggtataaggatcgtatagaataggatttagaacaagcactgggcctagacagtcagaaggagagatgccatttgttaaacctgagaccccttgccagcagaggtaccgggtaagccacagagagcagtgctggagagctcaccttcacatgttggtatagatccaaagctgcaggttctccatcatgacacagggcaacaacagaatatctgagaggagtccaggtgaagatccagtatggctgaagtctggggcttaaaagaccaataagtcattgcaatgaacatttgcaagtaaagaagtatggacacaatagtatactgtgggacacactgtggcatactacataggagatgtcattattttcttcttgtggggtgattgtaagggcagagggcagatacaaagggttggggaggtgagtggaattgggatgtatcagcatcagcaggggtctgcattaatgtgtgggtcacattaatgaaaaactcatgaaaaatcaataaaatgttaaaacaaacaaaaaaaaagcaaaacaaacctgtactggaaatggatataaaggcaacaaaagtcgtggtcacattcctcagggtgaagtatgagtgaacagagctaggagaggatctggagagaaagccagcttgcttctccccgacctccccagaatcgcttaaaagcccttctgtcttaaccagtagccacctgctttgtagattgctttcctactctattctactcttacggggcaatgttttaaagctgcagaactattacagcaatactaggtcatttgtttttgaaatagtctaatgtgatggcatggatgcttaacaactacagaaatgcccaaaatggcacttacagggctgggctcatgagactgccacccagtggttttctggtagtacacattccctgtgtctcaggcactagggacaaaggaacatggcagaaactaaatgactgagcccatcactgtggtacacatccccaccagtcaggagagtagacatttccctccttgatgtatattccctagccctgcccctgcatgtcctttgctgggtcttctgttataagtctaccctctaccctctgcatcttcacagattgactcctttttctcaattttatttgagcagaccaacacttcttcagtttccttgacctctagttagggaaaccaagggcacgttttcatttttgagcacccaaaaagacaccttttttttttttggaattagtaataaactggacgtggaagaatttggtgttttgtgacatgtgggaaaatatactagagattgcacttcagtgactgtgtctactattgtgtttacaggttctttgctatgtagagagggagagaaggaggaagagatgccaaggaccagccttggcttggagaaggattctgaggaattggtgtctgggaactgcgaaacaatttgtgggtctaagctggtggcctgtgctctgctggagaaagctttccagcttgttctctctgttctactttctctggagatctctcgacagccctctaggttctgcttgagacagttctccaagcagttctttcttgctaatctaaaaattttctctgccaatagctcatctcttgcagaacagaagccagccttttattttacatatcaatccaggcatttactccaggttcacctttgattatcctatgaatcagcaccctctgaccccaggctctgttggagacagcgagcacatttttattttaaaacattgtaaaagaattcagagagctccctgcctttgtaaactttgctgggtgggaccttgtcctgaaattaccatttctaccacacctgtgcctaagttccctctgtcccaggctgaccttgaactcaagaattggcctgcatttgtatctgcctgactttgtatctttctgccaagccagttcatagtgttgctgcatctgttccttatacaatttatattgcatcctaacatttttgcataattgaaaaattatatatgtttcaaatactatatatattaagggctgtcctggaggtccgagcttttaccattttgctgagacattagacacaccttcatcttcaggacccctgctatctctaagtgccatgaagtcattaacattaactgggaggacattccttggaggaccctgaaaatatgtacaacatatacaaacaagccttatgctcttggcagtcacagacacttgtggaggcccaagtatattggccgtgtcccaggggcaggagccatgtcattctgtcttcacccaaggccatggggacccacagagggagggagaaggaaggaaggagggagggaggaaggagagaggagggagggaagaaggagggagggaggagggaagagggagggataattcagtttgcagccaccaggtagtactaagacaacccaatggagtggagaagtgcaggtggggccttattgaatcctttattccctacaggtaagcctaaacagaacctttaagaagaaaggaagaaaggaaggaagaaaggaaggaaggaaggaaggaaggaaggaaggaaggaaggaagattaatgcagaatagacttgataaacttgtgtgtgaagtttggagaaggaagactaataagaatcatgaactttaaataaaagaaaaaaatctgaggttataggaaaggacacatgtttgctttcttgagcaggaaaatagtaaagataaaaggaagacacatttgtctctgtctcttttatctatctatctatctatctatctatctatctatctatctattatccattcatctattcatttgtccatctatctttctgtatgtttaaaaaattccttatgacacatatcattcttttctcttttcacgtgatagtcaaaataaatttatctttattgtaaaaaaaaaaaaaaaagaaagaaagaaaagaaaacaagaaaaagacatgctctcagaagcagatccctgcaattgcaactttccacatctcatccgacaagaacgctggaaatcctggctgagaactctgtcaggggcagcagccaactgtacaaaagagcgatggagtgagcaagccagcttggccccagtgcaccagtctcctttgtggctggctactccactcagcctctgttccagatctcccagtcactgccttctgctgctctgtggatatccccttcacttgccattgtgtgtgtagctgggcgagggtagggagaggtagaggcaatcaacagctttgtaaccctagtcttcccttcccctcaaactcccagttcagtcacttgccattttaaatgaattcatcactgtccaaagggtccagctgtcatattggatgcaccaggctccacttggtcgcacaccttatcttctgtaccttctcttcaattcacccacagggttctctacatcactgttctttcctttttgtaagcactgtagtccaccttcatcccttagtctcatcctaagctcctttgaattggaagtcagttacctggctggttttatactttccccatctctccttccaacacttcctttcagtctccaccagccttccatggtttggttcagcagttcagaccacttgctgcccttccagaagaccctaggtcagatctcaacactcatgtcaggcagctcaaacctacccacaaccagattcagagcgtccagctctctcctgtcctccttgtgtacccttacacatgtgacatacatgtccatggacacatacaaagggaatgaaaataaagattggtccacttatgttatttactcttctgctttgtccaaagcatgtggtacagcaatcgtctaaaatatatggtgctctgccttgtcagagtctcatagctctagccttgataacttttaccttctattatgagtaaaatgtaggcattgtgacacctcagaaagtccgtgtgctgggctgtgatatctgcgtccttggatagctcggtcatggaactagagggggattccaggccatctgtgtcctccgttgccccacacctagcaaactggttagaggtaatgaatctctcagacatccatagaagacatggacagaactgtgcctctgatgagagaactgtacatatgctgagccaacacatggtggtgctgtggtcacatgcgtcagaaaggactcctttgtaggccaagtccaacctgacatatgttgtgctcaaagggtcttttggattcagaaacactttagtgtggggtgtgatgtcagtgacatcatgatattgtatccagaggctgcatgtgccattgaaacctcagatctcttgagtgtgtatttctttatcagaaataggactctatcctgcctttctttcaaaccccaggtcctgaaaactttttttgtcctgttctgctttaatattaggcctcagaattcaaattaagagcgtggttctttcaggtacccctctttcctcctggcctgagatggtacattgaaaagaggacataacgtagtaaatattggttgtttgtcgatgagttgagggaccaaattatggagaaggatggttaatatgggcatttcaaacaccatgcttggctataatttcccccctgaatttatcaagtcatattcagagatatcagcttacatcatccctggtagaattggcctcagaaggcagaagtaggcagagtcccaattcccagtatctgctcttcccaaactctgtttttattttgcataagaaagtgccagaaaaattcacttacatgctgatacacatggtggaagagaaagagttctgctaagactcaaaagtccaatgtctgctgtttgaggccacttgcaggaaagttattttaccaatctatactttggttcctgttcctaatgtgcacccacctttcatgcatcaatagcacttttgagtaggatctctgagataaaaattaaagttaaaggaagtctacaggtgggatctccatattgactatagtatggcttgacaaaagagcaaagggtcctggagctagcatgctcctgctgtggtatgtgatgcctgctgtgtccctcatcagatgctgaggagatcctggtgctgtgtgttctctggtccatattgtcataagcagtgaatagtggagactttggggggtaagctcatattcaccatgaataggtttaaaggactcctttgtaggccaagtccaacctgacatatgttgtgctcaaagggtcttttggattcagaaacactttagtgtggggtgtgatgtcagtgacatcatgatattgtcagaaatcaggtctctaggattttggtcttgggctttttccactgaagtaagagctgtgcgaactaagtctggactgcccaggttaccttcttctatatctgaatatttattacacaaacaaaaacaaatggagaaaggtgtgagtgtgtgtgtgtgtgtgtgtgtgtgtgtgtgtgtgtgtgagagagagagagagagagagagagagagagagagagatggagacagagacagagacagagagggggagagaattggtttatcaattttcttataaaccttgttaggtattgaggctattaacctcctaaagggaatatatgagttactgctaagcatcagtagcattcatattgagaaacacaatgaaaacaaaagcaacagaggttagcatttaatccaagttggagaattttaaatgttgagtcaaaggcatatggagcattataaataaaaataatatagagcacacacaatttgttcaaacaagtgaatgctgagaaatttactattaaataatggttcaggcgggcagtggtggcgcacacctttaatcccagcacttgggaggcagaggcagacggatttctgagttcgaggccagcctgttctacaaagtgagttccaggacagccagggctacacagagaaaccctgtctcaaaaaaaaaaaaaaaaagtttcaggataaatggcttctggcacttccatgtgtacccaccttctgatttgtttcaacttagcatccttagcagcttctgaactctttcttatgtccctttacctgacacctttcccttctctataaggacctgtttgtatggtgggaaggaaggctttggaagaatcaaagcatattgggaaatggctgtgtgcttacttattgtccacagtgaaggaagtgggtgtctttgtaacttgataaattgcaaatataccaggagcacaattgggatagtcaaaaatgccaaattctgggaaggttgagactggaccctggaggggagtgaacagaaagctgtaagtttccttttgtcaactgcccagccagaggtaggcagtagggtgtaaactccattaacatgctgtggattctcccaccagatggcagggacagcgcgccatgaccgggagatggcaatccaatccaagaaaaagctctccacagctactgatcctattgaaagacttcggttgcagtgcctggccagaggttctgcaggcatcaaaggacttggcaggtaagatggtgtcttgttatttatttctattgcaataacaaaacatgaccaaggcaacttatgcaagaaaacatttagtttgggactcatggttctagaggcttagagtcaatgatcaccatggcaaggaacatggcagcaggcaagcaggcatggcactcgggtagtagctgagaatttgcacattgatccacaaacagaaaagagggaaggagagagagaggggagggagggagggagggagagagagagagagagagagagagagagagagagaactggttgggtatgtccaccaactggggaccaaagattcaaaggtttgtgtttaagggagccattctctttcaaaaacccacagttggaggtgcaaggaaaggaagtggaaagaaatggctgggaaactcttgcactgatgttgtgctattggccaaatcatttccttgtaaggcccctggttctcatctatgaaatgcattgtttgagaaagccaatatccgagtcctcatgaaatgtctgatgcttaaccccaaattcgcaaagcatgtgtcttttgcaagggaggatgctcctggagcaatgtggggtaaggaaaccaccagttagagtgagtgcctggaaggacatggagaaaggccctcccctgagctgcagcagaggaaggaggtggatcagtgattaaagaatttgggaagcaggcatggtggcttcccagcacttgggaggcggaggtttgatcaacagcagtccagcgtctttttctggctatataatgagttaagcccagcagtctcggctacatgagatcgcctctaagagtttgctcccagctaggctgtcttgtcttacttgtttctgtaactgctcatgggataacttgagtgttcattcctggtagcattctgtgggccaggtgattcttcctatattctctgatatttgatagtgggaatagacgtgaggactgaaaatcccaaggagaaaggacactgtgagcctcctaaggatggatcttgtgtgcatttaacaaattatattgaatatccaacataagcacagccttggacatcatgggtggacaagcttctgtaggctgcacagggggacagaccaagagagtaaacatcttctagatgtgcctttcagtggtccaagtggtggggaactttgctattaaggtctcacccccccatgactgggcggctttcagagctcattgcaaaatgggagattcctcttctcagaggggcttccctgtctttgcctatctgtgtgtccctgaatacaggtggttggccttgactggctttgtataaaaagtgaccttatcagagctccctgaaaggctgcataactcagcacacatggctcccctggctaccttcctacatgataattaggtgctgaactataaccaatcagcccttcctgctcctttgatgacaggaacaattagctccttccactcatctccctaagaaagcccttatataccctatacattcctaaacaataaagtagacccctgtcaccacagcagtctgcagacgtcattctatctatactcaaggctgccggaaccctgatttccctgccccctttctcacttcagcggtggtggtggtggtctttcctcactagctgcctcagtgttctgggctccaggatgaaagacatacatatgcagctttatattttaatatgccttaaatagctcaatggttggcctactccacaatctccaagtggctaacaccctctccactccaatattcttgaatttttacttactaaaacttatattccatcttggctgccctggacccaggcctgcagcccccctgcaacaggatccccaactcttacatgttggcagtctctctgtcctacacttctcaggtctggcttttctcatttcccagcatggtaggaaatcctccttcctctcagtccccttgtccaggaatccttaagtcccacttctgtctccctgcccaagcactggccaccaacaactttatttaccaataagaactgactgggcgtagggaccctcagcatcttacatgcggatccttgtaaaattttgagaacctaattaacataatacaaatgttagaccaaatccacaacatttatcacttatatcagtctgcttcttatagaaggaaaatttattcattaactcacctagttgaagaatattagtagaatcattgctgcctagtaaacttgttacactgtaaaacagatgggcactgccaccatatagcccatgtctgtatggtgtgcttatccaatattcaaagtgttctttctgagttgtttttttttctttttctttttaaatatatggaattcaaaggaagaagaagctaaaaagttacttattttcttgttttgcattgccattcagtgtagaaggtctcattatggcattttatatacatgtatcatcattttcctactccttgctggtctcctttcttcccactgtcaggcatcagctttttaagtcattggcatctgaatccctcatggcagaactagtaaagagaaaattgcaagttgtaacttagaaattgcagattacttcagctttaactagaaaggaaggatcatcagtgtagacttttatagaaaagtgagaccccgagtgataataagttacactcaagttacacagttgctgctactgcagaactacaggacgagctcatctcttagaaatcctaaaggataattctgtcttttaagagtgaaaaacataattcttggggcttttgtatagggagtggggtcccgtggggaagaagggaaagggtgggaaagagtgagataataacagtgggctatgaaattcgtagaaagaccttatgcaccacaagagcaatgagaagatatatcatttcttccataaaggtagtaagtaccttgtgtttggaacggttaagttccttggctataatctatgtgtttctaagcagaggcttcctgtagacaaagtagcatccatacagtttatgtgttcagtgcacatttggtggagaaattagaaactttattaatctcaatattagattctagagcttttactaagattactatggtaaactatgattcaattgcttgtctgcattttttttaaggggggcattttttaaagtagaagacaagggaactaagggattattagcaaacatgaatttctgaaaggttccctctgttagtagctattcattattatatcaaggtaataagcctacgaggaggaaaattcgttttggttgacggtttctgaggcttcactctaggctcacggaacttaattgctttgggcctgtgacaaggcagtgcctcggcccacgaaacgggcagtaggggtaaatatcccttgcaaaggcgtgactgcagtcatctgacctccttccacgaggcctctgcaggcatcactaactcccagctgcacacggcacccgacagctaagccttcacacctagatcttaaagagacagaaagatccaaacttttgtccgtgccacgtacttagaatacaacagtgcaattgtagccttgtctgtgcgtttgcatgtccacgcatgcgtgtgtttgaaggtttgttttcccgtgtgaaataccaaggaaagcctctgtgcttggtagtgaggccgaggaggtaaacctagggcttctgtattgtactttaaagacaaagaggagtgtttcgctctttttatcttcgcacttacacattgtttttgtgtttttatcaatttgggtttgtttgtttgctattatttttgtttcatattgttatcttcagagtgtttcgaattatggatgacaataacaaccgaacccttgatttcaaagaatttttgaaaggcttaaatgattacgctgtggtcatggaaaaagaggaggcagaagaacttttccagagattcgatagagacggcagtggaacaatagacttcaatgagtttcttctcacgttaagggtaagtgtgagccccggtgaggattcggtattgacagcgtggcagaatgaaccagaccaatcagcgtagcagaatgaaccagaccaatcagcgtagcagaatgaaccagaccaatcagcgtagcagaatgaaccagaccaatcagcgtagcagaatgaaccagaccaatcagcgtagcagaatgaaccagaccaatcactcattgccctggacatgtgtaagtgaaggatatttggacaaaagggtctaccgtgtgtcacacagtagcttccacgacaagattgttgtcgttgtttatttatttactcacttgcttgtttatgatttctggtttcttttgatgggggaggttgcaaggacagaggggaggtgtgaagggacagggagctgagtgggattggagtgcatgatgtgaaataaagaaagaatcaataagaagttaagaaaaaaagagtaaaaatggtctccaaccgtactcccagggaatcaatgttttctgttgaggagcttggctttctcgtgctttgggttagctacttcaaggatttgttttcagagcttgctagtacatttcagggggtgtgggcagaaggctgtggagtagctgagggactttctgaaacatctcacttagtggtaagctggcaatttcacatcagtgaggcgaataagtgatcatcatatctgctacagaagaggctcatttgcacatgcatttctccatgggtttttgtttttgtttttaaatttatctagcctccaatgtccagagccagaaaagaggtaatcatgaaagcttttagaaagttagacaaaactggagatggggttataaccattgaagaccttcgtgaagtttataacgctaaacatcatccaaagtatcaaaatggggaatggacggaggaacaagtcttcaggaaatttctggataactttgactcaccctatgataaagatggattggtaagtgaaagagatgaatccaaatgtagtttatttacccaaattagaattgtaagtaagaaataggttcagagccttacaaagctcaacatgttgacaccataactgttacaaacagaagaaaacatgtctttggggccacatgaactgttgaaagctaaagtgataaaatattcatttcaacgtgtaatgagacaggcgtctctttcttggtaggggaatctgtgagctactaattactcaccatggaaaatgtcttgttttgaacatcagcccatctcatcattgctggattccccacgtacagcttagctatattctcgtgaagtagattacaataaaagcatgcttgattttaaatgggggcctttcaggaggtttggctcctattctcttgcccttgggagcattgtttgccttcacacttgcctgtgtgaaaagaggctgttggtaaagggaatcccagagagcagattttaccctgactcactctttagtcagttttgagattagcttgcacatctaaattacagtgaacttcaggacaaaagcaactccatcttcattggccattaccttcaagtatacaacatatatgggagagatgcaataaggtgcataagccacctgtttgaccacttggaggcagtttttgtcttagatgacctgagattcatagggttgagggaggggaggtcctcagcctcagcagcagcggcagcaacaacagcagcaagagcagaacctttgaacctccagaccgtagcagaaaaggtaaccgagacagtgactagggatagtgcttatggcaagaagcctccgccctctgtagggagtttccccctccctttcccagaaagcctgctgacttgtcttcgtatcactgggtgggaggtaagaaggggaagtgccctcctgctgacattttgcagacagacatggagcagtagctgaagtgtcttgtaggttgaggaattgtgcgccagatacaagagagtcccagcttctgttgggcagccaaattatctcggacaggaataacagaacggcatgtttcctctagtactgctgtctttgatctccaagatgtcaagtgaaaaataaccaactgccatttcccctaatagctcagctctacatggcccctgctgtctctggttccttctgcaggtggttcctctttgtcacaagggaaatgtcagctgcccttgtctctaacaagctcaagtagccatttgtgattcaactgatttaacgtccccatttcatccccttctgacatttatcttaatctgccatggtgatctctcaaattctcaaagggttattgaggtttttttttttttgtagttacaatatttgatgttgcttgagtatcataaacctggtaatgtagaatattaactgtttcttatcagtgtgtgagtgtgtgtgtgtgttgaaatggagattactggctatactgaagaaccacagaacatgacatttgggaagatgtacccaaagtctttgcatactttctgtatgtccatatttaatgtatgctcacacacacccatatttgagattcttacatataaatcatataaaaaacttatttttattactaaacataatatatatacagctttatttaatataacaataaatctgaacaatatttattgggcacttatcaactagctatttgctaaggctctacagataccttatttaatagatataataaatatgttcatctgagtgattcaaacttttgtgggttctgggaattgaacccaggtgctctaaaagaacagtcagtcctcttactgctgagccatctctccagcccccaaacttttatagttttaataacatcctaaaaacccaaagatattgtagataaaataaaaacaccttatgatgaacactttcacacagggaacaattcccatgtgtacgttgtttatctgtatttacagaatcattaccacagatcctctattcactgaattcagggtcattcttcctaaagtctttcactggtctcgaggaaagaggtttggggaagattgtagatttgtttagcttattgctttttgttttggtttgtttaattttcccgtttgtcagtgagccccaacatgtatatgaaagagacactaatgtttccaaagattagtgtgacagattaagctattatggactagaaataatttctcagttatttatcaagtttctttcttgtgatgattttatcttttgacttagatgttgccaactcctattaacttatgagattcccctatcccccacccccaaaattctatgaatcctgacatagataaacatatctgctgatattccaggccatcaatcaaatgcagtgcacagtggagaagccgggagggctgggaagagagctgcagaaggtcgtggttctgcttactctcagccttgaatgaggaattcgtaccgagaaactcacacaaactgcatgccttgtactagaaatcactttctttacccataggacagagcatttgttgaaagacaagacatcgcttatcctgatattgtatatagcctgcttctgacatgtaccagaaagacagtattaacgatagctgaaggacacatatttcctattctgggcctagtctcttgtttctgaactaacaagccccagttcttaaagaaaagatgtcaccccatgacactctccctctctccacttaggatggcttggatattttcaaggtcacctctcctcctgccctgaaccactcttaccatgatgtttaacttggtttcatctttacttttcttttaggtttgttcctcacacacctgtaatcacacaggaataaacccttcatgggattgcccctttctctttacagggttggaagaatggcgtccattaaaacaagaacaaagtgttctttctctttctgacttttccactacaggtgacccccgaggaattcatgaactactatgcaggtgtaagtgcatccattgacacagatgtgtacttcatcatcatgatgacgacggcttggaagctctaaagacctgtccctggaaaccaggccatgcatgcagtcacgtgactccaagtgattacgctctacccccaaactcagaatgctcttcaattcactgttcatcaaacagactcttctttgccaacacactgtattttctaggctgacaagagggcagaaataaagtcactaagtaattaactatgagcttgcctcctttgaagctgcttccttatctctaaaatgagaattatgaaatttatatctctgaatttcctaacactgtggctgattcacacaggtgattaattaacttggcttgtctcccttggtcatcaatgatctcatgtttgcccagaaaaccaggatattttcacctttaagccaggtatgaggctacctctatttatatagtaaaatcttaagggttttagtctcaatttgggtatcagaaagaaacaatatactagattcataatttctccaagtcaatctggagatttactccttgttttgacaaatagattgaacttgaccattgatttgcttgttccctttgtcttttaaaagatgaatgtgagagtggaggccatttctttgaatggtagaccagtgacttttcaatgcttccttgtggttggagttctgagcctgggctgaattctattttatgtggaacagcttcactgtgataactagcaaactttcctttcatgcaatgtttccttttgttgtctgttgttagccaacattgttgacaattctatccacccaaagaggatgggtgtggcacagactaaaatcaagaacatgccaaagcagagtttccatcttgccagttcatgactcctcgttctagcactcagcccttctcacatattattgacatgagaataccgacccacaaggggctaatgtatacatacaggaagccccagaaatgagagaaacagagcctgaagctacagttcctactcttcatgactgtgcttggagacacagacaacacagtgagcagcctctggttgtggtactgggaggaattctagttgcttttgttgtttggaagtcccctgtacagatcccatatctggctgcccctaggcattggcttatggacatagctttagttaatggtgtcttcaccattatgactttaagaagctccataaagtggatctccagaggctttgtttgaatttcaccctacctccatttcttaagtctcatcttacacgcttctctaagttgatattatgaatgatattgatttcaaacctgtgttgcaagttgagaattgtatcagttctgtttgtttgtttgtttgtttgtttttgatcgctacaactcacagcagggtctttattctattcaagttagtggtagaggagcctcaaatatcaatcggggtaaggctgtatagtaagcagcaagtgagaataagtgtgcaagaatccaattggaaaactactgtgacctttaacataactggttaatgctggaagtcagattataaacttagtttctgctcccatctgcattggtggtcgttaggcagggggtggccttgtaacctgggggtacaggtttgttgggggagtaacctggagacattggtcttgttgggaattagcctagagactggagctaggcttgggttttgttggggccaacttggaaactaatggtaggtaccagcctgttagttttttttttccattttttattaggtatttagctcatttacatttccaaagctataccaaaagtcccccatacccacccacccccactcccctacccgcccactccccctttttggccctccagcctgttagttgacctgagttcaaacttaggtcaggttctctaaaatggagcctgaacttacaagatttggcctctcagaagaaaatagtgaggctacatatcagacatttactgaaacaggtacatttttggactctatggcacaattaagactatcaaaagaaaactaggtggctctctcgaatcttgctgttactgcctggacaaacctaagctttgacagacatccaacaggggagagaagagccttatgctgatgctaacattgtggattgtctcatgaatgcagtcacaaaaataattcgtcatgaagaggtggcaggtatgttgttgagaaaattatcttacaaaaatgctaatcaaacatgaggagacctgcttaggcctgtaaggcattctggaaaaattacagatttttgtcagcctctgtgttgattttataccctttctggcccaagggcttgcaatagctgcagctttccagagacttttccatttcagaatggagggctggggataaggatccaagttttaacctttgtcttaattgtagacatctcagacatataagctatgagggccttcatgggtttatcctatctctgattcattctgtgaaattattctctgatttgtgatttttttactgaccctcaattagatatcactttcaaacgtggttgcttccttctacaaactaactttgctttcattgtttaggattaaaggtgtgtactaaggacacgtctgtattcttaccagaggggttaaaggtgtgtcattccatctatatcatatagacctcgaaggtcactggatatgatcccttgccagagcagctatgttgctggattaaaattcctctgctttctatttaagtcagaaggcgtacatctttactattacaatagaaacaattatcagttccttaaactaaatattgtgaatgtccttatgaagatctgttgatgcaaggatccttcttaacagaaatcctgtttatctctcatttagctaatgcccatttcattatcaaggttttccaatctgccagtatgatgatcaatctgtctattttcagtcagttttttgagctgtctgcaggcaggggtagaggaagatttctgcatcatctctgcttcagttcctttgtatatcttcatatatatatatatatatcctgtcctctgacttgtctgtcagttgtcctttgtgttggtgtggtttcttctttcacaatcatgttgggcaccagatgtaaaagtgactgctattcacaaaatctgattgtcatctcagtggcttggtactgaataagctcatttttttcaagttctttctgaacttgactggctggtacaactcagctgtgggtcaaattacactccaagctgactggttcaaactggcttctcactacattgctctgctttgaaaactgcttctgatttccatgaaatgagcttctgttttgtgaaatataaaaatcagaccagcatgtttctgcactagagctggcaactctcagcccccagcggcctggccggattggcaggcaatggctgacctgtttttattttgtggagattctgcctctgaactccacaatctctccacccagctctctgggttcccactggggagtcattgccatgccaaccctgtgcttcaagtgcctcccacccccaccccacagcctttgtggggcacctcaggcaaacccatgcttggcttccgtacctttctctcttgaacccagaggagctgccctctgctgtcccattccaaaaaaagctatatcagttctttactagtgtgtcttgctttgtttcttgttagggaagctcaacttacttatcttgatactgactggaaaagaggcctttatcttgagattgggcatggatatcttcatgttataggaagtgggcctctcccctcccccccactccattccttacacaagccatattttccattgactttactaactaccctttttagagaatggcagagcaaccaataccaaacataacaagaacatatttataagtcatataggaaacacaactatgcaggaaggtatcatttttaaagcatgtgccctgcaaactgtggctcagaagtctcctgtgtcctaggcatggtggacatagcctactgctctagatagatttgtgtctttgattctgggtatgactcatagcttgcttaatgggggctaccgagtgagcatgtgattctgagcagtgcctgggttgtggctatcagcgctgtctcttccaatgatgctttgcttcctgtcttatgggggttcagggcacaatggtccaactttcgataacccttgtctcacggtgcacactcagctgcctccctttcagaggtttaggttctggactcaggaacaagattccaccaaggccttctctcaccttagaaaaacaaggtctcttaagaacctgatgtccaaggaacactgcacacacacacacacacacacacacacacacacacacacacacacacttctagtctcatctatgatttcttagacacacagtcaaggatgacttattaattcactcctagtagctatggaaggaagagagaagatacatttaaagatattatctaacaacttaataaacatgcttccaatttatttaacatgtagattttaaacagaattccacctgtaaaatgagaagtacttgggtcaggaggcagaaaataacacaaacccctaaacatttctagggaagacttttctactggacatggatccagtacaggagagaagagagggtggaattagcagcctttttaatgaaataaaaccaatgcatgcagacatttccaagttagaatcttctgtccaagccaatgcttctaatgctgaacctggaaagtgtctttcagaacacagccttgtgtaagaagggcaaaagacttagttactatcaagagctgcattccactggcatagccgctcaggagacagctatatcaggctcccgtcagcaagttcttgttggcatccacagtagtgtctgattttggtggttgtttatggaatggatctccaggtggggcagtctctgaatggtcattccttcagtctctgctccacactttgtctctgtaactccttccatgggtattttgttccccattctaagaaggaacgaagtatccacactatggtcttccttcttcttgagtttcatgtgctttgtgaattgtatcttgggtattccgagcatctgggctactttctacttatcagtgagtgcatatcatgtgtgttcttttgtgattgatttacctctctcaggatgatgccctccagatccacccacagtctcagtgcaaaggagaaacaaaatgtgttgaattaggtatagactgaggcagaatccctcctcagtctgaaggactagtttcttaccactctcttgttcttgctaggatcttccccaccccccccctgcatagcagttcatttactctgcgtggtttatatgcacgaacatagttacaattcagacacacaccactctgcaggaaggcgtggcagccctccatctcacctgccaactgactcagcatgtaatgtaatgactcaaggtggcttgcaggtaaaaatatcttgataattatttactgaccctcatgctcttctctggagtgggcatggggcagtgaatttgatgctaccagtggcttgtaaaccaaattgacatccaacagttaatagatcagagactgcggggaaggaggacaacctagcactgaaattctcctttccaactctcacatagcctttcaggtagacagctggagcccatcatatggcactgtgtgagggaattacaaattttgacagcctgcccagacaatgcaagcatattgcactgcatatcctattcatggggttagataatggatatattccttcagctgccttggccattgtagattggaccatacaagcaggaagtggtccccaccttcatgaatctacctacagttagactgttatgttgatatttaatcaaggagttagctagtgtgtgggtactctgcttcttctgcttgataaaattgtattagcatcctgtgactcacatatattctaggtttatgcaaatctattttgagcacagaatacaaaatatatagcttccaactttccaaattgtccaacaagcttattttcttagaaactattattattttaattaaaatatctattagatgaagtaaaaaaagtttagtcataggaatgctttgactcaaagggaaaacaaagattttggagggggcttttaaaatcaagagcttctcaaatataggaacaaggttttaaatgttagaaatgccatggctcaaagtacaaacaaaagctttaaggatctgctgtataatagattagtttgacagatcattttctcagcatgatttaacttctccaagttgcttagatgaaaattgtgtactcaggttagagctagccaagttcttttgttctaacaacaacaaaaaaaatccctcaccaagttaatgcctcaaattgtttcttctaaactagatgacgggtggaatctgttgaaagatatataagcaaatgattgatggtgcttctgagaacattgctgtgagaagacattctctctggtgtctgggttggtgcggtgagaggctgtggtgaagcagcccttcctctctgagaatacagcggccttcttgtttaattctcacacctgctttgccaaagccagtttttttcttcccctcagaaaaatgtaatggaagtaaaactcactgagaatgtaaaccacccacaggcagctgagtttctgatatggatctcacatgtagcaaaaggtaaagtacatcacaggaaaaaaatcctcaaaaggtcatcgttttctttctttcttttcttttctttttttctttcttttcttgttttcttttttttttaatcactcgtattggattcttctcctgattcttcagaacagaatttactgaccttttcacttggcactcagacactggtattgatctcatagcatctttctctggtgctctaagataccagaggctggtatcttagaaacgcacaggctgtgtgcagaactcatgataagtctgagggagactcagaacaggaagggaacctcacatggaaagaagatgatggatggcagagtggcttgttccttccagggctcacttgggtcttggctcttctacactgatgagatgaagtacatcacaaatatggggtattatctaatgccattcactgccttactaagcccaggacattcccttcgtttccaagggaacagagaaggaaagtaccattccacaggtttcctacttactcatgcctcaaaagtcatttagcagtatcattcaaaatacatttacttaagagtgtcattgaagctacaacatgcatgcagtaaatcatgggaacttgagcttaactaatcagttacttagaaagtgtttgagttgaaattcacacttatttcttataaattaaaacccaaaacaaatgttaaataaatcagtaatataacaatacttagaagggctgtgtctttctatagccatatgtttatgggagatatttatttgtatgtaaatataatctgtatactagtggcaaaaatattgcatatagctttaaaacagtgccaagccaatagtgacttgtcattttatcacagaactgtcgctcaagctattttctccacagtgagatgttctcatatgtaaatattatcttgacagcaaacagttaagtagacatcaaataaacactggttttgaagcagcattctgtttgataaataagaatattgatggtatttatactatacatgctaaatattttatttaaaataaggtgtgtttctagtggtaagctctatgtatatgaggtatctacttgttataatgaaaaaaaaaaaaaaccaactggggcatcctctcgagtaaccagaaattaagatttctgtgagctatcagtttagacatttataaaagcacgtcatttggtactttctgagagattttgctttaagaagttctgacttagcagatttttttttttaattaaaggtctgaaacagcaactgcttcaatagaacagaacatctaactctgccagtaaatgacttgcaaagtgtgctttctctcaccagctaacatgtcacttgcatcctgaggctctctggctgtgcttttgtttgttgataaaaatgtaatactttattataatgtaggatactttaccttaatgaactgtatagcagtgaacaggaatgtatattgtttaggactgggcaagtgtttattttggtgcataccttaatctagctttgtggtgtttttattggtgaccctattacagcaacgtgattgtgcttcagagatatttataaatatcattggtgtgatgcttctgttacaggtgataacatttaacttggaaagtggtgagtctttttaaaatgcatgacacagttactcataaaattaccattttaacagccaaggataagatattatgacacaatttgctattattattgctttctattctttccacagggtcagactatgttcacctaggaggcttaccaacttcatctcattttcagctttgagttgcacttctacaaccaagaaggatagaataactctattactagtacaaggaggcnnnnnnnnnnnnnnnnnnnnctccctttcctgtaaaatgccccttcctcaagttctatctctacatctgtttgacctcatttatgcgataaaatctttatcctaaggcttaatcatatcattttatccatagagtatttattccaggacttaccctaagtaacaaaattcttaaatcctcaagtcctttatatgaaatgacatcatttttttgctcataagttccactcatcttgtacatatacagtatggacacaatgctacttactttaaattcttccaataaaagttaaatgagtccctgaggacagaacctgtgagcacagaggattgactgtattcatcatgatcacaagtaggcagcatatattctagagcaggattacctcattggacttgcgtagtgacagaactgatctgatctgtgtttcccagcatatcaattgctggctacatggagctggtgaacagagggagtatggtcagtgccccaagacatgcggtgtttgattagacttcatcttaattagtgtaaattcaaatccccgtatgtggtcaatggctaccttattgtgtgacttggagagatctagagatcaatagtgatgccctgaggaagaagtttatacaactgagatgcaggtgagtctttggctgcccactgtaaatgtccaaactcagaaaacagtttcagaaaagaaatacagggcaaattcttgctgacttaggcaatgctgcttgactatttgttgcaaatcatacatatatctagtgtcttgggagaaattaagtgtgtggctcacagattttgacactgttttttctacccttaccttcttcctccttcaggtttcagaggaagactttctgaattactatgcaggtgtcagcgcttcaattgacacagatgcttattttattttgatgatgacaaattcttggagattatgattttgtttaatatcctcttggaggaaatcgagagctctcagaaggcagaatgcatttgcaagaatctgatactatggattttaataagatgcaaactaactctaaacaaagaaccccaggcaactaatgaccactaagagaactattttttccagcaatgagagctctgattggctatccaataaaaagcagtcatccatgaaatcatatacttttagaacacaaaagtgtgctttgcaggttatattcatgtatttgtgcatctatctaatatctatctatctatctgtctatctgtctatctatctatctatctatctatctatctatctatctatctatctatctatcatctatctatatgtatcaactatctattacaataataaagaagaaaagtctatatgttttagaggagttagagggaggtgatatggaagaggttggagggaggaaagaagagatgagaagtgatgtattttaccttaaatacattttaaaagataaaagtaaaatgtttttaaaaatctggtgttttaattgtaatagatcttgagtaatcttaataagaatttgaatgtattcatctccatgaatgcccgagaaaatagttttaagtcaacatgaaaggaaggaacaaacaaaagaagggaatcatgaactgagattacgaagtggtt

SEQ ID NO: 1856 - DNA, 1069 bp, Mus musculus
atgactttgcttcagcgttcccaggctatccaattagaactgaaagccttgaaaggccaggacagcaaaggaagacagatggcagggacagcgcgccatgaccgggagatggcaatccaatccaagaaaaagctctccacagctactgatcctattgaaagacttcggttgcagtgcctggccagaggttctgcaggcatcaaaggacttggcagagtgtttcgaattatggatgacaataacaaccgaacccttgatttcaaagaatttttgaaaggcttaaatgattacgctgtggtcatggaaaaagaggaggcagaagaacttttccagagattcgatagagacggcagtggaacaatagacttcaatgagtttcttctcacgttaaggcgtggcagaatgaaccagaccaatcagcgtagcagaatgaaccagaccaatcagcgtagcagaatgaaccagaccaatcagcgtagcagaatgaaccagaccaatcagcgtagcagaatgaaccagaccaatcagcgtagcagaatgaaccagaccaatcactcattgccctggacatgtcctccaatgtccagagccagaaaagaggtaatcatgaaagcttttagaaagttagacaaaactggagatggggttataaccattgaagaccttcgtgaagtttataacgctaaacatcatccaaagtatcaaaatggggaatggacggaggaacaagtcttcaggaaatttctggataactttgactcaccctatgataaagatggattggtgacccccgaggaattcatgaactactatgcaggtgtaagtgcatccattgacacagatgtgtacttcatcatcatgatgacgacggcttggaagctctaaagacctgtccctggaaaccaggccatgcatgcagtcacgtgactccaagtgattacgctctacccccaaactcagaatgctcttcaattcactgttcatcaaacagactcttctttgccaacacactgtattttctaggctgacaagagggcagaaataaagtcactaagtaattaactatgag

SEQ ID NO: 1857 - protein, 294 aa, Mus musculus
MTLLQRSQAIQLELKALKGQDSKGRQMAGTARHDREMAIQSKKKLSTATDPIERLRLQCLARGSAGIKGLGRVFRIMDDNNNRTLDFKEFLKGLNDYAVVMEKEEAEELFQRFDRDGSGTIDFNEFLLTLRRGRMNQTNQRSRMNQTNQRSRMNQTNQRSRMNQTNQRSRMNQTNQRSRMNQTNHSLPWTCPPMSRARKEVIMKAFRKLDKTGDGVITIEDLREVYNAKHHPKYQNGEWTEEQVFRKFLDNFDSPYDKDGLVTPEEFMNYYAGVSASIDTDVYFIIMMTTAWKL

SEQ ID NO: 1858 - DNA, 54493 bp, Homo sapiens
gtgtgagaatggactactacgttggccaactttctttatactttcagtgcccccactcattttccattccttgtcacccaaagaattttgaagcaaattccagatatcatagcatttcatcggtaaatattttagaatgtatctctgagagtctctctttttccataccacagtaacattataacacatccttaaatcaacagtaacctcttaatatcaaatactcattgttcagaactctctgacagggatatgagatttttaagagttcagttgaatcaccctgataccccacccttcatgtgtccttccatgttatttatcactaacacaccacatatttgatttatttattttgttatcatttgactcccccacaaggatgtaagttctgggaggcaggtgttttgtctttgttgttcaatgcactccgtgcagcaactaaacagtgcctcacagatgattacctattagtatgcttgttgagttaaagaataagtttaggatgagaaaacaaattctctgtttgctaatgcattattggaggtccaaaaatactaaatgggctggagccttgtgatgcctggtaaagacctacccctgccctctgcaccagctcctcagtgaccaatggacatggttgtgttgcagaaatgtctaaggatgcaatactttaaattcagattttttttttttaaaaaaaggcttatagacagaagatatgtaatagtgcaaagcagaattcaagggcccactttatcgtgtaggcattgaaggactttctctgtcattttgttgtttgtttgttttttagatacaggatctcaatatgttgcttaggctggcctcaaactcctgggctccagccatcctcatgcttcagcttcctgagtagctgggatgacaggtgcatgctatggtgcctggctctgcctgtttgagaattgcactgaaatcctttattaaaggcagcattatattgaggatggggaatgcaaagatgatatttgggagtagtgtgcccaccccttgccagggctgacatttcaagggggtaaaattgtaggctgtcttcaaattgtccctgagaagactgtggaaaaagcaccaattctattttatacttattcaggattataatgtaaactttagagacttatgctttcaatgaagaaatgaaaatacaagggggcttaacccgtttggacactagaatcattttatggatatgatatcttctaaggaggctgcctgagtaataatcgtaggccatttcccctttgtagatcattatcttttggggattggcttccagagttcttgagcttgcgacactagctagaaattttatgcaggtatccggggaaatgaagcatagggatgtcagtataaggttacgaaagttgtcagaatcaaaatggagttacctgtgttaaaaccctgatcagtggagccagggaaggcggtgaagggaggttctcacacagtatccctaataacaagaactattacgtaagactgtaaaaactacaaccttggttaggccactgcacccttacacaaaagaatacttctgtgaggatatctgtccagcaactgcctatcctaccttggactgatgtcacccttgttattgatccttctagccaaggataattgtctaaaaatgacctgtgtaaccctcttcatttttcatttaaaaagccttattgtcttcctttatctccctgaatatgcccatgtgtattcccactggaatgaccatttcttttaaagaaggtctccaaaaggtttcttttagagagagcgtctctcaatgtaagctatttgggtttgacaaggtcatcagaataagaaaggaagtgtggcaccataaggtcaaggaaggatccataaaagggagatgggttctcgtcacctcaagctgcagctgtcatccacgtgatttcttagggtccctagtgttcttggttcatactgatttccaggaggggagagtggtgcttacatggttagggcagggttcagggttcagttcaccaatcccccctttccactgccgttggtttgggagagtgagaatagggtatctaactgatcatgaattgagtaagaaggggcagagggtgagagggaacagacagaagagaagatagacaggctctcctctcctacctcttctcaagcctatagacagtgcctttggtgcacagggtcccttaagcgtgtgcagagcacacagcctaagggctgggttctggggcttctgcaggagtgcgcatggctgggcagctgggctctgctcctagtgggcttccttctctttgggattctgctctcagaggctgccaaaatcctgacagcatcgacactgggtgagtgcttggcgggaaaatgcagagacaagcatgttccaggcaccgcgcatgggcactggcagttctgtcagagggtcatccaggtagttttccacgctgggctggtgtctcgggctggaaaaggaagagagaggctggcaggggccgtggagccaagaagggcctctaaccaagggtggaaaagacagttctggagaaaacggaagtttcctttcttctctccagctctggacgtgcgctgcgtcgcgcaaggctggagccagcatttaatttcccagtccaatacgttcgccccgggcctccttcctcagtgctggatagacgtttcgttgctcattcgtttcttctaagggggtgcacggtagctgtcaatagaaattgtagcaagcattttcaggctcttaaagaccgaggaaacgtgctcctgggcgtgtcacagcaaattggggttgttttcgtccaaaggaaatccggagaactgactggggcgacgagaggacccctggacaattgggtctttggaagcccttttatctttcattcaagctcctggaaaggttttgaaggataagtggggcagttagttttgcattttgtgcccctatttttatttcttttacttttacccccaaaggaatagaagataaaagagaaaatatatcaagggaaaggagggagctccccaagacccttcttaagcccatcctgaaaggacggtgggctctctcttagatcagtttaagatcattgagaatctgggattcctggagctggatgaaaccaaggagttcatttaattcggcctttcccttttgttttcctaagggggatactaaggattaaggaaatgcaggcaccgtttgcaagagcgcacccagctttcctaatggcccatgaggagttgaatcaagattccttactccgagtcaggcccggtggctcacgcctgtaatcccagcactttgggaggccgaggtggctggatcacctgtcagaagtttgagactagactgaccaatatggtgaaaccctgtctctactaaaaatacaaaaattagccggacgtggtggtgtatgcctgtagtcccagctattcgggaggctgaggcaggagaatcgattgaacccgggaggtggaggatgcagtgagccgagattgtgccactgcactccagcctgagcgacagagtgtcactccatctcaaagcaacaacaacaaaagcagttttagaaagctgtgactccgtgttaatctttttttgcgtgttcttttttcctgatcattaggagaaattaaaagctcatctcttcaattacacgtttccctgcctcagacttcaagagggagttgatgtggtttgtgaggtgctaaaatcccagggtttgtcctagaatgcactctggctcgagacccaccatgaatggatgcatgtgtggtcaccccttctctctgcttcttacatggataaaatgcaagtaagagcaggcagtctgaggggtaggggattttcactttatatattccttattacctcagaccacacaagtgtgggtgttaaaaatagtcactcccacagatacacactatttctctagcaccacagcctccacttcgaatccaatggctatgggacttcagctcccaaataacacttgcttctaatttttggctattgccataccttctttcctgatctggctttctctgctgccaagactcttagattcaagaaaaaagcccatgttgaagcatggtttaggagaagacatatgtaaaattaaatgattcaaacttagagctgttgaaactttaacttactctgagccttgagaggaatgtgagttacacagcatgcagtcaagtagcatgcagctacaatttatgcttctctgattatagattaacctccttccttattcttctgtgataattaggaagaccaagaggtgccagagataagactccctcaggtcctagccccttcttaagcagtaacaaagtaatcttcctggggatgtagcaatctgtaaacaatcaaatcgctgtaatgtatacactggccttgtatggcaaatgttgtaatactgctaaaacttctctgttcctaccttttaagtgaaatcttaacttctccatttcagaacactgaccccatttgtttggagtcagtgttttctgggtggtcatcctcaagttttgcacttgaataaactctatacctaatcatgttttctaaatgtcattatgtaaggttgacacattagtgtgatggaacttgtacctctcctgagaatcaaacttttctttccttaggatgccaagattgttctagaaatgggcgacgtcctagtctctcttgcaactgggattccagttgcaagagagactaggacgtcgcccattctagaacaatcccacaattttcctgaatgtcctaatttaactttgcacaaaattcaggccccaaataagaaacatcctgccaaatattgaaagtaatggcaaaaccgcaattacttttccaccaacctaatacatttcaatctcaaggattttggctgtaagtgttgactacatatttctccctccaatggaagtttcttggactcaccctttagctcctatatttctatttcctaaagtaacataaaattccaaagtgaaggatcccagaaatagccctgattggttgtccatcaagaatccttcaactcacattcacagctctgtaccatattttccaccaatgcagttatttcttttggacacagtatctccataaattctctgattagaatgcaacatgtatcttggaataagacatgcctaatgtctgagcacagagaagaagctcatcacactgacatggagaccacgagtcagagaagaaatctttggtggaagattgccacagatcagggatttgggcagttggaatataggtacctgggctggggcttacccaaagtgaaatggaagaactggtgaagcttatcttcatgtgttcactatttcacttcttgtttcctaggctgttttctcctggctttcccccatacctccacaaacccctgtcatgtgggctgcaccaagcaaaatcataggggtggaattgcctgaggccttgagggctcaatcctagcccagtgtgtccaggaggtggcacatggagtcaaaagagattattctctagctttaaaatttaatgtctgcctgctgagttttggtcttacttggagcctgttacttttgttgggaaagggagcatggaagggtgctctttctcacttttggaataggaatgtctgtcttatgccgtatcaccattgtatcttagaagttgttaccttattttgattttacaggttcacagatgagactctggattttggactactgagttgatgctgaaaccagttaagactttggaattagagggttggaatgaatgtatttgtatgtgataaggacatgagtttttggagggcagggacagaatgttgtggcttgactgtgattttcttttatccgaccatccctggatttaggtctagtaatcatcggctgattgccatattgtttttatcaatgatctagtataaaacaggttgatccaaccaaattcagattcctttaaaaagatggtttttaaagacaatgtttgagatttttttcggacctaagaagggcccctcccagctgtctcttttcccagtttcctctggcaagttagtcaccctacagtttcacttgtatctccaatgaatctacccatcgcctaccaactgcctttcacagctaagtccaccgtttctttgtttttttctgtttgagttctcttaggctggaaccactccatagtttttgttgaagatagagccaattcctttgcaaagtctatcagtcagggttcctcattaaaacagagcagtaaggtacctttttttttcaaggaattggcataaatgattttggaattttaagagttggcaatctgaaatctgtagagcaggccagcaggctggaaactcttgggtgggaactgatattccagtcctgaggcagaatatcttcaaagaaacttattgcagatattaatcacgtctaaaaaataacataagagcaacacatagattaggttttgatttaataactaggtacaatggcatatgtcaaaaaacacagttttatacaactcttctatagcatactgggaatatactaactcttccccagagtggaggtccttgggtgatgttcactcttattcttgatattctgtaacataaatactgtgaagtaatatattagattttaaggagataaagtgagaagaatacgatagtattctacacacacaaattcataacaaaatacaaggtaaatactcaaaacatttacaatccttttgcaactgatcatatggtgatagctagcatttgtatttcatatacctttgccctcagcaagtaccgcaattgactttttgcctgattgggaaggggacccaaatattcattcttgaagagttggggttattagttttccttactgaattgggttattgtagattttttgttgactttaataaaagggcatgggcataattagtgatgtgttaacagagttcctttattccaggcttactcttctttttaatgacctataacagtaaaccaacgaaatgattgcagctgtgacaagtgctacaaagaagatgaaaacatagtattcgctactctttttccaacttttattttatgttctggggtatatgtgcaggtttgttacacaggtaaatgtgtgccatggtggtttgctgcacagatcctcccatctcctaggtattgagcccagcatccattagctattcttcctgatcctctccctcctctccccacaccctgtgacaggccccagtgtgtgttgttcccctccgagtgttcatgtgttcttattattcagctcctatttataagtgagaacatgtagtatttggttttctgttcctgcattagtttgctgaggatggcttccagctccatccgtgtccctgcaaatcacatgattttgttccttttaaggcttactctttacatcaatgtgtagtagcaactcaatttcccttagtaatcaggtcttgcatgataaatccagtccaacatttcagtctccctaagcctttagataccttcctcttcagtgtcccaaggtaattctggtatttcagcttcatttagcgtaggccaccctttgtttcatccttaactcaaccaaacccatcgagctgcaactctatattgagaatttgtgctttgtgggcctgtatcaataaattcaccttgagtcaactttatgttccttctaccattatttcacactattaacttacattctcacatgtattcaccagatttctgtctgtataaattgaaaaaatacgcattacttttggaatgtagtatgtctcccattggttcgcaattttaatctctctttcaagcctgttgggactagagtcttatttatagatatagatatagatagatatagatatagatagatatagatatagatatagatatagatgatatagttctacaagccaagaggtttggtggaagtaggttctgaggataatcagcagtgtcttccagttaaaatacctcagaggtgctagtacactttcctttgaaaaatcaggatgaaccttctcagacatgaatagcagggttgctcctactggcaaagaagatgcaggagaatttagaggttaagtgtcctcagcttcatcaggatctaccctacaggtttcattccgattttcagaatctcattccttcctaatcaattccctcagtttagcagaagatactttgcctggttgggaattcaatttgcactgtaattctgccactctcaggatgagactccagatttgattttctgaaacctcaggctgatgacaatgggagataagtacgttcctccaggaagacatagaaggtttcagatcatttatgtggagcttgaacttggaatttcaagccctgagttcatcatttttctttactttgtctaccacagttacaagcagtcatcctcattacatttattagtttgactaaaatattttaagctatcatgattacccagagatttgccatttatgaatatttgattaggaatccagtagtaatattttacaaatctttttaccgtattacaccatagactatcattgtcttctttaccactggaaagagtacttatgccttaaaatataatcaatattttatattgattgtcagaaacccaataccacaaacccagatccagttttttgaactggtaaaacccttggaattacaccagttgctagcagtggaaacaagcaaaagcattgcttaagtactccagagattttgttctttttactttatttgacacaacctggaggcagactattgagggcttgcacggtggctccatcatgctgtccgttgtcccaattttcctgtttcttttttatcttttcttaaattattgcaccaaacttactctccagtaggtggctttcaagaaatacttcatatttaaatgcccatgccctcatatttgcttctgcattcacagatgaaattaagtttcttcttaaaagtttcaaatgcgtgatatcttgtgggttaaaccactgaaaagaaaacattagacatctgaggttgccctggaagaaccacagttctaattgcttaattctgggacaattcttcagacaattcagataaaaggatgaaatagctactatgtatactccctgcagatatagcaaaggacccaagcccttgtcaaatccatgaaagaacttgcctagtagtctgcagagctgggtgcctggcatctattccgttttgtgagttcttatactgcaaggatgttgcacacagccaggattatgttatatacagagatgtgtgtgtgtgtgtgtgtgtgtgtgtgtgtgtgtgtgtcagagagagagagagaaagagagaggtgtaaggtctgaatcaccactaattatacctgcctgctcctgaaagcaggacgtgcaggagtgggaatgacaaggatagggtggatgtcatagatacacaatgaaagagagcatagtgtagatattttcctccaaataagccactagatttcttcttatctggcaaagtaactgctagggaacatgtgaaaaacataagtaaaaagaaacaaaaagagaaaagaagagaagaaaccaaggatgaaaacagcagaaatgacatcctctgcaaatgcagagaaggagggagaaccttgaatcacctataattacccctgcctgctcccaagagttgtggttttaagtatcacctggcaatgaggcaccctagcagtaagctttctggggactacagaaggacaggaaggtgctgcctaaaagaaagaagacaatgtgctgaatactaccttacaaaacatgggagacaagttttgatgctgttctagaaaccaaaccattgccagcaaaacttctggctggcttctctcccagtgcaaatggcttgagctttcacagtcactgagatttcctaggcaacaggagtgtaaacttgagaaaaggcagaaccagagtagagattgacagtgagctgagccaatcaggctgtgaatctgcagcagtgatcccaggtcctccaattaatactaagagagtggaccagggcccctgaggaagacaggtaagagggaggaggctaaggtggcttgggagggaccagttttcctagatgcaggagacagcgtccatagtttcagttcgaagcaactggtggcaaaaggttagcatttaaggtaaatcaatgtttttatctattctatgatttaatgtttttttttttcttggtatgtcttagctgagaaaagaagacagtagatgttactctctaaaaagaaaatctaaaagtcttttgagagttcttggactagagaagccatcactaggctgtcagtgcaagaggaaagagcttggtactgggaaagatttttgtaatctttgcaaaaaaaatgcttagataaaaatgtacaaaaataaatttcattcagtaaaggggaaggaagtaaacattactgagcagtcattaggtactaggtatttgagtgtgaagggtttgggtgaattgctctaacgatcctgatgaccactgataaaactgagcttcagggaggttcagcatttccaagtcacaaagcaataaaacatttcaactttcattcagaccttgctttgtctgatacttaaacttatgctatttctgctatacactgacaactgagaatcagaataaaaatcaggatgcttattaaagtgtacatacatggcttgttcaaaattatatcaaatagttgatttgattcatcagagacttgagcgggtcctttacgttctcattaaaggacaacaccaatgacccaggcagccatctctattgccttcagtctggggagtatttaaaccatattaagtagatgaaattcttacctgtttttttttttttgacttattttttcctcaaatcctacaaccacaaaaatctattttgttattgaaagttttaaatattgagatttgaatttcaggcatacatttgtatttatattctgataaaaattacccaatagcaatgacaatgataaattctaatagcaataaaatagcctcctgctaagccctgatgatatggtgatagtaaatgcaaaggatacagctcttcctcgtaaggaccttatagtctgtctagcagggcaagtaattcgaaaacgaattacattgtcttgcaatgtgaatgctatttggacttcaccacatgatcatggaaggatgggtgggacttctctgggccaacaggaaaaagaaggtgtacctgcaagtgtgactacatgtacaaaggcacagagatacagaatgctatggtgtgtttggggaatgtgagtgagtagagatgcaggatagattttgaatggatggagaattactagaaatggctggagacataggaaaggccaatgcatgaattcaatgctaagaactttcattttacctgtatgcaatgggggaccatcaaagggtcttaaactatatcatgaagttcatgttttcattttctaaagattgctcagtcttttgaaagacaaagtacagagggcaaagctaggggcaggaaaccaactaggagacatttgcaatggtggaaatgagaagtgaccatgtcctaggctgagtcagtatccatggcaatggagatgagggaatggaaatgcgggatgtgtcaaggtagtgaaactctataggacttagctgctatttggatgtaaagggttaggaagagtctaggataatggtcagttaatgacccaggtaaatggtattgctgtttcctgaagcaaggagtaaggaagataggtaatgaatttggctctggaacattaaactgaaagtgtctgtaggtcatccaagtgcacatgttttgtgagaaatctggctccagagagtgcctacattggaataaagatttgttagtcatcattgtatcaggggatatgactgagattgccataagatagtggaatagtgagaagagaaagataactgaagcctgagaaacagcacttaagaagcaggtgaagacaaggaagaaacaaaataggacagatccaagagggaggaggagagacagggagttagatttatagccattgagagaaagggtgttaaaaaggaagaatgaccaatagtcaactagttggagaagtgaactaagggctaatgactgttgaagttggcaatcaggttagcaatgacttattgaagagtatatttgttggaatgacagggtgaagaccatattgaaatggaccgaagtatgaatggggcatgagaaagtagaaaatctggaaattctttaaaatagtttgactttgaggggtgatagctagagggagtccaggactgagggaccacagcggattcatgaactaaaagaaggagctgctggagaggaggaaaagggcataactgatggctgagaatcttagaggggtaggcctctgtgttgcaggtagagagggcatccttagatgggaggaagttcagcaatctcttggaggagggaggagggaggatgaagtcaggatgcccttagagcgctatacttttatagatttggaggaggatgatgtgaatttgttcataactggtggctccatttttttctgggtctttcaaggcaaggtctggagtggcaaaagtttggattagcctctgaggagactggaataagaacctgaccaacatcatataaaagttgagttgtgtgttgcagaaggcctagctgtggttaaagaataaatacagtgacacctgtccatgctggcatgtgggtttattcagctgcacttcagtctgccgttaagtacatggaacatgggcaaattgaaccaagttagctattattctgagatggtgggaggttgaaaaatgagggtcaagaagggaggcactggtaccagatggtcagaaagatgcgcagagtgtgtaaaatggataagaaaggaagtagatccagaagggagaatgaggtaggtaatggctggggtgaaaatgtagggccaaaagtctggaggtaccataaggtcagaagcaagttggaataatggaactgaacactgcagataaagtcaatcttgaattttgaactttcagtctgggcaccgtggctcatgtctgtaatctcagcattttggaaggccaaggtgggaggattgcttgagcttaggagttcaagaccagcctgggcaacatagcaagatcctgtctctactaaaaataagaaaaaattagttgggtattgtggtgtgcacctgtagtcctagctactcgggaggtttcggtgggaggatcacttgtgcccaggagattgaggctgcagtgagctatgatgacaccactgcgctccagcctgggcaacagagtgagaccctgtctcagaaaaaaaaaaaaagaagtttggactttcagaggagaccagatttggttgggagggaatgccgagacaacaaacagatggagttgagttggtagaaatcaaggagctccaggaacttcatagctgcctgttggatggattgtctagatgagctctgggttttcccagattgatgacaccacttgaaatggagagtacatctctgaggcaacattcagagtgtcagtgatttataaactgacagaaccaaagagaaacataggaagtttgtccagctaggctgtgcttcaaagaaggatgtggatataggtcatgatgtggaggtgacagggtgcatcttaaaatctgtgaggttccttaatacttagaatttggggtaagaggtgctttcatctgagaagactgcaagaggggtaggtttccttatgcaaaatcagataccatccaggataaagatattgtaccaatcagtgtcttggcaggaaattgatggcacattcaaaggtagtaacagaaaagagtttaatgaaggacaattcacagaagtgtgggtaggaataaggaatatagagaaagcataatgagacacccagcaatgccacagtcagaagggacaagaaaggtgttacccatagccttaaaggggcaaaaggaggagtggttttcatatctcaatcaaagcatttctgtagggagggctgcctttggtgaaggatatggtcactgaaaaactgtggcttggcagaaaggaagctggggaaataaatactccagcctctatctcctcctctcctctgatcttctactgatgcctcccagtggtggaatccagctggaagccagcaagcaaggaagtgtggttaacacagtttatggaggtcgacctcttgtagcacagatgtgggtggggaatggatcaggagaagcacacaggcaaacaatattcagctcagcagtgacgattgctgttcagaagttgatcaagatgaggaggcttataattgaataaggaatagaggaaaatctgggtgtctggatggaaggtatgcttggtcccaagagggccaacgtctgctgtaacttgtggaggtggtggtgaggtgctcaagagcaaggagtgggagtgtttagctcgtggaataacacttttggcttcaaccattgctttaatctctggatgaatgaaataagaattttccttgtaacatgttgctctttattctgatatcagacagctttgtataaagaaaacatatcaaggttcacaagagcagttttctatatttcagaagtcaacagaatggcatttgggagaagatggcattacaagacactgaactgtagaaatggccacatgttggcttctcacgggattctcaatcccatgaacacttgttcaatttatgatattctttagagcagattgtctcccacatttttagccataattccattgccactcagcatcttgtttttcctgcagtctgagaatagttttaaaattcttgtatattttcttgtaacctgaagtcaaatagaattaaaatttcccaaactaaaaagtgtagtttgagagagcaggacagttctctgttgagaggtggatgacagctcttcttactttctttggaagttctgcttagtgtgtgtcccctctgcagttacccctctagcttggacaggagttcttcacaccgagggaggagcaggcaaatgctcttcagtaacaaacagcatcagtccttcttacttagtgtgctttggactcaatattgctaataagcttgacccagtttttataaatgagtgccctgtggtgaccacaggggtttcctgtttaaaaaatgaacattttctgagatgttgtggataatttacaaaaggctgctgggggactggcagatgcaacaggccctgctcagaatcttggtttttctaccaatttgtgaactgagacaacctccaaatctctctgtacctcagtttccttattttgtaaaaagtggatatagctatgtctgtaacctataagaattgttatcaagacttattttataccagacaaattttctgctctaaacaaactgactttgaaaatcttgcaaaacacaggccacccttttagcagagaacatgggacagagtaagtgtgcagtaaatgtttcctattactgttgttcttatcttttgcatagtcccggaggtcagcaaagtgtttctatataaggccagagagtaggaaatttaggcttcatgggccagaaggtctatgatgcaactatttaacttttgagttgtaatgtgaaagccgccacagaccatatagaaatacacgtatgtggttgttttccagtaaaatgttatttacaaaaccaggtggagggccaaatttggtccatttggtgtggtctgatgtcccaggcctagattattttaggttatgtttgcctgcactgagggcatccttcataactgcccgtggaaaagtgagccttatttggtttgggtgaacagaggtgaaaagggaaaaatcatcaatgtgttgacgtctgcccttagggctttccttagtcttctgcatcagagtgatccggttgctccatatgtttagaaagcttcatgctccacatagttttgtgaaataagctgatttagacatgctcacactcttactttctggaataacaatatttcttctgccaactgaggcagaaactgtaaggtgcctactcaatagccactgtcttcttttttataaacagaaccttaggggtggcaaattattcagccaaaaatcaggtttcccagactcctttggagtggctgataagatttacatagaaggaattgggtgaatcttctgggaaccacttcagaaagagctgatttcgctgggaagagcatccttcttgccttttgccctttttcttttcttttgcttggagtgtggagataatagctggagctgctatggctattatgtaggaatattatgtatctttaggtaactttgagtagagtctggaaacattgatgactacttgaagcacttccagtcttcttttacatgagagtaaagtaaatctctatcattttcagagatatgacctgtttctattatgagtcgctggacacaatttataactgatacactgatttacgctgatgttggcactatgacattggatttctatcccttaacactttttggttttctggaagtatcagttaagaacaactaggatacaaataattgactagatttctaggtggccataaaataaacattaaaatagacaaatgactccaaaagaagcattcattctaagggactgcaagatagttactaagtgattttcatgactaatggctgcaaaagggcaaatgtccaccagagctgtgtctttacttgcatctaaaagggtgatagaagatgtaccagttgggctttgtccttgcagtgggtttgaaacaattgtctgaggtcatgacttcatggcaaaaatggaatatttgaaagctacctggttggtcttaagcacataaacactgaaaccaaccgaagttttacttttcttttgtcttggttttatttatttatttctctatattgcaattcagctaactctttgcttacctttgcatagtttaggtagcttcttactctgtttctttaagatgttgcatcgagcaggttgacctaactcagaatacattgtaagttatttctttgtaaaaaccccagagactcaaggcacagcaaagggaaaaaaagcaagatggagaagacagcaaggagagagctattaggagagtgcatgccccctgacattcccagtggatgcttattatgacaaggaccctacaaccttggggcctctgtattttattaaaccttgttttttttttttgtaacacattgtgtcagttacatgggttcttgaatattatgctaagctgtttattttgctctctttcatagtcaaaagtgctggagaggctgttacttgacaaaattctactgagagaagaggttataatagagtgactttctctctcctcatgagtctcaggggtagttgagtctcttctcacattggattgctagttattttacccagctaaaggtcaatatttagggtcagcccaaacattgcaggaataagctttttgccgtctgtatcagttaggaatatttttgacagcaagtgactgaagacctgaccaacaacagattaaacagataatacaaagagattatgtttcttacaagacaggatcgtgaagtcaagaagttgccaacattagttcagcagctcgatgatgtcagggctctaagttggcatggatatgattcccttggcccttccctcatgattgcatagaggctggcatagctctggacatcacatcctcactcaaggcacaaggaaggcaaaagagatgagagagatattccagagctctcagcactttcctttgggtccctttggctagaactggttcctgtgcctacccagtagaaagtggaataaggcagagaaaaagggaaatagaatgactttgtctcaaccaggtggcagtgtctaaaaaattagctgtaattcaaatttaatcaagttaaaactacttctaggaatgtaaacttccaagggttggaagcttggctgtctcatccgttcctcttgtatggcacataataggtgtttaataaacatgcattaatgcagaaccaagactagagtgggacaaggtaggtgtttagggtgcaccatttaaggagacaatcattctcaggcttgggcaagtgtatggttgacatttgcacgattctgagactgtgtgcctctttaaacattgtgcctttctcttacttagccctagccccaaccctggttcagtgaataaagtgaaatatgaatatgtatgaagtaaacactttatcacaatgatatttataaaatattatttttaaaatgtaccatatcacaaacattaaaataaggactgaattcacatctcaaagctcaatagaaagaagtaaagactatggtttagcataaatgggctctacacaaacctgcctattgagagtggctgcaacatgcattttaagcatttcgagaaaatgtattctgatacagagaaaatgtggtaagatgccagacttcggtgacatcttatttccacagtatgctatgtcacttaagtgtagatgaaatgccgtcatactttatgtggtatgtggaagttgacaatccaaacaaaaaccagatgtttcatatattcatacattttagaaaaagtttttaaaataaattgtgggaaaatagtaaatggtataaaagataatcagtgcagaagttttgagtttgatttaaaaaccctcacacatcattttaattaaaacaaacagaaaaaaatagctgctgcaagaggaagaggctaagtaaaatttttcttcttaaccataaggtatttacactgagccttaaggatttgaaaacccaagcaaggacctaagatgggagaaggggtcatgtttagggactgtgagtggcccagatttgctctgcactccggtcctcactctctgctggtatgaaatctagcagcactccaaagcattcttttccctgaagcttttcccttcctgcatctcttacttcatggaccttctctgagtccccaaagcaatttatcggttttaagcaacatcatggtgtaactgttgaatgcagtgacttagaactgttttcaaggccgggcgtggtggcttacgcctgtaatcccagcattgtgaggccaaggtgggtggatcatgaggtcaggagttcgagaccagcctggccaacatggtgaaaccccatctctactaaaaatacaaaaatcagctgggtgtggtggcaggtgcctgtattcctagctactcgggaggctgaggcaggaggattgcttgaacccgggaggcggagattgcaaggttgcagtgagctgagaacgcaccactgtactccagcctgggcaacagagcgagactctgtttcagaaaaaaaaaaaaaaaaaaaaggaactgttttcaaccctggctctgctactccctggtagcgcattctcagacaagtaacctgggttcttcaggtctctgctgacttcctgtaatagggcagtagtatttgatagaatccaccacatgaggcaatgtgtggatatatgtaaagtccttagacaaggacttggcccccagcatagttacaactgtatttactacctcttctcttcatgcctttatcttgccctgtgttgtgttataataaggccttactcctcttactagagggtgaccttgtatttcccgtagcttatgttctcaaacttagggatacaggaaaaccaactaaaaacaataaagtgcccagccgcagcatctacaccaagagagtctaatttactgtgcttggtgagtgctgtgggcatctttgtttttcaacagcacccacggtggtcccaggtctttctctatatcagggcttctcaacttcagcactgcggacatctctgactggtaattctttgttgccaggggccatcttgtgtatcttgtgcagaatgtgtagcagcatccctggcctctacccattagatgccaataacactctaccctacttccattgcaacaaccaaaaatatctcacaggaggcattatcaaatgtctcctgggggtgggggggattgtacccagttgagaagcacttctctataattatcacctgaagagttagcacagtgccttgcatagcttgtggtactaagggcacattcagttgattcaaactcaaatgggctccgtgaagtaactctcacgatgtcaacaacactgacacacactcttatctgaggcttctgtgtactgcagaagccacgtattcaaactgtcagagtcttcaatttcagtctcttcgggaggacatcactatttattcacttcctagccgcctgctaggctatactcaacacctagtgctatggtttgaatgtttgaaattcatgttgaaactgaatccacaatacaatagtattaagtggtgtggtcttcaggagttggttaggtcacaaggactcatccctcctgaatgaaattaaggtgttaataaaagtcgctttgcaaattattgagcccttttttgcccttccatctcttctgccatgtgaagacacagcatttatcccctctggaggatccatagttcaaggtaccatctgaaaggccgagagaatagtccttgccaggcaccaaatcagctgataccttgatcttgaacttcccatcctccaaaacaatgagaaataaatttctcttgtttataaattaccccatctatggtattttgttctagcagcacaactgtactaagacctctggaatgcaatatttattttagaagggcattttccaaggggaaacttattgaggaactatgggtttttgccatctaccgtgtagtaatagctagtttattgaatggactaaagccagtgcagatggtttaattttttccattaattgccttcagacatggtctgttgtatatctcttctcatacctggatgacatttcaagtattgaaaggtccaccaagtcttaatcaaaatttcaatcttatacccagtttccaagtacagagataaagagcaaaagccacatcaagttccccatccctatgggggactggtctcagtgctcaggatcaagcccgagctagaagaaatagggaatgttttgtcttggatgagaatttaaaagaaggcaaatgttttccaccttctcggaactagcttgatgccctacaagcctcatcaacagctgcctactgtatacctttctcctttcttctctccccatagtaaaatgttttcaaagcacatggaatcattatagcaaccccaggttccttgctattgaaaatagctaatgtaatggcacaggtatctaagaattacagaaatgcctaaaaatgttaaaaatcatgacatggtctggctatggggaaaatgggcttaacagcatcaagaggtgggacagaggctcggaacaattggactgcagacggctgctgttgtcacaaggctggacctgcaggacttcctcaacaggacagcttcctcacagtacgtgctgtctcaagcagtgtggtgcaaaggaagactgtccaggcaaaatctggtccagccatcgcgactgcacatccctgccagcggggaagcctcctttcccctcctcaagcacatctcgcctctgtcatctacaccacatttgctgtccctttctatttacctgattctgtccttccctctccactttaacgcaggctaaccctgctcttctcttaagttcatccgagctgactaaacctgcttcggttccctttcaaggaacggtcttttccctgaaaaaggaaaaccaggaatgtacggtcagagaagtcaaaggagggagagtttcttgagggtgaggtgagaagtttccattggattttgcaacaaagaggatgtaaaagcgttggtgccttatagtgtctggatcaacgatctctagggttgcctctttagcaataagatccccttctgtgtttgcaggtagttggctgcagatggagaggaacagagaaaggaagagagatgtaattcagcttactgccaccagggagcaccaaagacaagtcaatagatgcaggctagggctagagcagttccctcttccaagggtcctcttaaatctgtctctgaaccttacggagggaaccatgaagatacagaccccatgcatttacagctttccacatccttcctacaataattcgcaaaatccaggcaggcagagagtttggcgtggcagttggttgtgcaccgggaggacagtggaatgagacagccttaatgggaccattgctaccgtagctacactctgcctctgccccaaatctccaggcttctgtgaatatcctcccttgctgccagccactggagggtgagagtggagagcgcaagcaacagctctggatgccagccccgagtccgccctctccctcaaactgcacgttctgccactggccatctcctatctcttcttctctctccgtccacacggtccaggcagcatagctggaaacaacagtctcctattggctagcctgtcccgccttcctatccattcttctcactttacaatgcaaacggcctttcccgttttttcgttttttttttttttttttgagacggagtctagctcagccgcccaggctggagtgcagtggcgcgatcttggctcactgtaaccaccgtctcctgggttcaagcgattctcctgcctcagcctcccgagtagctgggattacaggcaaccgccatcatgaccggctaatttttgtatatcggtagagacggagtttcaccatgttggccaggctggtcttgaactcctgacctcaggtgatccgcccgtctctgcctcccaaagtgctaggattacaggcgtaagccaccgcgcccggccagaagactttgtggtctcctgttttttaagaagactttttcccttttttgtggtctcctgttttttaagaagacttcttccccttttaagaagactttttccttttttaagaagaatttttccctttttaagaaaactttgcggtctcctgttgctctcaggagaaaatccaaatcccaccctggcaccccaggctctttgggatctgatggctgcccgcctggtcagtttcatctttacccacaattcccctttccctacttcctccgaatcttcactactgttcatctccccctgccacccatacctctgttctccaaccatactgaaatacttgtactttcctaattatattgttttctctctcaccttagtctgagtagttggtacacctgctatctaaaatatccttctatccccacgtccccagcctcgataactaccaccttccattaggatgaaagtttagacatcacctcctctgagaggtcctcagaaagccccactcccaggccaggtaagcctcccgtcctcttgtgattgcatcccctgctcagcccccaggctgtaagcgttgtcttggtcctgctttcatcctacccctagcacagtgcgtggcgcttcctgagctcttagcagacctgtgtggaaggcagagactgaaccgcatgcctggccgggggaatgtgcagacgcctgagaacacgtggtggcgctgcggccaagtgcgtcgggagcgcagcctcttcgccttgcacagggatgcgctccgttgtcaccacaccggatctttaaggttcagacagagtcttctacaggcagagacactttgtgcactgctatgaagtcggtgacatatgtttggggactgactcttgccctggtgcctggcgcctttattgaaacttcaaagctgagcatctcccttatgcacttgagatcctgtgcaatcctgccttccttaaaagccccggtgcttaataaacttttcccttctgcttaaatacaggagatcaggattcaaactaatgaagactctaggctattcaagggcttgctcctctgagtaattcctcacactcccacactctattccagcatagtgcctcgaaaagagtacacaatacagttagctagtggttggtgaactgggtgattcaatgattaaaagggatgcttactatgggcatttcaagtttcacggtaggctagcaggagagaatggacttttttccccttgaatttattagactccagaaataaactgccaacatcatcgctgggtagggtcagcctcaagaggtgggacagcctgaggtactgggctggcagtttcttgccttcctggactcgatcccactttcctatgagaaagcaccatcaaactgtgctttgagattcttatatgttatttcacaaaccacaaacatgatgaagcagaaagagcccttaggaatcagaagccgtctgttttggtcttggccaggacttttgagcaagtcactttgccaacccaagccttagtttccaagtttgcaaaatgaggttgcactagagaatcttcaagggtcatacagttctaacagcgtgtggattactgtgagtcatgtttccgtgcgacttgggcaagttacctgatttctctgcatcctaatttctttatctgtgaaataccaataatagtagtaactagctcataggcttgtttttcttttttaacctttgctaatttaccaggatgactacgtgcccagcacactttaaattttttttttaaattgacagataaagttgtatgtatttaccttgtataacatgatgttttgaagtatgtataattgtggaatgactaaatctagctagtaacatctgtgcatgggttttattttattgagatgaatacacataacataaattagcaattttaaagtgtatattacattcacaatgttgataaaccaccgtctatgtcaagttccaaaacatttttattacccctgaaggaaactttacattcattaagcagtcactccccactggccctcccaccccagccccttgcaaccactaatttgctttctgtctctatgaatttgcctattctgaatatttcacataaatgaaatcgtacaatgtgtgacattttgtgtctggcttcttgtacttagcataacatggccaaggtttgtccacattgtggtatctatcagtactgtgttcctttttatggctgaagaatgtttcactgtatggctataccacaatttgcttatccctttatccataggtggacatttggtttgtttctaccttttggctgttgtgaataatgctgctataaacatgggtatatgtgcatttgtttgagttcctgttttcagttcaactcaaggggtttttgtgggaactggacacatgcttactacctagtgggggcaccactgatgcctttaatattattctgaaggtgtgcaaagagggtcccactggggatctgtcccagatccaggagctggatctcactttctctccatgactggtttttagtctctgtttctcttcattctcacttactgtcatggatggcagggaaaaaccagagcaaaatgaataaggtggacaaggtaggggagatgtcatgggaaatgagaatgggaggtgagtggctggggacagccattgggcaagtatcatgaagcaaggtcaagggtcaggaaagatgatggtggtcctgggaaggatcaagactctgaggtgggtttagagaatgagaagggcatgttgttgacaccagttcctgcttccataggggttggggtggggatggggcgcatgccactagcagaatatggtcagggcaagagaatggctcaggcaaggatgagtaagacagcaggacatggctagatgagtgaattggtggtcttgtctgtgactcaggattctggctgttaataaggggacagttagtgctgaagctgggaacgagctctgggaattgtcagcttgaggtcaggtaacaaaatagtaataagcaaacgccagttattagaaagctaaagctgccaggaagggcacagtcttggctgcaggtgtccctgttggatgagaattggaacatgctccttgtgtgtgcctggcaagaacggagatggaagtctctaagcgcagggtgtgccaccgtctggagttccagggaacctctgcttaggtgccagtggaagcagaggaagactgtgtagctttagacagagcaagtttttcctaatgtggagtaaagagctgggacgtagacaggtctccttcttgacccgaggttcaagagaactgaaaggaattgctcccaccttcatccacatactgggaatctgaatacagggcaagaaagagggatcctgtaccttggctcggtggaggctgcaagaaagtggccacgttaagtgtatgcatccctgaattgtctattctggcctcagttattggcttgatgagattccctttcccaaaagtcaaataaggagtaccctctatgggagacctttcagggtgtataggagaacaacactcttggcatagacgaggttgtgaatctgcaggttgctgtctttgatgaaaataattcagtcctaatgtagcacttaggggaagtgccagaatttgactggggagggagcctcgaagccagggtggaaccacattctaataccgtttttttttttttctgcacattgcatgctgtcctttgcacatccttcgagcctcttgcctctcattcttttcattcacgactcacaggtaacttccagaatcccccatttactgaatatgtggacttatgagaattagtgttttttgaagctgggatggaatttaaagaccatcttatccaatcctcccagttaaaagaggaggaaacaggctgtgagattcactcacaggcaggttaccaggcagatgggggtgaggggttgggggagttgaggggtggggattgaagagtcaggactataacccaggtctccaggcccccagctaagtgctcttcccactgttgtgcaagctttgagagctcaagtgtggctacaagagtttgtacgtcccttggggaccactcaggagacagcacttcactgcacccatcctaagaacctcattaggtgttagtggatactaacctgtgaatcaaggagaccatacccattactggtaagaatcattaaggatcaagtgctgaaaatctcattcaagacagaagcaacaaaatcaatgtttagaccaaagaggagaacattaaatgtgagggtcaagggaatatggaaaattctacataaaataatatggtatataatgttggttcaaaaaagagagtatagagaaattggacttcttttatggatggaagagggcttcagaaagatcaaaacatcttgggaaatggtgatatatttaagattattgtctaggctggagaaaccagatgtcctcaggactagataagtaagttataaatatgccaggcacacagttggcatagagaaaaattggaaattctgagaggtttcctgacagagaaggctgtaaatttccttctcagtgaggcttctgtcactctgcccagccagaggcagcggcgaggcctggactttgctaacatgctatggcttcccctcagatggcagggacagcgcgccatgaccgagagatggcgatccaggccaagaaaaagctcaccacggccaccgaccccattgaaagactccgactgcagtgcctggccaggggctctgctgggatcaaaggacttggcaggtaggacccagctacaggtggcagggaatggagcgggaaggaatgactctgccaggtgaggctaatgttggccacgtggtcttggggaagtcatctcctcctaggggctcagttccttatttgtaaaatgtagagtttagaagagttgatctatgaggtcccttgtgacagtttttggatcttagtcccagattcggcaagactcatatctgctacaagacagtgcagctctgggaaaatatgaggtaaagggagaagcagcatgtgccctggcatggagatgcctaccaggacaatgagagggactctctctgcagctgtgataataaaggccagggtggaagagggaggaaggaacagccagttagccctaattgcagaatttggaattttgctctcgggcaatcatttctccatcacttccagggacactggtattgcttgtcagataactgatagctcactgccaatggggttctctcagctgggtagctcctgttctcccaccctctgtcctctgagtgtgaatagttttaaggactgagaaaccaaaagggaaaggagattgtgagcctcctgagggcaggtcctgtgcattataagaaactccatcaagagcctgccatgggccaggcattggacacatctcagggacccgtgggtgaacaaggcttcttaagcccccatggaggactaagactatggacaatatgagtgatctaaatggcatctcagtggtgtgagaagttgtttattagagaagtacagggtgccaatgggagggaaatctagccttggacccagaagatgcggaaggcttcacttccagcaaggtactgagtgcctgggagaaaactctgaacagtcccaagtctcagactaagcccagctctgtcagaaggccaggcagtggggatatggaccctggtggccaggctgccccagtccaatgggaagaccagcacccatgccctcaatattgtgtcacttccacctctatcccattcatcatgggtccacatcattgtccttagtgcaaacccttgaggaatcctctcttccactctctggttcactcagtggaatccctcctgctacctgtgccatcttcaccccatacccactgcacactgcgtctctaccagcctttccactgggaaccagtctacggtcaatggacaccgttccatcctaagccttttgcagaatgtgccatctgcctcacttactggccttggccttctctaagtaactcctaactcaagtggaagctgcccctctcctccactcctaccttagggtcagttgaagactgaacactctccttcagtctaactccaaatcccaggtcatacacacccctttgttcatttatttctttcccataaatcctgtcttagaagggcatctcttcaggttaggctctgccatcatcccccctgcacaacatttagcattctgtgaagcattgactcccggcaccatctttccaccctgagtctttatcctgaccaagatcaagatgactttgttatttataaccttggcaccttcattttttgacatgaaattcttgtggttttcaacagtatacgttctttcttagtcatttccaattgccttgtaaatgtagatacttctctagtatctaaattctcaagattcttttgctagtatccttaatttatcagacaacttggctactcccgagttagcacatctgtaccttggccccttgccacgttcttggaatgctatccgttcctgagatccaaactaatttcacaatttttatatatatatatatatatatattttttttttttttaatcaggaaagatactagctaaccagtgaatatctctatatagttgacttagtatccaatccaaacaaaacaaaagtcattttttttgttttttgttttccaaatagagcttcttctgcagcccctacggttttaacagtattactactcttccaggtctttgggttgaaaactttagaattatcttcattagcccaccatattgactcctttatttctataatatcttgaaatctttatttttcttattttcatcccaattgctcaagtgtagacactcaacatttttttcactggactcttatgatagtattcttgctggttcctttgctcctaagttttcagtcctccaattcattcaacccattattgctagagttctgttagctctcttatgggtaaagttctcattattttgataatgtcacttcaagtcaaccatttaatgactttaaaaatgacttgctaataaagttcaaatttttagcatttaaggacatttaaaagtctttagattctgattactccaactttccatcttttaaaaaaattattctttaagtgctgggatacatgggcagaacgtgcaggtttgttacataggtatacatgtgccatggtggtttgctgcacccatcatcctgtcatctacattaggtatttctcctaatgttatccctcccctagccctccaccccctgaagttcatgttccactgtgtgatgttcccctccttgtgtccacgtaatctcattgttgaactcccacttacgagtgagatcatgcgatgtttagttttctgttcctgtgttactttgctaagaattatggtttccagcttcacccatatccctgcaaaggacatgaactcatcctttttttatggcagcctgatattccatggtgtatgtgtgccacattttctttatccagtctatcattgatggacatttgagttggttccaagtttttgttgttgtgaatagagctgcaataaacatatgtgtgcaagtgtctttacagtagaaagatctataatcctttaggtatatatccggtaatgggattgtggggtcaaacggtatttgtggttctccatccttgaggaaatgccactctgtctttcacaatggttgaactaattcacacttctaccaacagggtaaaagcattcctatttctccacatcctctccagcatctgctgtttcctgactttttaatgatcaccattctaactgacatgatttgcatttctctaatgacgataagcttttttttaaaattttattattattatactttaagttttaggatacacgtgcacaacgcgcaggtttgttacatatgtatacatgtgccatgttggtgtgctgcacccattaactggtcatttagcattaggtatatcttctaatgctatcacttccccctcccttcaccccacaacaggcaccggtgtgtgatgttccccttcctgtgtccatgtgttctcattgttcaattcccacctatgagtgcgaacatgcggtgtttggttttttgtccttgcaatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacgtgtgtatgtgtctttagagcagcatgatttataatcctttgggtatataaccagtaatgggatggctgggtcaagtgatatttctagttctagatccctgaggaattgccacactgacttccacaatggttgaactagtttacagtcccaccaacagtgtaaaagtgttcctatttctccacattctctccagcacctgttgtttcctgactttttaatgatcgtcattctaactggtgtgagatggtatgtcattgtggttttgatttgcatttctctgatggccagtgatgatgagcattttttcatatgtcttttggctgcataaatgtcttcttttgagaagtgcctgttcatatcctttgcccactttttgatggggttgtgtgtttttttcttgtaaatttgtttgagttcattgtagattctggatattagccctttgtcagatgagtaggttgcaaaaattttctccccttctgtaggttgcctcttcactctgatggtagttactttggctgtgcagaagctctttagtttaattagatgccatttgtccattttggcttttgtcgccattgcttttggtgttttagacatgaagtccttgcccatgcctatgtcctgaatggtattgcctaggttttcttctacggtttttatggttttaggtctaacatgtaagtctttaatccatcttgaattaatttttgtgtaaggtgtaaggaagggatccagtttcagctttctacatatggctaagccagttttcccagcaccatttattaaataggcaatcctttccccattacttgtttttgtcaggtttgtcaaagatcagatagttgtagatatgtggcattatttctgagggctctgttctgttccattggtctatatctctgttttggtaccagtaccatgctgttttggttactgtagccttgtagtatagtttgaagtcaggtagcgttatgcctccagctttttcttttgtcttaggattgtcttggcaatgtgggctctttttttggttccatatgaactttaaagtagtttttttcaattctgtgaagaaagtcgttggtagcttgatggggatggcattgaatctataaattaccttgggcagtatggccattttcaagatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttgcctctctgtttgtctgttatttgtgtttaagaatgcttgcgatttttgcacattgattttgtatcctgagactttgctgaagttgcttatcagcttaagaagattttgggctgagacgatggggttttctagatatacaatcatgtcatctgcaaacagggacaatttgacttcctcttttcctaattgaataccatttgtttcctgctcctgtctgattgctctggccacaacttccaacactatgttgaataggagtggtgagagagggcatccctgtcttgtgccagttttcaaatggaatgcttccagttttttgccgattcagtgtgatactggctgtgggtttgtcatagatagctcttattattttgagataacgtcccatcaatacctaatttgttgagagtttttagcatgaagggttgttgaattttgtcaaaggccttttctgcatctattgagataatcatgtggtttttgtcgttggttctgtttatatgctggattacatttattgatttgcatatgttgaaccagccttgcatcccagggatgaagcccacttgatcatggtggataagcttcttgatgtactgctggatttggtttgccagtattttattgaggatttttgcattgatgttcaccagggatattggtctaaaattctcttttttggttgtgtctctgtccggctgtggtatcaggatgatgctggcctcctaaaataaattagggaggattgcctctttttctattgactggaatagtttcagaaggaatggtaccagttcctccttgtacctctggtagaatttggctgtgaatccttctggtcctggactgtttttggttggtaagctattaattattgcctcaatttcagggtctgttattggtctattcagagattcaacttcttcctagtttagtcttgggagggtgtgtgtgttgaggaatttatccatttcttctagattttctagtttatttgcatagaagtgtttatagtattctctgatggtagtttgtatttctgtgggatcggtggtgatatcccctttatcattttttattgtgtctatttgattcttctctcttttcttctttattagtcttgctagagttctaccaattttgttgatcttttcaaataaccagctcctggatttaatgattttttgaagagttttttgtgtctctatttccttgagttctgctctgatcttagttatttcttgccttctgctagcttttgaatatgtttgctcttgcttctctagttcttttaattgtgacattagggtgtcaattttagatctttcctgctttctcttgtggacatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagaggttttgagtgagtttcttaatcctgagttctagtttgattgcactgtggtctgagagacagtttgttataatttctgttcttttacatttgctgaggagtgttttacttccaattatgtggtcaattttggaataggtgtggtgtggtgctgaaaagaatgtatattctgttgatttggggtggagagttctgtagatgtctattaggtccgcttggtgcagaacttagttcaattcctggatatctttgttaactttctgtctcgttgatctgtctaatgttgacagtggggtggtaaagtctcccattattattgtgtgggagtctaagtctctttgtaggtttctaaggacttgctttatgaatctgcgtgctcttgtattgggtgcatatatatttaggatagttagctcttcttgttgaattgatccctttaccattatgtaatggccttctttgtctctttttatctttgttgttttaaagtctgttttatcagagactaggattgcaacccctgcctttttttgttttccatttgcttggtagatcttcctccatccctttattgtgagcctgtgtgtgtctctgcatttgagatgggtttcctgaatacagcacactgatgggtcttgactgtttatccaatttcccagtctgtgtcttttaactggagcatttagcccatttacatttcaggttaatattgttatctttgaatttgatcctgtcattatgatgttagctggttattttgctcattagtttatgccgtttcttcatagcatcgatggtctttacaattaggcatgtttttgcagtggctggtaccggttgttcctttccacatttagtgcttccttcaggagctcttttagggcaggcctggtggtgacaaaatctctcagcatttgcttgtctgtaaaggatttttatttctccttcacttatgaagcttagtttggctggatacgaaattctgtgttgaaaattcttttcttttagaatgttgaatattggcccccactctcttctggcttgtagagtttctgctgagagatcagctgttagtctgatgggcttccctttgtgggtaacctgacctttctctgtggctgcccttaacattttttccttatttccactttggtgaatctgacaattatgtgtcttggagttgctcttctcgaggactatctttgtggcattctctgtatttcctgaatttgaatgttggcctgccttgctagattggggaagttctcctggaaaatatcctgctgagtgttttccaacttggttcctttctccccatcactttcaggtacaccaatcagacatagatttggtcttttcacatagtcccatatttcttggaggcgttgttcatttctttttgttcttttatctctaaacttctcttctcacttcatttcattcatttgatcttccatcactgataccctttcttccagttgatcgaattggctactgaggcttgtgcattcatcacgtagttctcttgtcatggttttcagctccgtcaggtcctttaaggacttctctgcagtggttttctagttagacgttcatctaatttttttttcaaggtttttaacttctttgccatgggtgcaaacttcctcctttagctcaagtagtttgatcatctgcagtcttcttctgtcaacttgttaaagtcatctccatccagctttgttccattgctggtgaggagctgtgctcctttggaggaggagaggcactctgctttttagagtttccagtttttctgctctgttttttccccatctttgtggttttatctacctttggtctttgatgatggtgacatacagatgaggttttggtgtggatgtcctatctgtttgttagttttccttctaacagtcaggaaccccagctgcaggtctgttggagtttgctggaggtccactccagaccctgtttgcctgggtatcagcagtggaggctgcagaacagcagatattggtgaacagcaaatgttgctgcctgattgttcctctggaagttttgtctcagaggagtacctggccgtgtgaggtgtcagtctgcccctactggggggtgcctcccagttaggctactcgggggtcagggacccacttgaggaggcagtctgtccattatcagatctcaagctgcatgctgggagaaccattactctcttcaaagttgtcagacagggacatttaaatctgcagaggtttctgctgccttttgtttggctatgccctgcccccagaggtggagtctacagaggcaggcaggcctccttgagctgcagtgagctccacccagtttgagcttcctggctgctttgtttaccgtctcaagcctcagcaatggtgggcatccctcccccagcctcgctgctgctttgcagtttggtctcagactgctgtgctggcaatgagtgaggcccggtgggtgtcggatcctccgagccaggcgcaggatataatctcctggtgcgccgtttgctaagactgttggaaaagcatagtattagggtgggactgacccgattttccaggtgccgtctgtcacccctttctttgactaggaaagggaattccctgaccccttgcgcttcctgggtgaggcgatgccttgccctgcttcagctcatgcttggtgtgctgcacccactgtccaacactccccagtaagatgaacctggtaccttagttggaaatgcagaaatcacctgtcttctgcatcgctcacgctgggagctgtagactggagctgttcctatttggccatcttgctccacccccttattttttaaatagactactttaaaaaccaatgccagcacatgattattaactaaggcccataatttattcatacttccgtagtttttacctagtgtccttttctgtttcaagatctcatccagaactctgctttacatttacttgtaatgtttccttaggatcctgttggttatgacagtttctcagactttcctggtttttgatgaatgtgagaggtcaagtattttgtaggatgcccacctattggaatttctctgatttttttcttcatgactaaactgggcttattatttttagggaccacagacataaagcaccatttttatcacattataccaaggatatgtatgattaacatgatttattactgttgatgttgacactgatcacctgattgaggtagtatttgtcagacttctccattgtaaagttgcttcccttttcccttttccatatcgtactttttggaaggaaacctctttgtagagcccacacttagagagtggggagtatatgttccctccttgaggggagaatatatccataacttatttggaatttttctgcaagagaaatttgtcattttcttcatctttatttactctatcatttatttaaccagtatggatgtagggatttcttttttatattttgggttataatccagcatagttttattggtttaattgttccagccttgatcttgagagctatttaagttggctcctatatccctaacatagccacatcactgtgattttctgacttcctaaatcatttttttaaaattgatatgcattaaggtttacaccttgctctgtaaagtgctatgggttttagcaaatgcataatgtcatgtatccaccatcatagtattataaaggatagtttctttgacctaaaaatcccatgtttcaccaattcaactctctcctttacctttcatctttttactgtctccacagttttgtcttttgcagaatgtcatgtaattagaattatactttgtgtgtgtgtttgtgtgtgtgtggtgggaagaggctctccagttttggaaaggagggtgcagagaagaatttaagacttttgtattttaatttgacgaaaccttgagtgtggatttttttttaatctttacacttacacctgttatttgtacatttcttctgaatttttgtgtgtattttcttcagagtgtttagaattatggatgacgataataatcgaacccttgattttaaagaatttatgaaagggttaaatgattatgctgtggtcatggaaaaagaagaggtggaagaacttttccagaggtttgataaagatggaaatggaacaatagacttcaatgaatttcttctcacattaagagtaagtggccccattaatcagtgtatctgctgagtttggctttcacgtagtttgggttggctaccttgaggttttgtttttacaagttgttagtacactgtggggagggggataagcagaaaactgtgaacagacttaggaatttttggagcaattgtagtgtctattacataatagcacacaaatattatttcacatcgttgaggggaatgagatattttatcacataggataccaaaaaagctcatttgcttatgtatgtctctgtatgtattcttctatttttgtagcctccaatgtccagagccagaaaagaggtaatcatgcaagcttttagaaagttagacaagactggagatggtgttataacaatcgaagaccttcgtgaagtatataatgcaaaacaccacccaaagtaccagaatggggaatggagtgaggaacaagtatttaggaaatttctggataactttgattcaccctatgacaaagatggattggtaagtaaaagagcctaatctaggggaaatttcttcaattcgaaattgtaaatgggaaataggtccaaactcttaaaaatgttaacacattgataccatatttgttgtaaatagaagtaaactatttccctaggaacaatctagaaacttctccattgccaggggaaaccttcatgttactttagttgaaacctaatgtatgtttgtgcacgcacacactcatagacatatattgaaatatattggtaggggatccacataagtgatgacctgtcatctggggaatgtgatgttctgattaaacatgccattttatggttactatatttaccatactcagctagttgcactccagtgaactgattataataaaatatatttaactttgaaatgagatcataatttaattttggagaacagatttacaaggcctttcaggatgttttagcgccttcacactcatcctcattcatcttcacactttgctatgtggaaatgccatttaaaggtagtttttggtaaagggaatgtcaaataacagaatttactctgatttattctttagtgtgctttgagattaacttacatttctaaactgcactgaatttgaaaacaaaatcaaccgcccatctccattaacttttatcttcaagttacaaatgcatagcttggtagggtaaggaattatatagctccatgactgtgtctaggctgagatgaaaatgtcatctgtcctttatcaacagccctaaattgactttttagaaaaaaaaaaaaaccctgagccagttctgttcttagatgatctaagggttttggtgataaggaaaggggattgtcccttgagtaacagtcagcagcagcacagccccagggttcattgtctcttaagccctttacagcacaggaaaagataagtggcccagtggacaagaagagagtggttaagggaagaagaaataaaccttcctcttctgaagggaatgtgctccaactttttaaatgaaacttcatgatgagtctcattagcaaggggtgggggataggaaggtgacctttctgttcttcctgctgacatttccctttcagggatggagacataccctctatttcaggctgaggattgtggaggcaggtttacaaaagggccaaaattcaatagggcagccaaaatcttagggacagaaataaaaactacatgttttcttccagtattgctggccttgatcactgagatgtcagtggaaaaatagccaactgccatttccccaaattagcccacccctttgtggatcctagagtgtgtctgcttcctctctgcaggtggttcctcctcattgccaggggaaacctcagctacccttttctctaacaaaagtcaaaatagccagttgtgattcggctgattcaagtctgcacatcaccccttttgatatttatcttaagaagccacattaagctctcaaaagctcataaaggttattgaggtttttagcagttatagcacttgatgtcatctgcatgttacagaccctgtattgatacccaactctggctgttcataatcatcatcagggaggatttattagtaatgtagattcctagctgcactgcagaaccacagaatctgattttttggaggatggagtccaaggctttacattttaatgtataccagatgactcttacactcacgtgtatttgtgatccttagctctaaaagattcagaaataactgttttaaaattactaaatataatatacacatgaccccatttagcataataatgaatctgggcaacactttttgagcacatatcaactgggcatttgctaagggcttaccagggatatctcatttaatagacataataaaagtgtttctgaaaagtgatgtgtaattcaaactttcgcacactgaattgtattttaaatgcacaagaaattgttgttgtagaggaactccatggtaaattcttttatgagaagaataattagcttctaaaatttacctcttgcaaattgcactattttgcatattaagattgcttgtggtgaagcatagctgtacttgaagccagtgtgctcatttatggttaaaaacatcccatataagacaaaatttaaaataatgcaaaaaatttagcatagctcctagctaaaggtaatgttcaaacttgataatctaggttaaactctcaaatacccataaaggttgctggagtttcagcagtcacggaatttgatgtcataaatcttgcactaatacctcactggactcccatagcagccggaagccatttggatggaggtgtgaagcaatcagataacctgtgacacagactttccttaccccttttctatcactaaaccccaccacaatttggtgagacatttacttcttattctttaatatctaagttttgaattcttcatgtgtatatatgactttatcatcactatatttttaaaaagcctcttaggactttagaccttcagggaatatcagtctattgcctcatccatctcataaaaaatttttaaataattaaaaatatgttaggtatattactgagtgtatgtattaatagtaacctagatttgttttaggatttttctgatgaatttggagctgagaaaaagggcttgtattgtgacttccattacccccatctgggacctttccttgtatatatgatatatatcttgtcacataaaggtagcctagtcaagaggcctgctaaaagtaggagtgcccagtctctcatttttttctaatgtcaaataaaatgaataaggatagtgattattgctaaccaacaatttactatgatgagggcaaatttacaggagatcagagaatttgcgattcaggccattcccaatataagttgagtctcagaaaacaagcaaacacctagctaagagtaactgatggctttttctgaaatgatcaaatacattagctctgacctctggcttgacgtcatctgacttccaagtgaggtttaatgcttcctttatcttttgcccatcttggattccttctccattctccaacagagccaactcaactcaggtcaccccatcccactgggggagtttgggatggaaggatgggtgacgataccagtctcaatcatgtattggtgtttcagttagggtttgctttcaattgcaagaaataggaaatcttattatacactggaatacacaaattaggttttattttttattctacttgatgttctcacttgagtggcttaaagagagcagagctgaagtctttgtgattttcctggcctttccttcatgatctcaagatggttgcctaacttcagccagcacatctgagtttcaggcagcaggacaaaggagggagaaggagggaacgagaaagggctggagcctgcatcaggaaagcaaaggcttccctagaaattcatgtcaaatttcctttgtatcttattggtgagaactctattacttggccatcccaagctgaagctgcagaggagtctgggaaagtgagttttgagtttttcaacttctgtgggagagaaaagctagggataggattattacagtggatgtggagggagtctcactcaatggctgtcatccctggccaacaaacagacaatagaaacaataacaaactaaaaatatcgggagtttgataatttttaattaaaaaataattagctgtaaaaaatgttcctcaaactgtcatggtaaagtgcaccgtcaaaatggctcagggtctcgtgggtaactcttttagtttacttgctatttgctgtaaaatgatccacttactttgttggagtatttcaccagcctgcaactttttgaggactgagactttatcttaattatctttgatattcccagttaaattactgtagtgtgcacaacaattaactgggatgtttagatttttaagaagtaaattccacaaccacctgcttcagagattctgatttagcaggtgtggggtacagcctgtgggcctaggcttatgacagacaccccaggttgtcctgatgcaggtggtgtggacccacactgataaacatttccctggaacctcacacaacatgagaaagatagaaagagggcaataatgatgtgtgaaacttaatgtaatcccttaatgagggaattgaaaagcagaggctgaggaatccaaaggaggagaggaataaagaagttcaacaaagggggatgctaatggtatcctaattttgacagaggctctatgcatgtattgtagatgtgtatttacagttcaactatgagctgagttcaaatgcctttctttctactgcccttccttatgtttttagtgggaaggggtggtatgaaagacaactgtggatccagtgacttttcttttctggtcacttataatttcaataggaccagtgggtcagtcatctcttatgattcttggaaggcataggtatgtccccaaccgatcatgtcaaccaacatgattaaattagagtgtacatattatctagacctgttaaaaataagactaataactgtcttttctccttccccaaaggaaagtaatataaaatccccacacagataaacacattagtcaatatttcaaagagatggtcatgggtgtagagtggagagaagccaggatgggtgggaggcatgaagcaggggtaagctttttattcaccctgggccttgaatgagttatttatgtgttagaaaagcatgcaacccgggagcgtttaactagaaatctgtttcttcacccacaggagagaactccatttttggaaagggaaaacatcacttaccctgacacaaggacatgacatgttgtttctgacgtgtcacagaaagacagaaataactacagttgcagagcacttccttcttactctgagtttcagtctcccttacctgaaccgacgggctcccacccttagacaaaagatgacaacctatgcgtcactttccatttaggttggcttagaaactttcaagactttctttctctcttcctaggtgctgttctcacaccatcctcagcttcacttgttcttttgttttagatcagttcctcagccatgatcacatacacaaagaaatcctctatttcccttctatttacaggtgcacaaggtgggcgcccattgacagagtgagaagcaaagtttcgtttttgtttctaacttttccactgcaggtgacccctgaggagttcatgaactactatgcaggtgtgagcgcatccattgacactgatgtgtacttcatcatcatgatgagaaccgcctggaagctttaagcacatgacctggggaccaggccctgggacagccatgtggctccaaatgactaaatgtcagctcaaaaaccagaatcgtatttgatttcacactcatcctaatgtttttttctgtgtcaaaatattgcattttctggggccaaaaaacaggcagaaataaaagacattgagtagccaactgtgagtttgccttgcctaagactgtttcctttgttctaaaataggacttaaataaaatgagctctgtaaagctcctagtgctgtgctgatacatgcaggtgtctaatcaactttaggttttatcccttggccattaatgaaagcttgagtattttaattaaaaccctcacccatgcacccatagtttttcttcacctccttttagatgatccttttctaggtgagatgataatatatctctttttatgactgattgtaagtctttaagtgtttcagtctcatttggggaccagaagaagaccacgtgttagcctcaatttctacaagcaaatcttgagtttcactgcttagggtttagggaagccgcagtttgacaaatagattcaaaatgatttatttaatagtcattttaaagactggtgtgagtgaggaggctatttctttgagcagtagatccacgcctgttcatggtactcctgtggctgaagttttgaaactgggctgggcgctcagattttatctgggacatcttgcgctgtgtgtgggcaggctattccagaaagccttcacctggtggaatgtttatctctcccctctctgctttctgccaattgtgttgaaattcccaccagcaagggctgggtgcagtggctcacgcctgcaatcccagtactttgggaggctgaggtgggtggatcacctgaggtcaggagttcaaggccagcctgtccaacatggtgaaaaccctgtctctactaaaaataaaaaaattagctgggcatggtggcacatgcctgtaatctcagctactccagaggctgagacatgagaattgcttgaacccgggaggcagaggctgcaatgagctcagatcatgccactgcactgcactccagcctagagcaagactctgtctcaaacaaacaaacaaacaaacaaaaattcccaccagcacaaggaggttgggtgtgacacggactaggatttcaataatattccaaagcaggttttccatcttgatgcttcatggcttaacacctcctcctcccagcactaagctttggcttcatatcgttgatgtgtaggactctgcccatgaaaggctactagaagcaaagatagcccagaggctggaaaatagataagaaaactacagctctccttctgtgtcttctgtatctagggccagagataaaagcacagtgaccagcctctggttatggtgctggagacaatgcccacccaccttgctgctgggtgaaatacctccttttgactctgtccttagctgcactcatcccccagtttgcagacaggattgggttaatagtcttctttaagatcttatatacttaattggctctggatttagggattgaacacacttgccatattttgtatcaattcactgtttaggttttatttcatacacttggaagttgagattcggatatgtattaatttaaaacatgtgaaaaccagtgctgctacataggcattatagtagttattaagtaacttgttgagatgctcaactttttcttgaggatggtgtatccccgtattaccagaaactagttttgtttttgtttttgtttttttacttaattgcacaattgcacaagtttgattttgtattggatttattatctctgctcatatagaggttggttaggccaaagataccaagtgttatgaagaaatatgtagacttatgtagaaaaccagaagaaattgtgaagaaatgtatagaaaaaaatccatatatttttgcagcctgtgccttgtagactgtggctaaggagaggtcccctatttcctggggatgatgggtttcaaggcttttgctctagaaagattcttgtctttgattctgggtatgactcatgcctcagcttaactgaggctatagagtgagcatgtgattctgagcaaggaccaggttgcagctatcagcttagtcttctccagtgatactttgcttcctgtcaaatgggggcacagggcacagctatccaatttcagataacccatacttcatagtgtatttggtcacatttagttgcttctcttctagcggtttgggttctgggcccatgagcaaggttccaccaaggccctttcaccctctggaaacaaaatctgctaataacctaatggtcaagggtcactgcactccaattctcattctcctttatggcttctggcacagtcacgaattatgcattatttagctctactccttctagtaggagtgggaggaaaagagaagagacatttaaagaaatcatttgctaacactcttctggatatattttttgtttatttaacttacagattttaaagcttactccgtttacaatttaaaaaataagcccttagttcagaaggcaaaacacaataaaaagttgccaaaacatccctcaggaaaacctcacctgttgggtctggtcctcagatagaaaattaaacaagccaaagaaaagagaatgaaattagcaactttttatgaaacaagaatgatgtatgcaaacattctgagaatgagagtttgtcagaacaaaccacccataacaatactgaatttggatttctaacttgatcaaaggcaaacccatgcaagaatggccagagactctgactctctgctgctgtgcacatcatacttggattctattcacagtgcaaatgagaaacccagaatgtggaagctatgcaaactaaactgtagactgaggcagaattctttctgctggtctgtggggctggttttcacagtgatttaaactgtgataggatcttcccaggcacagatggcactttggaggaccatgtacttgttctgtatggtttgacagcaggcatggagtcacatttcataccgtaatcaagcttttcaaaggcagagctgggtgttctccaagtagctgcagattgacttggcatacatcatggcttgcaggtgtaaatacatcccatcaataaatatttattgagatacatgctttttttctaggccatggggacagagcagtgaactagaataattgcaagcaaaaccattggctttcaaaccaaactaacaacccacagttgttaagagatcaaagagggtagagagggagggaaagaacaggcacccaaattcccctcccagaatctcattcagcctctgaagtcaggacagttggagccctttctgtggcactgtgtcggggagtgacgtagtcaatttcatggacatagacagcctatcaagacaatgcaaggaaaatccctctctgtatttggaggcagataattgtgttggctctttaattttcttggccaaagtagattgtctcactgagccatgagagtacaagtaggtaacacttccattctcactaaactacctgcaagatgcagtctatgttgaagtttaatcaagtggagagatagaatttaccagatgtattcacagatggtgtgtgggggcccttctacctctgcttcatgaaattctattaaccttctctgagtagtataccttttttggatttatgcatatctgttttgttattgtttttatttattatttttttgatatggagtctcgctgtgtcacccaggctggagtgcagtggtgccatctcggctcactgcaatctccatctcccaggttcaaatgattctcctgtctcagcctccgagtaactgggattacagtcacctgtcactatacccagctaattttttgtatttttaggagagatggggttttaccacgttggccaggctagtctcgaatccctcacctcaggtgatttgcccacctcggcctcccacagtgctgggattataggcttgagccaccactcccgaccatgcatatctattttgagtacagaaatgaagaacctcatattttccaattcccaaactggtcaacagacttgctttcctggagattattgattgttcttttaaattaagatcctattgaatgaagcggtaaagttttaaatcctagaaatgcttatgactcaaaggaaaaacaaaagcatcaggagtctgacagattgtcatttaatgttattgagtttcgtgtaactgatccttttgaaagccaatgtttctcagcatgattttactcctccaagtcacttaaatgaaaactatgtaactttgatagagatagctagttcttttattctgaaaaaataaaacccacctagttaacccctaaaattatatgttctaaaacaggtgatgggtgagatatgttgaaagaaacataaacaaatgattgatgggggttctgagaacatcgctgtgtgagaagaattctttttgccatttcagctggtgtggtgacaggctgtggtgaaacagctcttcctctctgagaacagcatgaccttcttgtttaattctcacacctgcctcgccaaagccatatcttttcccctgagcaaagtatagtggaagaacctcctcaggagtgaagcccactgaaaatataagcaaccaaccagtagacaaggttttaatatggaccttgcaatgaccagaaaggtagagttcatcagggaaaaaaatctcaacacgtaatggcctttttttttcttttgtattagattttcttttgattcttcctaatggaatttatttattgtttctctggggtatttcaaaaatcctagcagccattgaacattgttgatgccatgtgagtttcaccgaagtccctgtgagcaccatgggcttccagctccatctcccagcactagaagtgtgatacttagctcaaacactccaaggatcacatccagctttacattatgccaccatataacagtcactcatttccaatttcattctgctccagaccctgtaataaatgtaccagggaccttgtgactcagagctcaagcactttaaatttgaagcaagaactgagtatatagtagtttattatcctgtgctcaaagacttggatcactttttcttttctgacctgaatacttggcattcagagcctgctattgacttgggaacatcttgatcttaaacttgaaaggtttgagttgctgaactcctggaaatgcttaggcgacatgtggaactgatgacaatccgcaacccgagagagccttagaacaggatgaggacccggaattgagagaaaatgacaaatggcggagtgacttgctccttccagagttatagtgagtctcagagtgcttcctgttgatgggataaagtgctacacaatcgcaggttattatcaaatgttagccattaccttactaaacccagctcactccttttgtttccaagggaactgggaaataaagccccttccacaaatgtcatacttagtcatgcttaaaatctcatttagcaatattactcaaaatccatttacttaagattattattgaagtggctaagtgtgtatagcaaatcaccacgaattcaggctctactaattgagatcatttagacagggtttgagtggaagtttacttgtattttatctgtaccagaaaaaagagaggatggaggttgttaaggaagtcagcaatgcaaagattataagggctgtgcctacataggccaagtacctgtaaaacatatacacattcatataaatatatttgcaatatattcatatatatcttacaggtacttggagctatttgtgtataaatataattagtatgctagtcataaaatgttttcgcataccttttaaaatagtcctaggttaattgttaattggcaatgatttattggacaactatagctcaagctgttttctagatagtgaagtgtttctattatgtaaatcctatcttgataatattttaaaatagaaattgaatatacattgaagctgaaaacaacattctgcgttataaggaaacattttcatgatattcatgacataaatttttaaatattttatttgaaaagctataggtgtttctagtggtaagctatacatgcattgaaagcaagaacttggcttaatagcaagagctggaatatcatttctagggacgaaaaattgaaaggttcttgagttacaaagttagatattatttaatttataataccagctttgtcattttttaaaattatcagacagcactttgccattaacttggttctaatttaatttaaggtttgaagcattagcaactattgtaacaaaagaggatatctggctgtgtgcagtggctcatgcctgcaatcccaccactttgggaggctgaggtgggtggatcacttgaggtcaggagttcaagaccagcctgacaaacatggtgaaactccgtctctactaaaaatacaaaattagctggaagtgttggtgcacacgtgtaatcccagctacttgggaggctgagaggcaggagaatcgcttgaacccaggaggcgcagattgcagtgagccgagattgcgccattgcacttcagcctaggcaagaagagcgaaactccgtctcaaaacaaaacaaaacaaaacaaaaaccaaaaacaaaataaaacaaaacaaaaacacatctagctatttcagttttaaagtgtttccaaaagatatttattcttgttagcaaacatgtaacatatcatgcttctttaaaagtatacttccttgacggtgcttttggatcatttaaaaatgttatttgtgtggtatttcagttacaggtgataacgtttcttctttgaaaattatgaggccctgttcacattgtactcgctcatgttcttaaaagagcaaaacataattactcataaaactattattttgacagccaagaatgaaagttccaacatttgatgttaatattactttcttgcagggatgaactacttccatctagcaggccaagcaagtttccagaatgcccagcttttgagtggtgcttctagatctgtggggaatagtatgactgtatatgctggtattaaggaattggggaggttaagagggaggagagagagatggaatttagaggctgattcctactctttgcatctttggtcttaacttcattgcctagtataggaagcacaagtccaaccttaaaatattaacacgtatcctggccaaattgagaagtgggtagagttggccttctagtacctcctatagggctggtacctctccactctgccactgaatgtcaggcatcatgtatttctgggtgcccaaggattctgggaagtacccattctctagttctattcctacctgtgtgtttggtgtagactccctttcactaaagcactttttatctgttcatttatgctataaatttctacaccctaaaatgctaataagtgtagtcttgtgtagtcacaagagtggttacacaatgtccattctagagcactgctgtcccacagaactttctgaaatgatggaattgctctatatctgtgttctccaatatgatggccactagccacatacggctaatagacatttgaaaagtggctagtgcaactgagaaactgaatttttcattatattttatgaatgcattcatattcattttatgaatgcattcataaaatataaaacatgaacagattcataaaatatattataaaatatattcataatatagattataaaaatatatttcataatctattttatgaatatattcataaaacaaaatatatatttataaacatgtatattttaaaatatatttgtaagtatatatattttaatcagtgtaaattcaaatagccacatgtggctagtggctaccatattggatagtacagtagagatctagaaatcttaatgtacaaagtgatggtcacaagggaactgtagctggccagtgagcaggtgaatctttggctacccttgcacatgtcccgtctcagtgagccacctcagcagggacaggcaagccaggctctccttgcctaactcgaacctgcttgacagtggcaaatgacactcaatagaaaatatcttggagaatgtaaaatgctccactataactcacatattttgacaccatttccttctttcttttcttgcctttttcttttcttcaggtttcaaaagaagaatttttgaattattatgcaggtgtcagtgcttctattgacaccgatgcctatttcattttgatgatgacaaaatcttggagattataattttgcctattaattcttttggaaatcagggactcccagagtggaataagtttgaaagaattccaagctatggatttggattaggtgtaaactaaatttcctaaaggatctggaattttaaaagcgataaatagatctttggtcatcttacttaattatctggaatgtgttcatttttatcaatgcctgagattatatttttaagtcatgaaggaaggaagaaggaaagaaggagagagagagaaaggaagaaagaaaaccatgaagtgatattgggaagtggctcctaggtaaaacaatctgcttgttgttatagatattcctcttataggtgtaaatgtagctgctccctcacaccttcactttacagtcttggaactccatagcagaaggtgataataccgggattagaggaacctctaactgtgtaaaatgtcctgaacttatttattttaattttggtgaatacaaataaaagaagatttattttattctgaaatgtatgagtgtttttcgattttcagatttgaatgtaaatttccacatgtgcataaacaggggacataagtgcctctggtaggaaaaggaaggtgagctcagctggcccacttggttgaaggctgggctttcatggcgtggtctcacttattggttcaacctattaggaggaaaggaagtgcaagggaaaaaggaagtgcctattgcaaacttcagaggctttctggagctttagcgtaaattggagaggaggactttaaacctgttttggggaattcatcgttttgaacccacttttaggctccttcgccagacaggtgatgtcaggtttttttgactgatttctctcctctattaactgcttcttaggtaacaaaagcagctctaatttgattgcacacacctataaaccgttcaccttggaaaaggggtaaaagtgtgggaaaatagatgaaaggtgaaagctgtgcttctcatgctttaatgagcacatagatcacttgttaacctgcccattgctttttagaagtctgggtgtgggactgaacttttgcctctaacaaacttattttttttaattttttttttgagatggagtcttgctctatcactcaggctggagtgcagtggcacgatctccgctcactgcaagctgtgcttcccaggttcacgccattctcctgcctctgcctcccgagtagctgggactacaggtgctagccaccacgcccggctaatttttttttttttttttttttgtatatttagtagagacggggtttcaccctgttagccaggatggtctctatcttatcttctgacctcgtgatctacccgcctcagcctcccaaagtgctgggattacaggcgtgagccaccacgcccagccaacctctagcaaacttctctatgatgttgatgcctctggcttcagataacacttttgagtagcgagcggtaaagtgatacctgcctgtatatttccagtgtgtttttcttattatttgcccacctttggctgaccataatagtttgtgctttttgattgctgggctatccctttgtctttaaagtcgggaacttatgaaagaaatagaaaaaaaaaaagtacctcccaggtatgtgtatatgtgtaggagagaaatgaaaaataacatttgcagttgaagaatttctcatagtctaggatggagtccttccagcatcaaagattcgaatctgtcagccctccaagagtagatccatctctttaagacctacgttgagtaagctcatagcaattgatgcaaaaactagaatgtcaagccactgatcaactataatgaggatatacttctcacgtttcctgataagatcaaagaacttgatctggatttgaggatgtgagagaatgac

SEQ ID NO: 1859 - DNA, 1011 bp, Homo sapiens
aaacttgagaaaaggcagaaccagagtagagattgacagtgagctgagccaatcaggctgtgaatctgcagcagtgatcccaggtcctccaattaatactaagagagtggaccagggcccctgaggaagacagatggcagggacagcgcgccatgaccgagagatggcgatccaggccaagaaaaagctcaccacggccaccgaccccattgaaagactccgactgcagtgcctggccaggggctctgctgggatcaaaggacttggcagagtgtttagaattatggatgacgataataatcgaacccttgattttaaagaatttatgaaagggttaaatgattatgctgtggtcatggaaaaagaagaggtggaagaacttttccagaggtttgataaagatggaaatggaacaatagacttcaatgaatttcttctcacattaagacctccaatgtccagagccagaaaagaggtaatcatgcaagcttttagaaagttagacaagactggagatggtgttataacaatcgaagaccttcgtgaagtatataatgcaaaacaccacccaaagtaccagaatggggaatggagtgaggaacaagtatttaggaaatttctggataactttgattcaccctatgacaaagatggattggtgacccctgaggagttcatgaactactatgcaggtgtgagcgcatccattgacactgatgtgtacttcatcatcatgatgagaaccgcctggaagctttaagcacatgacctggggaccaggccctgggacagccatgtggctccaaatgactaaatgtcagctcaaaaaccagaatcgtatttgatttcacactcatcctaatgtttttttctgtgtcaaaatattgcattttctggggccaaaaaacaggcagaaataaaagacattgagtagccaactgtgagtttgccttgcctaagactgtttcctttgttctaaaataggacttaaataaaatgagctctgtaaag

SEQ ID NO: 1860 - protein, 211 aa, Homo sapiens
GRQMAGTARHDREMAIQAKKKLTTATDPIERLRLQCLARGSAGIKGLGRVFRIMDDDNNRTLDFKEFMKGLNDYAVVMEKEEVEELFQRFDKDGNGTIDFNEFLLTLRPPMSRARKEVIMQAFRKLDKTGDGVITIEDLREVYNAKHHPKYQNGEWSEEQVFRKFLDNFDSPYDKDGLVTPEEFMNYYAGVSASIDTDVYFIIMMRTAWKL

SEQ ID NO: 1861 - DNA, 175338 bp, Mus musculus
  misc_feature (1)...(175338): n = A,T,C or G
atggaaagatttctttatttaaacattttctgttgcaataaaatccacttcattcattcattcattcattcattcattcattcattcatgtattcatttaaaagcctgtcaatacctatctcccataggccaacactattctagacccttccgattcaatggtgaaactacccgatcatgatactttcatttttggtagaaggttcactatgtccatgactatagctgctgctggaagggtagtcatcagtgccttgaaatagtttaaacaaaggccgggagacccttaatatggcttaataggaagaaatgtagaaggtcaagatttccttctacagagtatttgaaccaaggaactacttcaaattttaaattagtctgtctttgtttttaagaggaagatgaaattacaaaggatctgaaatcatgagcaaaaagattctacaaggcagaataaagaatgcaggtgagaggactgaggagttggctctatgggcagagagcttgttgcgcaagcctgaatatgtgagtctggaatcccagcacccacataaaaagttgagcacggtggttcatgccctttgaaataaaatgagtagttcttaattcctttcattttaaaaagatcaagtaaattgcatgttcctcttagccaattaatatgaggtataagagacaaaataagaaatgtatgtcgttttttaaaaaaattatttttcatttaaggagttgaactagagctagggccttgtgtatgctaagcacgtattctatcactcagctatgcccccactggaggagtggactttaagtgatcagctttgaaataaataaaagttagtcccacttgacctctatctgtatggatttacaagtttgcctgtaaatcatgccagcattttataggccgttgttttgggaacctttgctccttgttttaaatatcaacaattgtgttttaacattaccccagaactgaaatgacattcagcctttggtctaggagaacttgtcaatcacttctttcactctgttaaagtctgttttcatgttatcttgactttggaacttagatcagatagcaacaatgtccacaaaggcttgccttagcttagtattttgcagagctaaattttattgtgtgcttctgtgcataagagccttgaattagtaaatttaatagtcacaaaaactctatggggtaaatagtataattattcccgtttcacatatatgaaaacacaaaatagaactttaaaaaagcttccaaagtattacagctattaaatgatgaatccaagatccaactataatttcaatctacattctgaattataactttatatgggcttgtttccatggaaaccatacaagatcctgactaaccaggggttatattcttgttcctactggaagatctactgcaatgaaaattaactcattcaataagtatgctatgtagtattgaccaagataagcggatagtgcctctgtctttaaaggggacttccagctttacagtcttctatcagtttggttagggttagtctttttccttagaatctaatatttcctcagatgaagttaaaagatttttgtcttcaaatagaaatttatttagtttcctttttaagaattcaaaaatgaaaatgttgttacacataaagtgatgggcttcattatggcattttcatctgtatatgccattatatttgtcctgattcactttcctgtcccactaaccttctccaactggctcaattgcctcttgctggagaattctaagatgttaagcagaacaaacactgtaacttgggtgacattagaaaagtttactcttgctggggcaagtgctgtgttcaagcattaattttgtctggaaatttttactttgaccttgaccctatcccatcctgcccagcccatgcccttagttttggtttttagtccttaatcagaacagaaggtgctagtctctggtgcatttctttcaagatcttttctgacttgttttcctttttgtagcagactaatgggtccagcttagtataatttatcaaatcacagcgacactgtattagctggatcaggactagattcagtggagtgtaacaaaaaacctggatggtaggggctgaggtaaaatcacttttatttctttttcacattcaataatattgggggagagcactccaggattgacacagaggctccacaaagttgtcagagaccccacttatcttcactcattattgctctgtctgtaggcagtgactcttctgaaaagctccctgacactgtgtcttgacgtagttaggaggatggagaaaggtgtctctcttaccgttgaaggaagttttacctcatacccgactagatttcaatagacaaattgtgattagatggctacttttgctgcaaagaagattgagagtaaggttttagctgagttctaataggaacatgtagaaatgcaggcttgcaacatgaggtaatgggtatagagagtaaggttttagctgagttctaataggaacatgtagaaatgcaggcttgcaacatgaggtaatgggtatagagagacaatttttagtctccactacaggtaccttacatgtttcatggtcaataaaaattcacttgtggtattcttcaatagtgccatcagggtcattaataaacataagtaatctaagaattgctcctgtctttatttttatctcaccttatggtaatataattgtaaaataaacttatatggaaacatcttaggcaaaatggagaacatactgaaaagtacaaagaaactctagaaagagacaaacatacacaggtcaagaagacctggaaatgatgatccaagtgtaaaaacccatgttagtggtctcctcagtttccctcttttcactgactttattctgttgctgcagaacagttttcttcacctggtaaaaattacatccagtaacatctcttggatttgctatctagtaaggtctaagacctctctttcaagtccagaaatcctgtaggaaaggcttaattggatctgattggacaggtgtttacttcttgcccagtgaaccacagccaagggacaatcagcagtaacttggatattactcctggggccattgtgatggaaatatggaaataaaggaggcagcttctccattgggaagatgggtgttgtccacaatccacacacaattaaaaggtgtctacacatatgatttaaaaatacaggttgctggtccaaatagttagtaaggatatagacaaaattagtactggaaaagcactgcctaacaaggctgtattatacataatccttactgtgaattaggcattaagctttttaatatattgagtcattgactgttttacagctctacaaactattattattatccctttttacagatggcaaaatctgaatttaggattaaattcaggtcatatatgtaacttatacttgggttttgtgtgtgtgtgtgtgtgtgtgtgtgtgtgtgcatcgtgccaggagtcagcatttcctgtcttcctcagttactttccactttatttattttctggggtaggatctctcaatgaatcttgacctcactgttttcagctaccaagcaccagggttcttccagtctcagtttcctcagtgctttacagtttcctcagtgcatacaatcacggattctgaggattctgaggatccaaactcaagtcctcaattctacgtggctagcagtttaccaaatgagccatctccacagtccaagttttcaattaccaggatagtatactgcctcaatacagaatacagtccattatcttgagctagaaactatggtaatttttctttggtcctctccctgccccccacagctccctctcttttagtgtgtgtgtgtgtgtgtgtgtgtgtgtgtgtgtgtgtgtgtgtgtgtgtgtgtgtgtggtgtgtgtgtgtgtgtgtgtgtgtgtgagagagagagagagagagagagagagagagcaggttctctatataggctagactcaccaaggagctgaggttggcctggagcatgttgattttcttgaccaagctttcctaatgctggaggttgaaccaagagacttgtacatgttagcatgttaggaagcactccaagcaatcaatactctagtctaattactttcatttaaaatttttagggttacctataattgcattgtttctcctttccctttccttctttcaaaccttcccaagtattctttcccactctccttcaaattcatggcctcttttttcactaattgttattgcatatatatatatatatatatatatatatacacacacatatatatatatgcacataaaatatatgcatatatacatgtgtgtgtatacatatatactcctaaatataagccattgagtttgtataatgttctttgcatgtatgttttcaggactcaccatttggcactggacaaccaaatggtatgttctctctgggggaaacccacctttcttgatctgagctttcctcagtcgcttatagttctttgaggagagttcaagtctcaagagcttttcctgtgttcacttggcatgtccttgttcagttcatgtcacccttgttcagttcagatttggcatagtttctgatgttactaatagacacaatctcacatcaaacttcctgatcctttggcttttacagtctttccattccttcttccacagtgtttctttagctttagatacgggactgtttgatgtatgcattgggattgggttctacaactctctctgcaaattgattggctgtggttttctgtagtggtcttcatctgttgcaaacagaagtttccttgatgagatgtgaagactacaaatatctgtggattcaagggcagatgtttacagggtgtggctatggattatgctagcttagtaaattagtggttatagattctccactaataaccaggacttcatagctctaggtagttggctaggtttccattaccaggcatgttttccctcttgttgagtgggtggtaagtttgattagagagttgttggttactaccaaagtgcgcatgccactactgcacccttattgagccatgctggttattgatgtgggtcctaggcatcacagctgagtagaactgttgcttgcctccctcctttgggaccttttatgccttctggtactgtgaaagctagtactcagggaggggacattcaggtcagttccagctcaggagcctctggtcgctgtttctgaagtgaatctctgcctgcaggcaaccaaggatgacagaaataaggctatatgttttgggaatctctttgacagccctgaccaacaactcaaaagagatcttcttatgtctggtattgggaattttgttaggaggtctttggctcttagaaggaacatcattagccaggacagtccaacttttggctcccccttcctctttgagacagggtttctctgtgtagccctggctgtcctagaactcactctggagaccaggctggcctcaaactcacagggatttgcctgcttctgataccactgcctggctcagtccaatttttaaatgaaaattattatttttttaaaccttatatctgccataatgaagctggatgaatttgataaatcttataatcttaaatattaatctcttcatctaaagagactggattaaattaaattactttctcccatttatcaatagggataatatttcagaaggcagtaatgaaagctaatgttttaaaatttttcagtgcttactacatttttgagtgcttttaagctagtaatcctgtgttgaaactgtgatgaaattaaacacatacaaaaggaagtttctccctatagaggcatagagggacaagcaaatggcattattattgtgcagaattaagagttcagaaagtgggctggcaagatggctcagcaggtaagagcattgactgctcttccaaaggtcctgagttcaaatcccattaaccacatggtggctcacaaccatccgtaatgagatctgacgccctcttctggtgtgtctgaacacagctacagtgtatttacatataataaataaataaatcttaaaaaaaaaaaagagttcagaaagagtagccttcccaagtggtatgatcatcagctcaattgtatcttccagagttttcctgtctcgctgttacctttagtgtgttcatttcatggccagttcgtctgctgtcactgctgtctgcagcactttgctttataggctgactttcttcaaacctaggggaaagagaatcctctcccctaggtattgactgaaagtcttccttttggtctgatgggggctggtttactccaagagtataatgatattaaggtgattaattataatactttgggactattatgattctctcaaaaatcaacacagcataacttagattctaggtcacagtgtagtaaaaaatacagtcaaatctcagtggcttcaacatcaaagatagatcacttgctcaaattacgtgaaggagttggatgggttgcttcatggggtcctggcttgggaacctgaactcaaatgcttcaccatctttagcaatactagtctcactgcctatcgtggtgtgtgccttccagctacttggcaaggttaacaaggataatttagcaaaactttgtctcattgtagggtttactggaggtacctggagggaaaccaaaccaaagcaaaacccaaaacaataacaacaaaaacaaaaaaacagctggccagtgagatggctcagcaggtaaaggcacttgtcacccaggctgatgatctgagggacctacctcactgataaatggaaagaaaaaagagctgatcttccatcgacaggaatgctgctgtaacatgtgctgacctggtatacacacacacacacacacacacacacacacacacacacacacacaaatgtaataataattaaaaaacccactaatacagattttgaggctaagtgatagtaactactgtaaggacttatactgacaaatagctgtgcctaggagtggcatcacttctattgaccaatggtagaatggctatccctgtctcatagtttggcttaactacaaacaggatattgagggctggtgtgacctttttaatgtttgaaaggaaaggataaactttgcaattctctcctgttctgggaatagtagaatcaggttgagttgttctgaagtggttatctaaaaagatagcaagttaaagcaagaacaaacccatgaaactcttattatggggaaactgtagtggatagtacatcaatctataatatgaagtatatatggcttacacttgatgaagacaggcatttagctgtggaggcaagtcataagaggagaaagtcggcctagtttcatcagccttcaaatcagtcacttcatttactctcctgatgggaatggttagtgctagctttttaatgaggacttggctcaaaagtgacttaaaccacttactaaatttgaagatacagaccatttttcatatttctttttttgtagtccctgtttgtgttatcaaattcatagttttagaactagcaattaataacttatctagaataatttctttattttacagatgagaaagcaggaggtagtcaatgcataaaaatcgttattcaaggtcctatcttcttgtccacagtagcaactgtattatcctttttctgatttcctgaaaaatagaatatcgtagaggtgaaaaggcatataactactataaaacaaagaaaagtaaaagttatcaagaatgtttctagaactacattagttggtatacattggtagagatgcaatagttttaagttacttcttaagcagatgttgctgagtctcctgattcccccactctagtcataggagatacctcaaaggtttgattggagaattaaatggtggaagaaaagagtttaacatggggccttgttctcagcaatgttacacctccagtattatttttattataggcatagtaaaatggtagtaaatttcaaactagtttctacatgaatgttcaccacttaggaaatatgatagcattcaagttcattaactttgatctagctaatctctcaataaagtaaccactcatgtacctcactttcatttggatatttcccattatctaggagttgaccccttcacttctcacatccacacttctaactgatgactaagaattaaccccggctgaaccacagaagaaactaatgagctgctagggccctctcgttcttagtgtaacaggtgatgagaatgttgtgaagtttttttttttttttctttaaatttaaacttaaaaaaatttttttttcttgtgctgaacctgtctgtgattttgaggctaagtaaagataggctcatgacttcatttcagaagggaacagtgggggatgaggtgacatcccatcttgtgttaatgcaaatcagaagccagggactagagacccaagtgagcagctggagcgagaagagagagtgtgaggagtttcagccacagagtgggaggctgcagactatagagaaaacgccctcacaaggtgtgctctctgtgagtgatgtgtacaaccggttaacacttaactggcttgtggaagatttgagttacagagtccctttggagagaatagaagacatgtagtaatatatatatatattttcctttatagtgttggaggttgaatctaggatttgtagtatgctagacaaacactcccaaaactgagccttccttcccaattttttttggaatcaattagtcactactattatttgagacagggtctttctagctcactagatagtccaggctagactataacttaaaacaatcctttggcctcagctttccctcctcagtgctagaatcaggtatgcgtcgcagcaatcgatcgatttaagactgtagttttcaaagagctcagttagtattacttcttgtttgaattttccagaaattcattactggtctagaactgaatgtgaaaagatttgttcccacatatcagttgcttagctgatacttctaattctgggatggtaactatatcctgagcatggcctgaaggatctttgagagcagcgtactgtgacactgagcagagacctgaactgctgaagaactactttctcactgtatttcagagtcatcagtttggcgctttcttatatactatgctgttctataaagatgtactaagttcttcacaaatatttctagtggctttttcttaaatagaaagtaggtgggatgctttgattcctatagttttaatatttcctaggagataattaaagccagattaaaggagcagagagttcgaggcacacataaaactttgaatgtagagatcttcaagtactgcaaatggtagcgtgtgttaattaactagaaatggttcctctttttcccttgaatacattcaagccatacatccttgttaaagtgctttttaaatgctgtgctgaagcctcaaagtaaacattttacctctgactcctaaaaatgttccaggctgtgggtgtagcccaggagaaaacacacccttagcatgcacatactcacacaaaaggaaaaataattcagggttttgactgttgaaattttagcccttaatccatctaagtacagtataagcctaaattttgcttatttgcaacagagaactgagagtctcacggaagttatctacgcatttaataaatgactacagatttgttgaatgatgacacccaagctttttggctagatcataattctgacttcaccagagttttgtgtgaccttcaataagccacggtgttttctcagagagctttatttcgaagagacattaacccagtcacaggtccggaaaagcttctcagggtgcggagctcctgaaggcacaggcatttttttttttttcctttttaaaaagcactgtcctttgcattttagaaacacagttcctgatatagaataaacattgggaatttatgagagttattaggtaggttgcattcttggcaggctacgacctctttaatgtcttttctgtgtttttttgattactagcatataaaagggtggccctgtttactcagagatacgtttccaaagtatttactagtatttatctgtgctgggaggaataattgtcttgagggcagcttttctactcagtcacccggctgagtcctcaggcttgggatctggtccccaggctacagggaagagttcggcacgggaagctcatcttccggccctctgattggccagttcgcactccactcactggttttcccgctctgattggccccggcagcaccccttcggcccgcgactactttgtgtgccctggctgcgcggctgggtcctcccgcccagctcgccctcccggacggtctgtcggaggtagcccttcggcactcggctcagcatcgcgggcgtcaggatccccgagtgcgagcgggtaggaagcatcctagggaaaagcctctcctctcctgtactcaataaacttccgcctccgaagggctgaggcagcagcggctgcgaacggccgggcttcgaactcgggctctgcggggttctttctcttcagatgaagacagagcccgcagggtagccggaccgcccggagccgaggtggcactgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagctccgttaagcggcggccgcggttcctgtttccgtttcttcctctcccttcagtcgggagtagcatcctccaccccagcacccctcccactctcccgccgcggccagctgcagctggaggcagcggcggcggcgacgggggacggcgccgaccgcctcgctcccgcctcgggtaagggggcgttagggagccgggccccgcgcgccgcggactccaggacggggcgggcgcgggctctgtggagcctgggctcggggcgctccttcgtcctcccgccgataccgggcctgttgctgcaactgctgcagccgttgctcagccagcggccccgggaaaagtggggagggagcctccgggacaccccggcgtagccttggccccttgggtgaggggcgccgcggcgtcgggcatcccaggacctatgggatgggggcggggtgggaggtgtccctcagcgaatctctgcatctgccgctccttgcccccgcagccgggtccccacggtcagaccgtgggaaggtgggttcctttgctttgctttgctgtgtgggcttctggggctggaaatcagagtgaacctgcacaaagatgcgttctggctagtggctgaggcagggtagttaatggcctgggtgcctcggtatcccctccctttgatctgcgaatgacaagctggaggctgtggagtgtctcaacttatttgggaaggttaaatgagtcatatcagctcagcggaggtctgtcctgctggagttggggtggtttgtcggtagcagcacctgttctctggatgtgggctttgcaatcctcagagacgtaattcttaagttaaatggcactgtcatggttagggtttcgcaccctggtgagcttttagcgctttgccttaaacgtggaggccttggagaaaagcaaagaaagtagtgtttttccttgtgtctaattctgcacgttacttttaagaaaacgcaagaaggtgagcccaggaaaaccatatcctcccgtacctcccgtagatcactccgaacttaaaggtttcagggaacaaatgcaatggaagtttttatcaatttaagagttaaatttatcacaagtcactgacttaactttgcctttgctccgtagaaactcttaagaaggttttattttagttgtcttgttcttcctggggttaagtgcttatttattttcttggttaaagttctgtgtaatatgcatacttcttttaaagggtatatcatatataaagtattttaggggagaaattatatactgaagcaaagaagtaagatgcttcttttctttaaggcaacataggagtctctgacaatagtacgctcctgtacattgctgtccttctgataagaagtcttaattataaatacgacagtattttaacacacatatatatagcatttgaaattgcaggccgagtgaaaatgtagggaacaagagacgactaggctgtaagcatatgagggtggcttggaggtttgggttttcagtttgctgttataaatcgagaattctgtttgagttgaagagctgaacagctggaatgaaacttgcatagattgcaggaacgtgcagaaatgtctttgatcagatagtgagttaatatgaagggtgtcttgtgatctactaggagagtgattcaaaataacttaaatatgacacactacagattgtattttaaggatttttttaaaatctaaaagtcatttgaggttgttttctctgtaagtcagctgtatttgatatatatagaacggagaccaagacaatcattctgattctataatgtggtctttaaaaaaataaaatctaaataatttttttccaaaggagtaacagtgacctcaaaagtgatgaattttgaaattttctagtgtgtcacaaaatgtgtgtgtgtgtgtggtttttttttttttttttttttttttttttttaaaatgcagttattttaggttggtctggagggggagctagtgccaaagcaaagtgtagcttaatagctgtttgaactttttaaacatctaaccagatttttatgaccaggagaagtatacatttttttaattaaaacactagaggtattgatgtggacatagtaactgttcatagttatttgtggggtgtgtatattggatattagaaattagttttagaaatcgatcatgaataatgaaagcaggtgtttaagtgttttgagtttcttatctacaattctgaaaatgtgtactacaacttgaatgtgctgtagcatctcactcctctcaggcagtgcgttgatagtggactgtgctcctgaccctctgctcgtattgagtattcttgctttataaaatctgcactcccaaaaaggtaaaacaaaaagccaaaagataaaaagcttcaagcagagtcctggagagatagatatattcactgtgtagtgaattctctctgttaaaaccagataattttagtaaagaaatgttggatagttggacagcagtctcaaggtcattttgcagcctattatatgttgaatttgtttgaatatagaatagttatttttatgatgtgtgacattttgtttaatttctaaagtatatgggtttgatttgtgtctgatcactcacatgctctttaaatctacaaaaattgataatgatgtgtatttaaaaattattaaaatatttatttttttgagggtagtgatgagccttttgctattcacattcttaagtaaatagaaccttaccagtgctaattaaaaaaatagattcctttccattcagtggttgttattggtttactttataaattgcatttagtaaaagtatattggtttaattaaatgatagatgtgcccattttatagcatacttataaacctggaactattttgttttgcaaacacaagatttttaaaaagtcagtatgtttttttccttaaaaggaaacaaaagtaagattgtaaacatttgaaacaaaagccctgttctcggtgttactgcttatcttgtgcttttcagatgagtaggatgggagtaaggatcagtacagattccctgtggtcctcttactctttgacttacatttctctaccacaaagtagaatggattactgtttgaattgtttttaacttgtagcttattatagtgacagtcaaaagtgtttaaaggtaaacacatattttttacaactgatttttaaagagccttaaaatccccaacatactatagaattcatataatactgtacattttaaaaaataaaatatgggccaatagggccctgctatggaattaggccatgcatgtcagtttaagagttattcatgtatactacagaatgcatagtgataataggctaatttcatttaagttgcttttcagttttcttttgtgaggcagggtcttactctgtagccctggttggctggaagctaataggtatagctcaggctggccttgaactcatccttccatgttctagagttagagacatggaacattacacttttttttctccaagaagactttattgtcaaaacctaatagtcatgcattactacttaagacaataattcttggtgattttttttttttttggtcagaaaatgatattgtaagggggaaatatcacttaataagatgtcaactcttattaatacttagaactagaatgaatttgtctagagtatagacagcataaaccaatgggctatgggaatgtggcttagttggtagagtgcttgcctcatccgaatgaagtatcaggtttgatctttatcacatgcattgcataaaggggatgtggaggtaaaggaaggatggttagaagtttaagagtagctagggatgggaacattgtcttaaatcaacaaaaacaagtccagaaacaaacaaacaaaaaccttctgtcaagtgaaatataaaccatcaaactaaatgcataccaatgtttacaaatgacttcactttataattactttatatgtatttgatgcaattgataataaatttagattattgctaaagatggaaaatatggttaatagcttctctaccaaatccactgtcttttgtgtgtcttactgtgttgctcagctggccttgattttgctgtgatccttagcatcagacttttgagtgctgggattacagtcatgctctctctttatggtgttttttttttcctcttaggttcatagatttttttttccaggcaaaactttagttggtgtgttaaatagatttgttctaacttttttttnnnnnnnnnnnnnnnnnnnngtgacttgatttgaaaagggttatgcaatatgaactaaccagtacctccagagcttgtgtctctagctgcatttgtagcagaagatggcctagttggccatcatcggaaggagaggcctttggtcttgcgaagattatatgccccagtacaggggaatgccagggccaggaagcaggagttgggtgggttggggagcagggttggggggagggtataggggaactttcaggatagcatttgaaatgcaaatgaagaaaataatctaataataataataataataataataataaagaacatcaaaaaagaaaagaaaagggttatgggatggtgagtatgtatcttagtggtaactgtgcttaaagtcaaaaacaaagagaaggtagtatggcattagaaaggttgccagttgcattattgctttactttaaagcatgtctcttattttcctggaatgcattctcttgcctcttatgctatttctgtctgtgtgtagagctcctgattacaaggagccgcctttttaagaaaatgaattatttatctttgcatacctctttgcaataatatactgtaaaaagcaatacagaatatggagattcactgaagagaactcagtctaaaatgaacaacagtgttctttactcatgggagttcacaaggggaaagtgtcagataactggagccttaatcagataggatcagactggttcagtttgtctggccgtgtaagtagcaagtggtcatagttttgatgtcttctttgaatatttcattcattcacaaatcaagtgtcaaaagattgtaattttgagaaaacatactcaaaatcagctaacacgtagaaaatattttgctttcttttttaacataaggtttgatttttcctattccttcagaaagcttaacaaaattctagggcttaaggtggctattgaaattcttgaggtggaaaagtcccttccttgtccttggtaaattgattctcagaagcttcaggagtaaataaccccgactgcctcctcgtacagagttatagccctccgttactcaggtattagcacagtctgaccctgcatgtagattgtcaggtgtgggcacatgttacttttaatctgtaagtattctaggaatagtcatgttctcaatgctaagtatgtctactaaaaatggccagatgatatacagtcaagagcagttcctcttaattcaaaagatgctattagtgcttaactataatgacacaaggatataatggaaatgaaatcagcaaaaatgtccattttgtaacagagttagcagaccaggtgtcaggtaagactaattcctgtgacatctgtaactgcagaggactagagccaggcagataaatgataagtaatggtcttatcaagaatcatgtgcagatttactcagtatatgtttatacaatttctgttattgtctgcttccattgtaaacgaaagactagaaaacaagctacctattttgggatctggaaagggagatggacttatagaaaaagtatagaaaaaaactcgcttggttatttagggtcttggtctgtagtctcgctacacagaagataaacttgtgatcttcttacctttgcctcctgcctccccggtgctttgcttggtgcttgtactattgggatgcaccactgcactcagctatttattttaaaaagttaaaaaaaggaaaaatttcttcaagttttattgagatataattgactaataaaagtatatttaaagtacacacacacacacacacacacacacacatatatacttatgaaaagactagtacagtaaacttgacatgtcatgtcagataacaacctgtttatattgtaagaacatttatgatttctctcagcagatctcaggtgtgcatgacagtgatactaactatattcacgaagtgtgcattaaatctccagactgtatttgtcctgcataaaacatgctccagtggggactttgcactcttcagtcagcatctctccatttctcctttgctctgagtcctgggtaatcactgtctgctttctgcttctgtgagttttcctttttaaaatccccacatacaaatgagatcaccatgcagtgtttgcttcttagtactctgcttggttcactttgtactctgttctccgtgttcatctcaacaacattgtagaggaggcagaagtttagttatacttttagtaggcctgagaatgaaatgaacatgaactggatgcgtagaagaaatgcatatacatttatccaatgcaagtcttgtttactgactttccttgtaaggagaggaagataccatgacagagtggaacacttaagtggtcagtttgtagggtttgaaaaaagggttgagttgtatggggtggattagtaggtaagatatttttttaaccaactttgtttacaattctctttcttgctttcaactttccaactctgataagtatgttggcttgcttttttagtacaatgaaggcatttttcacttgggagtttcatctcctacttttaagattttttttttttttgtagttgtacctactgtgtttaaagtgccttttaactcaaaattgtcaatatactactaatggggtttcctttttaaatttttttaaaatttatttttatttatttatgtttgtgtgtaagagtgtctatagaagccagaaggcagcattggatcccctggagctagagttataggctgtgagctgttcagtgtgggtgttggagataaaactctgatcctctgaaagagcagtacgtgcttttaattgctgaagcacctttctgcacccatgatttgtaacttttaaagtctgactaaagtcctgttgtatgcatgtatgcatgtatgcatgctcatacatttggcctccacatgcatgagtttagcatagagaactgggttatagctcaggttgtctacttttgtctggcatttatgaggcttttgttcaatatcttaatattgcacaaacaaaacaataacatccctttccaacaaactgagagttaaaaatgtttgaaaataattggaacatgtagactttttcactaaacaatgtgttaactatttacaacagactgtatttagtattgtaagtaatccagagataatttaaagcatatagtagcaaagtataaagtagggttctgtgcatcctattacaagttatacacaaatactgtgtccttttatatgagtcctttgggcatctggttttagttattagtggtaggggctatcttagaactaatcacccatagatatgggcctcattttattttctctctctcttcttcctgtctcttcctctctccctctttctcttccttcctatctttttttttttttttgacagtctcactgggtaatcttccctggcctggagctctctatgtaggccaggctgacctcaagttcccagagatcaacgcctgcctctgcctctgcctctgcctctgcctctgcctctgcctctgcctctgcctctgcctctgcctctgcctctgcctctgcctctgcctctgcctcctgagtgctgggactaaaggggttggtaccaatccctactctgtgcaggtgactcacttatctattggtaattaccaatagataatcacctagattggttctgtattttggttgtcagagataatgaataagaggtacagagatctctttgacatactgattttattccctgtgtatgtgcacccagaattgggtcactggagcatatgttgtttctatgtttaagttttggaggaatcttgatataggtttctataatgactgtaccaattcacatggccaccagccagtgtaagaagggttttcttttcttcatattcttgtccagtcttgctatcttgtctgtatgtaagagttgttactcttatttatatggaatttgcttattaaatataaaaataacatagggttaacattcaggaagtcactcttttttttttggtttttcgagacagggtttctctgtagccctggctgtcctggaactcactttgtagaccagctggcctcgaactcagaaatccacctgcctctgcctcccaagtgctgggattaaaggtgtgagccaccatgcccagctcagggagttactcttaaaaattccttttttaaaaatttttttgaacagcgtctggctataaagtccagtcaagccatgaattcttgatacttttgccttagcctcctacttcatttattaaggacaagagacaccacacctggtttagtagttactctgaacaggtgtgaaattgtaggtttgatttgcatttcttcattgtgttctttttaaaaagtgcctatttaggttcttctgcctcctttttaaaattaggttatctgaattcctgatagtgagttgactttcgtatctactgtgttctttctcagtaattttattgttcatgcactttttttttaaaaagaaaaaacatcaaatatttgaagctaagtaagattacataagtctaggaagctgggcatgtgtatacctgtcagtattggagaggctgagacaggagggccagtgagaccctgcctcaaaaataaataaatagctgaacgaacgaatgaatgtacaaacttggaaaatgcagatttaaagccgttttgaaaatctgcttcactgttgctgtccctcattgtctttcctccgttctttttcccttcccaatccccttttttgttgctccttttctctctactttgtagtctaggctggctttgaacttgcagtcttcctatcccacttggccttcctgaccctcttgagtgctggggcccttttagtattttgagcttcagaggaaatcagatcctgatgttgtttccatgtttaaatgtgtgagcctttacttttgggcctctgtttttctgtcaatgaaatgaatcattttacttttttatgttattgtctggttttcaaagctaggtagataacctctgaccgttcacttgactgtatcttagttctgtaactactatcctatcctgagtaatattttaaaaaatgaggccatgcctgctaaggtcttaaagtttgtatctccctaaaatcacatgttgccatgttgaaacctgtcccatacattcatggtaataggaagtgtggaggctttgcaaagtaataggtgataaggtcagagctctctagaatgggattactgccaagggaatctattccttcttcccattaaagactttgatgggctggcaggatggctgaatgggtaaagtgcttgctttgtaagcccgagtttaaattggtgtagggagtagactaactcctgaaagtgatcctctgacttccacatgtgtgccttggcacacccattacatacccaccacttacacacattacctatcatacacacagtcgacgtcgccatcatgatcatcatcatccatctatgtaacagagcaggccctcaccagacatcagatctgagccttgatactggatttttttttattgccctgaattgatatcaatgaatttctattcttcatgaattactcagcatcaaatattttgttatagcatcctgaacaaactaagacatgttgtaaatgaggattcagcagtgaataaatttgaggctgcttgggataaccatgatgggcaatgggtattattttagttcatgtgtataacctttccctctcaccttttgagagggattttggcccagtttggccttatacgtactccttctgtccttgcttctgagtgctgggattgctggtgttcaccaccatgcttgagaatatggatattctggatatgaagatgagaaaaatgctgttttaatttttcctttggggataaaaggcaggatagaggaattttagctttcctttgtgccaacctgggctcaagtagtcaggtggaattgagctgtttaaacaaacaaacaaacaaacaaacatagctattgctggggaaatagcaacagcaatagacctagaggcagagctgataggtaacaatctggatcaaaactgtttatatagatgattaaaaaataggagtgtgtatgcatgtttatatatgtgtgcaagtgtgtcttaataggagtgaacaacagactcaagtaggctggtgtcaggtatgtgccaaaaagctaatgtacattttgtgtgcaatatgaataagagaggacattgaataacaactagtgaaatttaaacaccagaggtgcgataattattttcagatatttagtaatttgactcagaaacccttaggactttttgtattagctacaatagttgaaaatatggctataaaattattgaaatttattttacccaacattgtagaatacatgagtggtaacccacagagcacacctctgtggaggagggggttacagttatattttaatgacagtgttattatagtagcataagaaaaattgtttcatgctttatagtcatactttttactcagaagtgttatttctaagttaggtaaaccactttatgataaccagaaatattcccaaatcaaaacaatatttaatgtgtgaagatttgtcacttctgacagaattataagaaccatgttaagattcttaagcagctgaaaaaattggatcctgatgcttttaatagtgacagcattctaggaataagtgctgtgcttcctaaagggatgttctttttggtatatggcatgccagatttgttttaaaatgacctactgaagtgaataaatataaagtgttttaagtactcactgtgtaatcagaaaaacttaagtgaaaagtggagacccccatttctataattttcaggccttcaaaataacaaagaccccctgagtatagtcataacgctaggcctataatcctagcagataggagaccgagttaggatgattgagttccaggccgtctttagctacatagcgagagccaagggctaggaatactacagaagtcatagaacatttgtgtagcctacaaaggtcataaccgagtttaaccccagcacagaagagaaagacctatcatattttcccaagcaagttttgttttcagtagtaataaatgcataaaactattatgttacagccatttctaaatttacaattcctgttcttgatatatttctcccgaatacttgttataatagatgttgtgaattaaaatttttgttttgtttttgagacagtgtctcactatgtaaccaatgcagcccttgaaaccttaatcttcttgcctcagcttcccaactgctgggattaaagacatgcctcaccatatccagatttgtcaagttcctcctttctttatcctgcccctccctagctttttgtttttgtatgcttgttttgacagggtcttactactatgtagcctaggctgacctgagattctctatgtagaccaaactaattttggactcaaagatctctcagtgtctgcctcctaagtgctgggaataaaggcatgaaccatcacaccagcatcttccttcttatcacaggctggactcagacttattgtgtaggagaggataaaaagattgcctggaacttctgagttctgagtgttgagattactgtttatgccaagagtaattgtatgccaagctcattttatgataccaagcctagtttttgtggtgttgggatggaacccagggctttgcgtgtgttaggcaagcactctaataacggagctataatccctgttaagtgtttcatgagaaatcaaataggacttttatatgtatgcaaaataacaaagcaaaactagaatcacattaaagcagtagttttgtaacagcaaaaattagctgggacaatatacaatagaaaagaaacaatattgctaccgtaaatcagatatagaaaactgatttttaaagaataacaatcagattaaatacaccagggaaattgtgaacatgagatgaaaagtaagatgaaaattagagaatatgcttttagttaggacaagtggtactacacacctgtaatttcagcttctgaggcaggctgaggcaggaggatcatgaatttgaggtcagcctaggcaacaatgtgctgacctagactcagttactaagtgaagaagaaagatattgtaaaatactaacactggttagcagctctttcccactttttataaggttgtttcaaaccgtttttagtagcttgtcatagtgttgcaggcctttaatcccaggttttgggaagcagaggcaggaacagctagatccctgaatttgagccagcttagtctatatagtgagtttcaggccaaccagggctacctagtagtgagaccttgctaacaaacaaaaaagcaaaacaaaaaccaaaacacaacaaaaaagtaaaaccccaaaacaaaacaacccctcagatttttcaaaatatctgattctagtacactgcttttagatactgaagattgatccagttacctatttagttttttgagtaaagaggttaaagccatcctagttgcctgaccgaggggtgttccctttttaccttatggctatttatttatttatttatttgagattggagttttactctatacccctgctctcctggagtttgctttgtagactaggctggctcagaattcacagagatcttcctgcctatgccttcctgtgctggtattaaagatgtgagcatnnnnnnnnnnnnnnnnnnnntttgttttctctaaaaaatgtgtgtgatcctgcatgggtgtgtgtgcaccacatgcatgtgtgcaggagctctcagtggccaaaagtttgtattggatcccctggaactagacttagaggtggttgtgagctgtcatgttggtgctgggaactgaaccttggttttctgaaagagtaataagtgttcttaactactaagccatcttcccagccctctgtctctccaattaattccctttggaatggtacctgtctctttgcctttagtgagaacattatttttactttatattgttatattgttaagctcctgaattcagtttccatcctggaagtttgtcattccattaacctcaacatagttatatttgaattttctttgttttgaaatatattattcctcttagctttcctttctctattattgatttattcttgccattttccaaacttgaattctgagtcatctttgagtgactcagatattttctgaatgaataagaatactagaggcatcagatcttttctgttgtgaaacaatggtgtattctattactacagtgtttttctacttcatctgttcatttctgtctcatattttactataatgactcattctcattcccacttgcataaacaattatattttgataattactatgatagaaggagaaagggcagagaattttttattttagtgtatggagtatgtacttggtatatatgcatgcttgcagttatatgtacagaagtatgtgtggatgtttgtatgtttgggtgtgtatatagagaaccaagaatgacattgggaggtctttctcaatagctgtccaccttatatattaagtaagggtcaattattaacctgaagctctccattttgatcaacctggcagtcagcttgctccagggatcttctgtctataatttgtgtgctgggactatagggggctgccatgcccacctggcttctgtgaggtttctggagatccaactctgacccacacttgtgagataggaacttgaccaactgagactttacaccagccccttcaaactgtcttcagatattggttaatatcagtgaatgagcatgtaaacgcagagcaacacaaagtaagatatatcttattacctagtataagtagagtggcccagtgtaaaacagggaaaagtaagtgttgcctgctttgtaagctattttgaaggttcctcccagtgtaaaacagggaaaagtaagtgttgcctgctttgtaagctattttgaaggttcctgaatacttagagagtaaatctttaatgggcaactattctcagtctatttatgtgtgcttttctcttttacttctgtcttgtttctgtcacatatttgtgattgcaggggcggatactctctttatattaataaacattaatactcaataaataaactgaaggtcacagcaagaaaatagacaatttgttatttttcttccttagagaaacaaaacatttgatgtttttaaaataaaaagcattaaaaaacactttagaacagcaaaacaaaaagataatttatttgctacataagtaggaagaatagtgctttatacaggagcacccagatgaagacagacacctttagagttctctccatttcctggcttcattcctttctggtctcatttttgtgcttatgttagaaagctttggctatggaagagatgcataacttcagacagctgagtatttaaaaggtctggccctgggctcatcattgtaggaaattgtcctatccacattagcctatccgtagttcacttcatataaacctcagcaaaggcccctcctcttctacgacagggtgttaatgggtctacaactaatcaactgctgtgagtttgagtgcagcagtcatgttagacttgaccacttctcctcttcccttagatcttacattcttattgctccttcttccatgatgttacctaaatcttggagggatgatttagtgacatatatattaccctttgatatagtagctgaacattcagcaaacattattctcaatactttgactagtgatgagtctctgtagttcctgatgccaactgtgaaaagaaaaaattttgaccaaagagaacagcagccctatttgacttgtcggctttgctctagatctttttgtgttccttccctgccactgggaggtcttctgactttttattttttaaacttttagtctattatgtgattttgttgttgttggcattgtggttcttaaaggatttagttggtttttactttatttttacatcattgctgtttatttttattttctttttgtggtgctggagtttgcttctaggcctcaacaaatcttccattgaactacattcccagtctttattattcattacactttttctgtgtagcactggggattgaatctgatacatcaatcatgggtgtctgtccttcctctgaagtgtatgtctagtccagctaagagaaataacaactcacattgtccatgaccagcccaacttgagcttcattttcacatgaagaattgggaaaataaaactcctagctaatgacctagcctcaagtaaggatagctcgtgtcccgaatacctattactagactgtcagcctcatagcaaccatatggagatatgacacaaaaattgtggacactgtacctgggtgcagtgtaggttgctttcatcttaatcagacttcatattgctgacaagactggagggataaccacagagagtgtgtaccctattacacattttacagtgtaactgcctaaactatcggagagattccgtatttgttagaaagtgagttcttctgactctaggacaaggtcccgtgtcaaaatccactgactatagaataaagaagctacaatggaactacactataaagtccatctggaattatactcaacactacattttaaggcatgtaatcaagaggaaggtgttccttaaatatacccttatatgaaagtaggagtagataagggtaaagatctatatgctaaacttttctgtcttagtagaaatttctcaagtatttgggcaagatatggacatctaggcacagaaggcaggcagagccccaaacaatcatgaacccaaaagaagatgtcagattaaattgctgaaagtacacaaaatattaaagctacaggaagaagtactaaaacaaacctatcagaatattaacaaaattttcagcaaaatctaatggccaagaggccattttattctggtcctaaaagaaagtaatagccaacatagattactgtgtatagcatagttattgttcagaatcaaaggagaaataaggacctctcaagatggccaaaaagtatttatgatcactaagaccagcttacagaagatacttaaaggaaccctaaaccaggaaacaagcaaaataaacacattcatgagattgtgggaaataataaacttaaagagtagataaacagataaacaagtgcaaattagaaaacagtgaagcctctctgatgagtaaagtgtagtctctcctcccccagcctgaaacctgcttgctcaggggtggagcagacacagattatttgaaataactagaaaacaaacaaacaaaaaaccctatatgataggaactagcatgcaactttcaataataaccctggatgtaattggttttaattcactaaatgaaaggtgcaaggctagctgattggaattagaaacgaggcctgataaccaggcttgggaggtgagcaggttgctgtgagttctaggctagcctggtctacatagtgagtccatgatatccagggctatgcagagagattctgtctcaaaaccaaaccaaactgaaacaataaaacaaaaacaaggcctaacaatctgctgtttgcaataagttcatcttactggtaaatacatacacaggctgaaagtagaaagatggaaaatgatatcccaagccatacttgcatatgactaaacagactttgaacaaaaactgtacataacaaagcctactacatattaataaggaagcaatttattaagacaatataattgtcaatatatgtgcatcaatgttgaaacacctgattttatataacaaacactactatacataaatatatagagaaacaagtaaaataatagtgggtgattttagcatcccactcttctacatagatagatcatctgaccaaaagtcaagaaagaaacttcaggattaaattaaattatagattaaattcatcagcacattacaaacgatgcacactgatcaaattagtttattccagaaatgcaaagatgatttagcatacaaatcagtaaataaatggaatcaagaaagtcatttatcatttcaataaatctagaaaaagcctttggcaaaattaaatattctttcatgataagagatatgtagaagtatctgtaggagggtcatacttctatataataaaagcagtatatacctgacctataaacaacatcatcttggtggggaaaagcaaattattttttctaaaataagggatggattaagggagttcactttactacttgaaattttacccagatcagtcagacaagaaagaaaagtatgggctggagagatgctcagtggctaagagcattgttttgtttggtttgatttccaacaccacatggtggctcacaaccatccctaattccagttacagggtatccgatgccttctgacctctgtggataccaggcaaaccactcatatgcattaaataaagtaaataaaaattcttaaaaacagaaagtaacaaaacaaatataaatagaatagtaagaaatcaaatgatttctacttgcagataatgtaattatatacctagaagtccttgaacacttccagaagactcagatatcacaaatatttccagaaaaatagcagcttgtagaaccaacatatagaaagcagtcgctttcatactaataacaaactttctaaggaagaaatcaggaaaacaataccattctcagtagctgaaaacaaaaataaaacaattccctaatttaaaacaaacaaacaaacaaaatcaatctgcatgaataaaactatccaaagaggtgaaagacctctacaacataaaataaactgagaaagacacaggaaggtggaaagaccttaggagagttagtgttaaaatggtcatactattgaaagtgattacagttagtagaacttccaccacaactgtaatgacaactagaaaaccacaaaattatcacacaacgcaatcctgagccaaaagagaaatactaatgtaataccttgtttcaaagtatactacagatttacatttacaaaaccatgctggttttggcagaaaaattaacacagtccaatggaatagaagatctagaagtaaactcataccaacagctctagtcatcttgtcctctacagaggtgccaaatacagcctttggagaaatgatggcttcttcagcaaaggggctgggagaacttgagtatccacataagatttaaactgatctctgtcttatactttatacaaaaatgaactaaaagtggattaaagactgtaggcttagaattttcaatacctactttaataagggtttttaagtgcttcaacctttcttctagcccaccacccaccagaggtagtggaaaagaaaggttaataggaaacagttgtggacctgtttagaaatagttctttggggctattccaatcttcgttgtcagcagtccagtccactagcaaaacaccaacatgaacgcaatctagtccactaggcaatcaccactcatgaatcagcaatagcagttccatctaaaagaaactgaggctccaccaattgacctgagtctgtggaagaagcaggaagctgccagaatagcatgagacgttctttgtccagttactgtctacaaagtcacaacaagtgaagatcagcaaccctatacaaggtgaaccaatatgagagctcttcagactagcaaggcggagcaaggagaaccagtgccagagcctcccctccactgtctgtaggattgtatttatattctttctaaacatcacacatctgctcacctgtgtctgcctcagcaaaacatcacatgacattattgaatttccaaagaaaccagaaatttccacttcaaaggaccttcatctagaattccccaaatccgaacttgttaggaaaacaacaagaaccactcaccttaaggtatgacccaagtgatgacctcctgaatagaactccagcagcttaatatataacaagaattgacaagtggaagtgatatcaaattaagcaatctagttaataaatagaggacagacactgtaatcaaatgaaattgtaatgccatacttcaatggcattgaatatctgaaaaaccaataaatatgtggaaaagtgtgcttaacattttagccatcagggaaacacagattagaactacattttcatcctagttagaatattatctgtttttaaaaagcaaatatatatatatatatatataaatatatatatatagtctggaaagtggcttagttagtaaagtgcctgccatgacaacctgagttcagatttttggcacccatgaaaaaccaaaccaaatcaagccaagctgtcaaaccaagtcaaattaagccaagccaaaccaaattactggccagctaggctagcctggttcagtgagatgccaaacaacaacaacaacaacaacaacagcaacgacaacaacaacaacaacacccaaaccaaactggccagtcagtctagcctggttcagtgagatgccaaacaacaccaacacccaaaccaaaccaaactggccagttagtctaggttggttcaatgagatgctgtctcaaaagggggctggagatgtggctcagtggttaagagtacttgctcctcttggagagtatccaggttcagtacttagcattcacatggtggttcacaattgcctgtaactccagtttgaggggatttgagtctctcttttggcctccaagaacactaggcatgtgcgtggtgcacatatataaatgttacacataaagtaaaaatcttaaaaaaacaaaaagcctgatgtcagttcttacctccaaacacacaagtgtgtgcactgtgtccactctgtcctcaaccaattaaaaagataaaaaatattgaatgctagttaggatgtagaacccccaccccctaaaaaaaccaaccagcccttatacattcgtagaaatgtaaactgcttttacttctgtttctttgaatgttaattgcttaggaaacaaaaatataaaaatttatatcatttaatattttaaaatttactatagtataactaagaacgagataagattttttaaagtaacatcttaagtgtttactactgttttgattttaatttttttttttttttttgtttttcgagacagggtttctctgtgtagccctggctgtcctggcactcactttgtagaccagtctggcctcaaactcagaaatccgcctgcctctgcctcccgagtgctgggattaaaggcatgcgccaccacacccagcttgattttaattttaagggataagaagattattatattttctgtatttggatttctaaaggtcttaatttggacttgctatcccaaccaaagttgtcgccatataaagcctatgtcaaagaaagactgaaatatgtaatactgtgtagagtcttgaaaatgcagcttactcaaataagtacttgaatgagtcttagttgaaatccttagcttgcctgacctatatgaacctggaggacattgtgctaattgaaataagcaaggcatgaataaatactgcatgatatcatgtatgcatggaattggaagaagtgaaactcctagaggcagagtattaaaaaggtgtttagaggatagaggtggtagaaatggggagagttaaaaagtccataaagttttaggatcagttttggacatggaagtatggcattataatttcatttaattatagttgatgatgtatacttgaaaatggtttagagagcagcttttaagtattctttttcatttttttggtgtgtagtatatgcctgtctacatgtacatgcatttgtgtgcaagcatatgtgtgtgtgcacatgtgtgcctgtgtgtatgtgtgtacatgtgtgtgtgtatgcatgctctgatgctgcatgtggaggccagagcttgacatcaggatgtcttctccatcttattttttgaatagtatgtttactgaaccacgagcttaccattttagccagtctcagtggtgaattgagccatcaggattcctttgtctctaccccctccccctctctagtgctatggatacacagggacattgctgtgctcagcttttatgtggataccagttcctcaagtttgtacagcaagcactttatctactgagacatttcccccaccccttatatagtcttaatatgtataaaaatgtatctatgagatggatatattaactagtttaattatcctatttgtgcacatatgttaaggtatcatgttgtatatcatatatatgtgtagttttgttttgtaagggtccatgattcactgacaaatgataaccctggactgatacagtatgtaaatgtgaagagtgttttattctgcagaagtccagcatgctggggtctcccattaccaagacagagagaccaccaagtgagcttgcaggcctgatttaaagcacattaggggaattccagggtaggtgacctctatgttaatctgttgggtccatctctacgaactgccaacttgctgctgaggaagtctggaaactgctgcttgtccttgcctcaggccaggtagcagggcagtttctgaggcttggatttgcctggaattgcctggttcttgcttggaaacagagatttaggcctagtctccttaactgctaatttgaagcctgtcacggaatcagcctagctttctccgtttcctggcgtcagtggcatgtgaattcagctgcttgggaggctgaggtgggaggattgcttgagttcaagaatttgaggtcagcctgggcaatgcagtgagtcttcacttcattcctaccccaatcactgtctgtttacccttcctccattaaaaggtgtttttcttttgagatagggccttactcactatgtgtgtagtgcagcccagcttgaactcagtttcccaagtgctggggttacagatatgagccacaatgcccagcttgagaattttttgtcttcaacttttacattttatggcatttgtgattagtctattaagttacaagtaatagctgggcagtggtggcacacgcctttaatcccagcacttgggtggcagaggcaggtggatttctgagttcgaggccagcctgatctacagagtgagttccaggacagccagggctccacagagaaaccctgtctcaagccctcctccctcctccctccccacaaaagttacaagtaatagtgagaattttattagtgcatgtgaagaacaaataaggtactgtagcaaaatcaaggggtgagctaaattatggtccagctagatcacttattttaatgagagatgccttcctctgaatgtacctgagaagaaactttcttagttgtacaataatatataagtatgaaaatttatagttactgttttttagactcaggataacaaaactagaatcatattttattttttaaccaataatcatatcctttacttacagaggaagggtaaaattaaagtatcagcaaatgattcataaataagtgtatttatacagaattttcatggttgatttcttttttttttttttttttttgaggcagggtttctctgtatatctgtatagccctggctgtcctggagctcactttgtagaccaggctggcctcgaactcagaaatccgcctgcctctgcctcctgagtgctgggattaaaggcatgtgccaccatgcctggctatggttgattttttaatttagatggtatataaacaatttctagacttgtttattctatgtgtttgttttgcctacatgtatatgtaccatgtgcatgcctggtgttcttggaaatcagaagagggcatcagatccccttgaattagagttatagatggttgtgagccactatgcaggtgctgagaattgaacctaagtcctctgtaaaagcaacaaatcctcttaactgctgagttctctctccagcacctagatggttcacaacctcctactaagtccagttctagcttgtcagcaccctcttttggcctctttgggcattggcacacaattggtacactggcataaatgcatacaaaacactcatttacataagttaaatttaaaaagaaggaaattaaggtgcagtactggggaaatggcacagtgggtaagttctttagttctttgctgtggaagcatgaagacttgagtgctgagtgtggtggtgcatacctataacaacagctctaggagttggagcaaagacaagcagatcccataggcaagttagccagctagattagctgaaacagtgaactctagcttcagtgagagactgtgtcaccagataaggtgtagtcattgaggaggacatccctgcatcagcctccagcctccatatatgcctacacgagctagctagctcacatataggcatgaaaagaagatagagatcaaatacatgtgcacatgtgtacatggaacaccctcctatacaagtgcatatacccatacaaatgcaccacacaaacacacatacacatacatgcacacacacaaaaatgagtactatcaagttctgcaggttaagatcttttggcttgttaatatttgtatgtttaaggcttagtatagttcctgacacaaaatgtccactcagtaaatgctttttacaattagataatttcatgaaaaaaagatttgaaaagacgagatggaagttgaaaagactgttttctcaatttgagaaaaatttacaaaattccaatttaatataaattgaatttgagtacattttctactcaatgaattgaaaaactttgcataaatgttccttgcttatgagggcaatttgaaattttgtgtggtaaatgattctgaaaagatatcaagagtagtttagcttatgaaagaatttcatcccattaacaggctaagtgctataatattaaatgtggtcctctggcaaatagaattaactgtagtatatatttaaaaaacagagcctataaacatcattaaccagtagaaatgcaaattaaaataatgagataccattacctagctattcaaataccaatggtaaagaaacaggtaaatgaattctgacagtagcaagctggcaaagatagagcagctgatgagaacgcaaaattgcaccacagtgtggagagttccttacatagttgccatgtgaatcagcagtctcatggtaaatactcagatgagtatttactaaagagtaatggaacacatgttcacaattgcaaaaaactagaaaagtgcaaatgtcagtgcatgagtggataaattgtggtagatcatgcaatggaatacttcacaatgaaagacaaaactgtaacagtaccaacagatcttcggtactatagtttgattgtttttgtctcctgcaaacattagtgttgagattattccagggcaacagtactaaaaggtgggatctaatgggtattgcccttatgaataaagtaatgaccttaagagtttctggaagtaagtttgctccttctattctgctatgtgatagcacaatgtttgtctccttttgcccctttgccattcaccatgttagtatgtagcaaaaagtgccctcaccaagtattgaaacattttaaaagtttctatttttaaaattatgtgtatgtgtgtgtatgcatatatttatgtgagtataggtgtcttcagagaccagaggcattggatcccctggaactagaatgttataagctgcctgtgttgggagttgggtgttctgcaggggtagcctgcatacgttccaagccactgagccgtctctctagccaccaagcactgaattttaatcttggactcctgagcctcgagaactttgaagaatatgcttctgttttttataatttaccttcagagatagtggttacattagcacaaaatggactaaaattcccagtttagggtaggatgagttgtgtgactattcagagcataaggggttttttaaaaggttggtattaatgataaaactgttctgaactgatcgtgatgatacttactcaaatttacaaacattaaaagtcttagaactatatacttttgtttctctcccaaagctcattataccatatattaattttaaaaatagaatatatgcccataactaaatacatggtactttggtttatctatttttattagatatttccttcatttacattttaaatactatccccaagaccccctataccgccccccattcccgccctgatccccaacccacccactccaggttcctggccctggcattcccctttactggggaatatgatcttcacaagaccaagggcctctcctcccattgatggccgactcagccatcctccgttacataatacatggtactttaaaaggcattttgtattatttctgactaagcaaacttatgttagtactatctgatatacttttagcttgaaagaatttatatgaaaaatgactaatacatagaaaacctttggttcaagatcaggccttttcctgttgtccaaactggtcttgactttggactacagcagtacttcagcttcagcctcttgcacgctggaactatagtcctgtgccctaatatttgacctagaatacctttaaaatattactatgtatattaaaaaacaaatagattgatatgtggccattcaaacaattgacataaccatttagtgtaaaagttttgatggctaccttgtatatagctgcttcttttgcacaggtaataattaccatttattgaatgttcagtagacaacttgctaaacattcaaactactgttatcataattatggtgtgttattttctctgttacagatgtgaagcattgaagtattacttaacatgtttgttcacacagcaaaaatctgataggactggaagtttaagaatttcaaattgagaaatccttttttatttgtatttttataaaagcttttaaattataacataaagtacaaatacagagagcaaaatgaatatttacttcatgttttaaaagggaacacatttagaaaaccacccagaagttgtcagctcttccacagtttgctgtgtatcttatctcagtcataactgcttcattttccaagagtagacattgttttcatttttatggagatctgtatttttattgttcaagtgtgtgtcccttgacactgtggcttagttttacctttttctctttctttctttctttctttctttctttctttctttctttctttctttctttcttttttttttaaatttggtgtcttttgagctgttatctacgtgtttccctctcacctctctcttagtttccttttaattttgcttctcagctctgagcttacaggttttcacagactcaattttgctgattatatatgatagtataattcagcattcacctctgttttctgtatgctctaaagatttccagcttaatccagacttgatcataattgataggatctggcttgtaaaacctgaggaggcatttgatcatgggtgactttctgatgtaagagccattaattttttgtgacgttgcaaaatggtgatattctaaattatttcttctaagaaggatacttcccatagactactgtccttatttattgtattattggctagtaaaattgacaagagaataaatgttttcttcttcatttttatttaccaattttgaagataatgaatttattccctgaatctaaacctttgaaggtgttggatgctttgtttgcttgtcattgtttaatatcttattggcttacatagtcagacatatttagatttcagtgcactgccatttctatggctcgtgaagttcatcaagttccatttttgaacagtgaatatcttgaaaatgttctgaattctttcaacatgacagtacagtactcatctttgatagcattgtatgacaagttgctccaggattatgttgtacattttctgttgattctgtgaaaacagcaattcctccaaaaattcttagccatggagactattctatagtgggacactatttgaacaatatcctcaccagaaccatcagtgaaaagaaccttggtttggcttaaatatcactcagttataagtttctgtttcaagccactgttcagtgatctgcacttttgttgtccaaatatgtgtccctatatgctgtgccttagtcctggaaactttttaaaatttaaaaatatttgttgagtacatattagactgtgaatatcttttcaagcccatgatttgttctccctaggtggtttctaggtgctcactatgtagtgaaatgaataagatcctggctttgatagcgtaccttattcttctttatatgcgttgtgtaactttgagtataaagaatttaataggagctggagataattataaagtaattataaatataaataattatattttgtcaaatattataaacatacatgggtaaatatatatcatagtaattggtgggtgagaacaccttatcaacatggtatataacagtacttaactagtttgacaatatagatgtcgtgctccaaataagtgtagcattcatagctccatgtgttaataatttaaacaataaagtttaccaaattgactattaagcttcgtatttcgtattttttattttgtgttcccaagttgtaaatagacaaagttaaagatatgttttctccagcacattaaattaacttgtactgtagttttggcttgtaaacaacatagaattaactactattgtcagtgtggaaacccttttcctgctttattcacattacttaggaggtgagtggtatgctgtggaggaatgtcactttcctgtaggagccattgatttttcttgttgttcctaaatctgattctgctgcagaataactgcctttctgcaggggcaccatgctgctaacagtgtgaccctgctctcatgcggaatgagacagaaaacttatgaccatagcctggaattcataatataaaacacataaattcacaacacatatgctttcctgtatttttaaactgtggttaggaatagtttataaattacaatttggtaatttgtatgggctgggtgagggatagaattaccatttatacatttttttttcatgtaaagagagaggtcacaattagtcctgagtgagtttaggattaaatggtgacttgtctacttttatatttaaggatgttcagcttgccaaatgacaagcctgaaatttttgccttacatactagttttaaatcctcagctctgtcagtctcccctaactcttccattggggtcctagggctcagtctgatgtttggctgtgagtatctgcatctgtattggtcaggtgctggtagaacctttcagggaacagccataccaggctcctatcagcaagcacttcttggtatcagcaatagtttgggggtttggtgtctgtagatgggatggatccctaggtggggcagtctctggatggcctttccttcagtcttgtttgtttgtttgttttttggttttttgagacagagtttctctgtgtagccctggctgtcctggaactcactttgtagaccaggctgtcctggaactcagaaatccacctgcgtctgcctcccaagttctgggattaaaggtgtgtgccaccactgcccggcctttccttcagtctttgttccattttttgtccctgtctttcttttggacaggaacatttctgggttaaaaattttgagatgtgtggctggccccatccctctactagaggccatttttgttcaaacagtattgggatagacttttcagatttttcattcttaacacttcagtctattatcaatcaatcaatcaatctatctatctacctatctacctatcatctgtctatctatccaagatctgatatatttcagtccaggctgtccttaaatgtactgtgtgtcttgagaatgaccttacacttctgatcctcctgtctcacctcctgagtactggaattacaggtagataccaggtgattcctggtttgtttggtgttgaagttggcctcattcatgctaggtaagcattctgcactctaaccactctactactatatcttctgctctcttttgttattagcatgaagtactttctttctccatgaatattacttcctttgcctatttttccttgcaagaacaatgcaacttccattgatatatcacagtcactggaatattggtgctataagaaaagcaggaaacggaggggaacactgtcatcatcactgttctttgagactttctctcccattcacttttcctttaacaaggtggttcatagctacagagcactgatgccccagtactttttgtgtctaagccagggcagcgtaccctcatgctctatttaggttgacacatttccagtagaaaaattaattataataagcaggttcttatgggttacctccatcagtctgggtagtttcattcatatcatctgcggatacagtctcatctaatcctctctgaagtcagactgttgagatacttaaatagcctaagggccattagtcttataggatgcagttgtgactgtaataattagctttttttttttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttttgtgtttgctgggccccggcatagtctcacaagagacagctacatctgggtcctttcaataaaatcttgctagtgtatgcaatggtgtcagcgtttggatgctgattatggggtggatccctggctatggcagtctctacatgggccatcctttcatctcagctccaaactccgtctctgtaactccttccatgggtgttttgttcccaaatctaaggaggggcatagtgtccacacttcagtcttcattctccttgagtttcatgtgtttagcaaattatatcttatatcttgggtatcctaggtttggggctaatatccacatatcagtgaatacatattgtgtgagtttctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctaggttctttccagcttctggctattataaataaggctgctatgaacatagtggagcatgtgtccttcttacctgttggggcatcttctggatatatgcccaggagaggtattgctggatcctccggtagtactatgtccagttttctgaggaaccgccagactgatttccagagtggttgtacaagcctgaataattagctttttattttagataggtttacagctgttgctcccttatttttttccctcaaaaagggccaattttacttcagacagtttctttctgtcatctgttaatatgtaacttccccagaaatgtagatttctctttcttgaatgtgtggtttttctgttttcttttttagaataggacttatcatttctttagagatgaccatcagtggaccagttgctgtttttctcttcccattgaggaattgctcattgtaactcagtcatttttcttgctaacagtatgagcttgggctgtgtaagaaaggtagccgagcaagtcagggaagcagccagtaagaaaggttcctccacgagccctgcttcacttctagtctcagcttcccttttttctttccttctcatgttgcttttggtcacagtgtttatcatggcaacagaaaacaaactagaacaattttcagtgccgctcatgacaatcaagtgtggcatttcttcctaaatgaataacatcttgcatatttatttgttctgaacaagcatgagatcctgtgctgtggccttggtcataggtttttgctttttttccttagagaaactattcagtttataatactttgcctaatgggatgttttctttgtattgtcttcttttttaaatgtatatattaatttttgcatttaaatgagtgtattatgatgtttgaatactgacagagtcgaatgaatatctacctttttttttttttgagaggaaagagtttatcttatatcttacagtacatgatgaatggtagtcagaacaggtaatcaaacatgaacttggaggcaggaactgaagaagagctcatgaaggaatagaattactatcttgtgcagactgatttcttattccagctgctcagggatggcacttgcaatgtaaatcgtcagtcaagaaaatactcaatgatcttttgcctactagataatctcatggagacattttcttaactgaagtttcctttttcagttttactcctgttagactatatttgataaaaaaaaacaaagaaagagcaaaagaaagaaagaagacagacagaggaacaaaaagaaagaaggaatgaaagaaagaaaggaaggaaagaaagattttctcaaagaaccagctcctggtttggttgatttgtttgtttgtttagttctttttgtttctatttggttgatttcagatctgagtttgattatttcctgctgtctactcctcttgggtgaatttgcttccttttgttctagagctttcaggtgtgctgtcaagctgctagtgtgtgctctctccagtttctttttggaggcactcagagctatgagttttcctcttaccactgcattcattgtgtcccataagtttgggtatgttgtagcttcattttcattaaattctaaaaagtctttaatttctttatttcttccttgaccaagttatttagtagggtgttgttcagctaccatatgtatgtgggctttctgttgtttttgttgttataaagactagccttagtctgtggtgatctgataggatgcatgcgattatttcgatcttcttgtatctgttgaggcctgatttgtgaccagtaatatggtaaattttggagaaagtagcatgaggtgctgaaaagaaggtatattcttttgctttaggatgaaatgttctatagatatctgctagatatctatagatggcccatcacttctgttagtctcactgtgtctctgtttagtttgcgtttctatgatctgtccattgatgagagtggggtgttgaagtctcccactattattgtgtgtggtgctttgagtttcagtaaagtttcttttatgaatgtgggtgccctttcatttggagtatagatattcagaattgagaatgcttcttggtagatttttcctttgatgagaatgaagtatccttccttattctattttttgataacctttgattgaaagttgattttatttgatactagaatgaatggctactccagcttgtttcttgggaccatttgcttggaaaattgttttcaagccctttactctgaggtagtgtctgtttttgacactgaggtacatttcctgtatgcagcaaaattctgggtcctacttatatatccagtctgttagtccatgtctttttattagagaattgagtcctttgatgttaagagatattaaggaaaagtgattgttactttctactatttttgttgttagaggtggaattatgtttgtgtggctaccttcttttgggtttgttgaaagaagattactttcttgctttttctagggtgtagtttccctccttgtgttggagttttttgtctgttatcctttgtagggctggatttgtgaaaagatattgtgtaaatttggttttgtcatggaatatattgttttcactgtctatggtaattgagagttttgcctggactgatatttgtgttctctcagggtctgtatgagatctgcctaagatcttctagctttcacagtctcttgtgagaagtctggtttaattctgagaggtctgcctttatatgttacttgaccttttccccttactgcttttaatatcctttctttgttttgcgcatttggtgttttgattattatgtgatgggaggaatttcttttctggtccagtctatttggagttctgtaggcttcttgtatgttcatgggcatctctttctttaggttagggaagttttcttctataattttgttgaagatatttattgaccctttaagttggtaatcttctataccctaattatctataccctaattatctttagatttggtcttctcatcgtgtcctggatttcctgaatgttttgagttaggagctttttgcattttgtgttttctttgactgttctgttgatgttttctatggtattttctgtacctgatctctcttctaactcttgtattttgttggtgatgcttgcatctatgactcctgatctctttcctaggttttcatgtcccaggtagtctccctttgtgattctttattgattctattttcattattagatcttggatggttttgttcaattccttcacctgtttggttgtgttttcctgtatttctttaaggagttatctatgtctttcttaaagtcctctatcatcatcatgacatgtgactttaaatcagagccttgtttttctggtgtgtcggggtatccagggcccactgtggtggaagaactgggtatgatgatgccaagtaaccttggtttctgttgcttatgttttcccccttgcctctggccatctggttatctctggtgttagctagtgttgctgtctctgactgtggcttgtgcctcctgcaagcctgtgtgtgagtactcctgggtgaccagttctctcctggaggttatttgggcatggagtgctgtggcacaggatcagctcccttgtattgcctttttattattgtttactgctcagtattccttgcacaatgatgatatttgcttatttttcaaattattttttttgtcactcatatctgggttttgtttctaatgtgatattttttggattcacatgattcttatttcagtgatttctacaatgtagttttctgtgatggtctccttttgctctaaagaagagctttgatgatgagtggtaatcacacttatctgtgggtaagggtactatttagaatgtagttagaaatttactggtagtgatagtagattattttataaggtttatgactttactagctttggtagtttggttgatttctagtacccagcattaagtcctgaaaagcaggtaataaatgaagggagcctatgcttgctctagctactgtactatattgtacttaatatgtctatgaagaagctttctgactctgaggaataaccaccccaaaggaatttagggaataagataaaaccttgagatcatatagtctaagattaggaccttagcccgccagtcagaatagaaaactataattaccaagtatctggtagagcatctctgtcatttttgtgtattcctagttcatttgggtcttttcttctctgtatctttactaatatatctactctctcttttgacttcaagattatgaatatatgtataataactttagtgtcttagttttctaattctatctactatcaactctaggttggtattgattggttttctctcacttagggagaaaattggactttcattagattttagaaattgtcttcataatttaaaaaattgcttagtagtcaactgttgtttagtaagcattaaaaaagagattataaactttattttgttggttgttatgtaatttcttcttcttttttgttttttttttgttttttgttttttttttttgtttttttgagacagggtttctctgtgtaaccctggctctcctggaactcactttgtagaccaggctggcctcgaactcagaaatccgcctgcttctgactcccgagctctgggattaaaggcgtgtggtaccatgcccggctctggcataatttcttattcctataaatacttgtgagtttttctgggatgttgtcagattctggagttttctgtctcaggtacaggttttagtctttctttagaaggtcatacaagctaagattggctccactgctgggtcacgatcttgctgaattctttaccatatggccacgagttagagatctttccttttggttggtggttatgggtattagattgaggattaggattacccccaaggctcatgtctcctgggattattatagaacagcctttatttgtgggccagtcaacatataatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttgtgttctgtttgaatatgtctttagtggtttgtagaacatgtctcaacataaagcaagatgcttacagagactggttgtttcaatttttcaagaactatagatcacactaattttttgttcaagatctggaaaggggcaaatatatataactttgtagctttttatcgtcagtaggtaaatctggtactagttactacacagtggcaataggtgtaaaacctacatgatccaattattgtggaaagttggcaataacttttaggtgaagttttaggaaagaattatagtgaacctagggagattttagatttcatatttatgaataaattgtacatttatgctttttcagattgtttgtcctcttcttgatctactagatgagataatgtaaataacagtgtggtgtacaaaagaattttgtgtttaggacaatttattgaatgttcttatagttttccctcagaaccttgaattttacttttggaaattaaagtaaaaataattggtatcttgattgcacagttctaatagccaaaaattggtttcagtgaggaaaaaaaattatagttaataatgtcaatcctacttctcacaattaatgtcatttaaagaataatcatgttatagcataatagttgggcaactgagagaaagatattgtcacaaattgtagtgtcactgtttttttttgtactcagtgacttgtacatatatatgcagtgaatatttaatatgtgaatagttactaaaattattttatttgtttatgaaccatactgattccttaccatatgtcaaacgtaataatgatgaagagccagcagcaaagacgtagtaaatagattccctaattagaagattatataagcttatatatgtaatacatatgtgaagtaagcatatgaatatggcggcaaatagtctaggaaagattaatggggggttggggatttggctcagtggtagagcacttgcctagcaagtgcaaggccctgggttcagtccttagctcttaaaaaaaaaaaaaataatggaatacagaattctgaagtcagttttaagaaagctgacttacatagtttaattgacaataagtgaaaaaaaatgtaggtgttcatcaggttatggctcagcagtggagcaaatcttagctcatatatagagggtcacttctgtatagaaagactaaaagcagtacctgagagagaaaattccaaataatatgaacacttcccagaagaattcagcattaatacgtgtatgaagttatttaacactcgacaaagtaaaatttacaatgtcttcttttatacttcaagaatgctcacagaatggtgacagttgggataataaaattgttctgtgtcaagccagcagattaaattagttggaatggaagtcctgtgtagaaggaggaagaaacaaagatgtagagctaacttgttgggttgttccggatgtagattttgaggtctgaactggaaaggaatgtttgtgactgggaagggaccattgggactgattgttttgggatggaatatgaagcaaattaagacaatgagtgcaactgagtttggatgtagtttgcaaaatgaaagtccatttcttcttggcacttgtaaaattgtggctgcaaaatacaggcatttacttattatgacttccacatgaaagtaaataaaaaactaagaagtataatgacattaagtggaatcttgaggagggtgaactaatttactttcctttgtttcaggttgctgttctggctgaggccatctatggccctggtagtgttttcattcaagacaaagtccattccatctttatttattagctgagcaaattcaggtcagtatatttttgtttccatttgaatattttgagatgattttgttttttaaagctatgtgtctatgtaccaatggagtacagtaccaattgtccacattagtccaaactagtaaattgtgcattaattgggaaatattttctgtctgcctaccgagtataatattttcttcataaagtcatagcatgttacttcttaatggctttgattttcaagttttgaatttgatagaacaagttgtgaccacattttttatgttgagctggttgtgtggcatagttggtaacgagaataaactcactttagaaacttatgatgtcttagtagctcttctaaaacttgtccacacatgaacattaaatcatatattaacatctctactattaatattaattctaagaggattggcatccatatttatcacttcaattaaaacagttctacaggctttttacttttagttaaggctgccccccttcaccacgaccagtagcaatgtgcatctgttttctgctaacgtggtttacctttcatagtatgctgcttatatggaattatctagtattcagcttttggaatctgcttctgttacttactataatgcatttgtgtggtattcatgtttctgtgtgtatcagtatttgcttttcagttgtatagtagactcccagtatgtgggattaccacagtcagtttatggacatttggattgtttcaagtttggggtgataataaagcttctatagttttgcattaaaaaaaataacatggcttcatattctttattaaaataactttttgttgttaaaagagattgtattgatttaattaatcgtcactgttttggggactagggttgcgtttcttttaaaaactgttccatgctctctccagttctaggtattggagcattcaagaaaggtcttggcctagcccttttttttgtttgtttttgagacagggatttgctgtacaatcagactgtcctgaactcatgggtttcctgcctccaccttctgattgctaggatcagaagcatgtgtaccaccatgtctgccactacaggctttcagtgttattaaaaagaaatcagaaaaaaaattaataatagagtagagggagagtcctttaacttactgtcatgtgtatgtttattaagagaagacatgtccagttgttaaaagtagatggtagcagaacttgcagtgtttcttgagtgcagtattagatcaggcatgtgtaggaagaacaagcctaaagtttccagtttataaaagtcaaataaattataagtatttttcctgatcttaaaattttagttaaagaggacagaaatttagtatggaaaggttaaatagaatttttctgaatgaacatttgaaatgaaagggaatgaaacagtcctatttatggaaattaatggtctcaaaaatagcttgaaaagctacttggatatttgtaagaaagttgttctttatttgctgtagatataaaaagatcttgagaaaatgtaatgctctgtgtcagagaatgctcatgttgcttggtagagattcctgctgttactctgggcacggtaagtgctgctgaacctttacactgttgtcattcctaaatatttttagatgatgtacacacatgctattacttatattgtgttatcatagaatgtttcttctttcctttgagagagtttgtgtatgcatgtgtatatttatgccatttgtggcatagtaggagtgtagaggtcaaaggccaccttgaggtgctcttgttttactgtgtaggtcctggggctttaactcaggttatcaggtttggcagcaagcccctttgcccactcagccatcttgttttaaataggtaaagtgtcttagtgcagtcagagcactttagacattctttttttgtttgtttgtttgtttgtttgttttttgagacagggtttctctgtatagccctggctgtcctagaactcactttgtagaccaggctggcctcgaactcagaaatccacctgcctctgtctcccaagtgctgggattaaaggcgtgtgccaccactgcccggccactttagacattcttttgacatagaatacaggttcattatccctcacattagaatctgagattcagtataccaagatctgaaaccagcatgacaacatgagtgaaaaattccacaacttacttcatgcgacaggtcaaacaaaaacagatgtattaaaaatactaacatggcataggatcagagtgaggaggacataacatctgttccaaaaccatcgggagtaactgggaccagtggtatccagggatgcaggaaccacgcctgaccagtggttcgggttccttttggtctgcgctggtttactttgggcacaaactctgcagccagtcccacaaaaccatgagaaaagcttcactcccaggcactctaacacgcccaggatcccgggatcccaggagcttggtcacacaaggatctcagagtcccagaggcagcttgactcccaggaactctgacacactcaggatctcaggatcacaggatcctggaatcacaggatcctggaatcacagagacagctggactctgaggagtttcaatacaaccaggataacaggaaggacaggctccagtcagatatagcaagggcaggtagcactagagataatcagatggtagaaggcaagcataagagcacaagcaacagaaactaaggttacttggcattatcagaaccaaattctcccaccgtagcaagtccaggatataccatcataccagaaaagcaagactcgaatctaaaatcacttctcatgatgatgatagaggactttaagaaggatataaataactccttaaagaaatacaggagaacacaggtaaacaggcagaagcccttaaagaggaaacacaaacacacaaatcccttaaagaatgacaggaaaacacaatcaaataggcaaaggaaatgaacaaaaccatccaagatctaaaaagagaaatagaaacaataaagaagatacaaaaggagacagccctggagttagaaaacctaggaaagagatcaggagttatagatgcaagcatcgccaacagaatacaagagatagaagagagaatctcaggtgcagaaaataccataaaaaacatcaacagaacagtcaaagaaaacacaacatgcaaaaagctcctaactcaaaacatccaggaaatccaggacacaatgggaagaccaaatctaaggataattagggtatagaaaattaccaacttaaagggtcagtaaatatcttcaacaaaaaaaagtatagaagaaaacttccctaacctaaagaaagagatgcccatgaacatacaagaagcctacagaactccaaatagactggaccagaaaagaaattcctcccatcacataataatcaaaacaccaaatgcacaaaacaaagaaaggatattaaaagcagtaaggggaaaaggtcaagtaacatataaaggcagacctctcagaattaaaccagacttctcacaagagactgtgaaagctagaagatcttaggcagatctcatacagaccctgagagaacacaaatatcagtccaggctactatacccagcaaaactctcaattaccatagacagtgaaaacaatatattccatgacaaaaccaaatttacacaatatcttttcacaaatccagccctacaaaggataacagacaaaaaactccaacacaaggagggaaactacaccctagaaaaagcaagaaagtatcttctttcaacaaacccaaaagaaggtagccacacaaacataattccacctctaacaacaaaaataataggaagtaacaatcacttttccttaatatctcttaacatcaaaggactcaattctctaataaaaagacatggactaacagactggatatgtaagtaggacccagcattttgctgcatacaagaaatgcacctcagtatcaaagacagacagtactacctcagagtaaagggcttgaaaacaattttccaagcaaatggtcccaagaaacaagctggagtatccattcattctagtatcaataaaatcaactttcaaccaaaggttatcaaaaaatagaataaggaaggatacttcattctcatcaaaggaaaaatctaccaagatgcattctaaattctgaacatctatactccaaatgcaagggcacccacattcataaaagaaactttactaaagctcaaagcacaccttgcaccacacacaataatagtgggagacttcaacaccctactctcagcaatggacagatcatggaaacacaaactaaacagagacacagtgaaagtaacagatgctatgaaccaaatggatctaacagatatttatagaacatttcaatctaaagcaaaagaatataccttcttttcagcacctcatggtaccttctccaaaattgaccatataattggtcacaaatcaggcctcaacagatataagaagattgaaataatcgcatgcaccctatcagatcaccacagagcatggctggtcttaaattccaacaataacaacggaaaacacacatacacatggaagctgaacaatgctctacttaatgatatattggtcaaatatgaaataaagaaagaaactaaggaatttttagaacttaatgaaaatgaaggcacaccatatccaaacttatgggacacaatgaaagcagtggtaagaggaaaactcatagctctaagtgtctcaaaaccaaaccaaaccaaaccaaaccaaaaaagccaaagcaaccaaccaaccaaccaaacaaacaaaacaaattagtagcttgacagcacacctgaaagctttagaacaaaagaagcagttacacccaagaggagtagatggcgggaaataatcaaactcaaggccgaaaccaactatgtagaaagaagaaaaagaaatatacaaaaaaattaaccaaaccaggagctggctctttgagaaaatcaacaagataaataaacccttagtcagactaccagagggcacagagacagtatccaacttaaaatccaaaatgaaaagggagacataacaatggaaaccatggaaattcaaaaaatcatcagatcctactacaaaagcttatactcaacaaaattggaaaatctggatgaaatggacaattttctagacacatacctggtgccaaagttaaaacaggatcagataaaccatctaaacagtttcataacccctaaagaaatagaagcagtcattaatagtctcccaaccaaatatagcccaggattagatgggcttagtggagatttctatcagacctttaaagaagacctaataccaatattcttcaaactattccacaaaatagaaacagaaggaacactacccagtttgttctatgaagccataattatgtttatacctaaaccacacaaagaccaaacaaagaaagagaactccagaccaatttcccttatgaatattggtgcaaagctacttaatataatccttgccaaccgaatccaagaacatgttaaaatgatcattcaccatgatcaagtaggcttcatcccagggatgcagggatggttcaatatatggaaatacatcaacataatccactacataaaataactcaaagaaaaaaaaaccacatgatcatttcattagatgctgaaaaagcatttgacaaaattcagcatcccttcatattaaaagtcttggaaagatcaggaattcaaggcccatgcctaaacatagtaaaagcaatatacaacaaaccagtagccaacatcaaactgaatggagagaaacttgaagcaatcctactaaaatcagggactagacatgactgcctactctctccctatctattcaatatagtacttgaagaacaccttcatagaagcaggaggagggaggatgggatgggggtttccaagagggagaaaaccaggaaagggggaaaaatttgaaatgcaaataaagaaaatatccaataaaaagaggaaaaatattaatatagttacctttgtgctatgtaaaggtctgtatgacacacaaattgattctgtatttcaactcattcataagctatctcattatatgtttgaaaaaaaattctaaatactgaaaaaaaattcagaatcctgaaacatttctggtcacatacattgtgaatagaagatattcatcatttattcagtagacaaatgcagcattgagtcagcaatacttttatactgaagtaatcatttcttcaggatttgatatattcttttggtgaatgttgtaactagcataacttgttaaattatttttacttaaagtgtgtgtgtgtgtgtgtgtgtgtgtgtgtgtgtggtgtatgttggggtaggggagcatgggcatgtatgaaggtagagcaaaagaaggtctgtgtagttggttttctcttctacctttttgtgggttgagaggctcaaactcagtttcctagccgacccagaaagtgtctttgcttctgagccgtctcattggtccttatgtaacttttgaatataacattaaagctagtactagaaaggatgaaaagtagtatgtggaaatatagatgttagccaaaaagtatgttataattatgaccagtacatattctctgaagtgtattttgagttctcatctatgtgattgcacttcttttactttaagatttatttatttatttatttatttatttatttatttatttaatatgtgggttcactgttgatgtcttcagacacaccagaagagggcatcgcatcccatgacagatggttgtgagccaccatgtggttgctgggaattgaactcaggacctctggaagagcagtcagtgctcttaactgctgagccatctctccagcccccgtgattgcacttcttgaaccttattttgaattttcaaaaggtggtgttttacatcaagtattactacttattatccctttattattgggttccttggaccttattaaagcccttttatttgtggactcactaagatgctcagggcaagaagtagaaattaattttttccaaaagcacgtggaaacagtattaaacatctgtaaaagctggttcttctcatagcattttatgtagagagagaccttactgcttgcttttgtaagtagaaggctggagatgtaagtagatgaggtgatgtgtttttagttgtgcagctctctggaaacagtatcatgctcactgcatctcctctggaatcactgcctgacttggggttgaaggaagttaaactacttctttaatgtttctaaaactcggttttaatttattttctttccagtagattttaagataaaacagatcatttaaaaataatttgagatgtgatcttactttgtaaacaaatcaaaatgctgacgttggaatatacagctagaaaaatgcaacaataatattttataatctcaaaacatttcctatgaaatttatttaaagtttagaatttaagtaaaatgccttttacaagtatattaggaaacatactttaaaaaaactagaactagttttaaaaagtaccttaaggtgatgttatttctgattttaagaatttaatttataaaaatatagattgataataattggtagaattcagaattaaccagtttcttttatttggtgagtactatcaagcttagacaatcaaaagataattcttgtttgaaatactatttaagaagtacaaaaccaagattctcacagagaagtatttacttctgaatatttggtgtatgggaacattatactatattgactaaaatagtttgtgcaaatttttgagagaagaaattaaacaattttgcttaatttttttctatcactggaagcacttcattttgtaatattaagttgatttttattacctaaagttttttagctttttaggataataactattggaaaacagttttctttctttctttctttctttctttttttttttttttaggaagatttttttctttctctccctctctcttctctctctcttctttctttccttccttccttcctttcttccttcctttctttctttctttctttctttctttctttctttctttctttctttcatcttttatttaatttatttatttttttacactccagatttttttattcccctcccagtccaccctccaactgctggacatcccatacctcctccctgcccccgtgtctttactagtgtgtccccaccccaccaccctccccaccagatctctaaactctctggaaccatcagtcttttgagggttaggtgcattttctctgactgggtggtgggttctttgggcacaacatcatgttagcaggaatacataccagagaatctttttctttctttcttttttttttcttcacattatatttttttattagatattttcttcatttacatttcaaatgctatcctgaaagtgccctatatcctccccgtgccctgctccccaacccatccactcctgcttcctgtccctggcattcccctgtactggggcatatgatctttgcaaggccaagggcctttcatcccattgatggcagactaggccatcctctgttacatatacaactagagacacagttctggggggtactggttagttcatattgttgatccttgtactggctagttttgtgtcaacttgacacagactggagttatcacagagaaaggagcttcagttggggaaatgcctcaatgagatccagctgtaaggcattttcttaattagtgatcaaggtgggaggtctccttgtagttggtgccatctctgggctggtagtcttgggttctataagagagcaggctgagcaagccaggggaaggaagccagtaaagaacatccctccatggcctttgcatcagctcctgctttctgacctccttgagtttcagtcctgacttccttggtgatgaacagcagtatggaagtgtaagctgaataaaccctttcctccccaacttgcttcttggtcatgatgttttgtccaggaatagaaaacctgactgagacaatcctccttatagggttgcagacccctttagctccttgggtactttctctagctccttcattagaggtcctgtgttccatccaatagatgactgtgagcatctacttctgtatccactggcatagtctcacaaaggacaggtacatcagggtcctgtcagcaaaatcttgctggcatatgcaaaagtgtctgggtttggtggttgtatatgggatggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgtgtccttattacaagttggaacatcttctgggtagatgcccaggtagaggtattgctagatcttccagtagtactatgtccaattttttaaggaattgccagactgatttccagagtggttgtaccagcttgcaatcccaccaacaatggaggaatgctcctctttctccacatccttgccagcatctgctgtcatctgaatttttgatcttagccattctgactggtgtgaggtggaatctcagggttgttttgatttgcatttccctgatgattaaggatgttgaacattttttcaggtgcttctcagccatttggtattcctcagttgagaattctttgtttagctctgtaccccatttttaaatagggttatttgattttcttgagtccatctcttgagttctttatatatactggatattagtcccctgtagaagaatgtgaattgatccattcttatctccttgtacaaagttcaagtctaagtggatcaaggaactccacataaaaccagagacactgaaacttatagaggagaaagtggggaaaagccttgaagatatgggcacaggggaaaaattcctgaacagaaccacaaagtttggagctgagatgaaggggtggaccgtctagagagtgtcatattcggggatccatcccgtaatcagcctccaaacgctgacaccattccatacactagcgggattttgctgaaaggaccctgatatagctgtctcttgtgagactatgctggggcctggcaaacacagaagtggatgctcacagtcaggtattggatgtatcacagggcccccaatggaggagctagagaaagtacccaaggagctaaagagaactgcaaccctataggtggaacaacaatatgaactaaccagtaccccggagctcttgtctctagctgcatatgtatcagaggatggcctggtctgccatcagtggaaagagaggcccattggttgtgcagactttatatgcctcagtgcaggggaaagggggttgggagggtatgggggacttttgggatagcactggagatgtgaatgaagaaagtacctaattaaaaaaaaaagattgagaatcgacaaatgggacctcataaaattgcaaagtttctgtaaggcaaaagacactatcaataagacaaaaaggccaccaatagattgggagaatctttttttttcttatgatggtcagaaagcagagaggcaggaggggacagagacaaagtgccacactatgaacccttctccattgattagttttttagctggccctgttaagaccagtagttagaccgtaccaaggagtcatgatggggccctgatctggaatggaaggcttccagtgatgatagctatgtgctgagtgtaactaaaaacaccatggttcctaaaaaagcagaaacaaccaacagtgtgctgatggctacttccccgaaagttcttcttccctttatagagttgtttccccccctccccccagccagagtttctctgtgtagccttggctctttggaactcactctatagagcaggctaaccttgaactcagagatccaatggcccctgtctcctaagttctgagtttaacaaagttctttttaaaacccctaagagcttgctaacagtaatcaatttttgggactcctcctttttggagaggcatgtgagtcagggcacatgtacaactagtgctcagtaaaccacttttgcttttgcacttagccatttgtgagtttcattcattggactcatgagacacactcagctgttggaagttttggtgaccattgataatcaggtgcctttgcaccagtatcaagtactcctgcaccttttgaccaatcccactcaatgaccatctgtgacttactatctcttacatttccccgagcctcccaaattagcacaatcaatcagggactagatagtcaatacacatacttgtgggagaaagttggtctttaagccttaacgggggtgttggggtagaggccttctgggaggtccttatgccattgtgggttcttataaaatctctgagtaaggtcatctgagagagttgtcaaaaacagaggaagtctgccctcccttctttctggctacctatctggctatgtgattcctccctttcacagcaactctgcctgtatgatagggttcttatcctggagttgattctatgctgtgtgaacccttaggattcaaaattaagctaaacacacttcctttcttcataaacacctaaccttatgtatttcattatgatataaaagatatattactctaatgatgatatcagtgtaacatgatgttaatgtatacaaaagtgtgtgtgttggatttctaggatatatttgtaacaaacttctataaactggatggcttaaaacaatagaaatttattttctcacagttctttaagttggacacctgaaatcagaatgctgggagagccatgctttctctgaagactctaggggaaggatctttctttcctccctctttgctatgaacagtagttattagaaatcggttgatgtttctcagcttgtcactgcataattctgactgcttcagaattccattagcagtccatgcatggtaagtccaaatttccttttcataatgaccacagcattctctctctctctctctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattaactattttgttgtgtaacttttccctggcaaaatgtgagcaaatgactgttcagcccagatagggcactactcacagaccaaagtaacagctatattgaattttaatttagtgaagtagtgaatttatttgtattatttaaggaggataaatggctgaaaggcaggtgcactatccactgtagcatggtgaagactaattatagctgcctctccagagctccctgcacaacttgtagatagatagctcagttggtgagagagagggtctcttctccctgccagttgttacagcttatgtagcttaaatgctagggccttgtagaccttacaagtttaaggaaattcctggaacttgtgaattgttaacttgtaagctttgtttattttaggagtcttaatgaactttccaggatgaaatgtttcagttaggaaattgttatttacaaccatgtccagttaattatttttctcatggatagtaagtgggaggcctggaggaagagaagaatggaagaaatgacttttctgcctctcagattctaaagttatgtaattgtggagtaacttctttctgtgtgccatatttagagttttgttggcatcacaaaagaaaaagtaaaacgagaatgtcccaaatacccattggatcggccctggcttgtgaacgtaacacctacagattaatttgtttggtttacttcagtgaatcactgaaggagatcactaatttgctgttatccctgcactttctaagtgatcataatttttaaaatttccatagcatatcagaaagtgggccgctcttaccgctagttaattcacttaagactgaaagtgtgccactgctttgctttcttgctgagttcataaaacgaaatgagtgtaaggagcatagtttctcctctgctctcagttctcttgttacatctttcttgttatcaagggatcttagaacaactcttactagcgaatgctaattatcctgggaggtggagcatgatgtaaaagttacagctgtggttcatgactgctggattttcctggtgttttgaataggtcattgaagtattttgtttgaaatctttctttcaatcatgaggtgagtcatggtaattacttcttagagatactgtgagcattgtgaaggaaattggtaatactgaaatgcttaaccaattacagtatgtagatttatgtatatgctcacattaataatgtttgtctattggtatcagaatacgtagagtcaatgtctggatatgaggaagttatgaggaaaattaagtcttttttattttacttcatacagtaaaaatgtaaaactatattttgaggatagagattctatttgagtatagaatttaatgtaatcttgtaggaatacttggaataaaatgttaaaaaggatagaatatagagactaaatatgtactgtaggtatggtagagtcatagtttttatttatattttcatttttcagtgaaaagggtaggaggatcagagttcaaagctgccttgctactctacaagagataggtttaaaaagttaggctggaaagagaggcccattggacacgcagactttgtgtgccccggtacaggggaacgccagggccaaagggggggagtgggtgggtannnnnnnnnnnnnnnnnnnngtgggagggtaagggggacttttggtatagcattggaaatgtaaatgagctaaatacctaataaaaaatggaaaaaaaaaaaaaagaaaaaaaaaaaaaaaagttaggctggagaaatggcaatagaaagagcacttccggaggaacctaattcccagcacttacatggtggcttccaatcgtctgtaactcctcttctgggggtgggggggggcaggtatgacatctttctctggcttccttctgcaccaggtgcacatgtgccaagtttttgacataaaattttgcttttcactaaagaacttgcaaacattttcttataagtctattagatttttatttttctcaactgttgcttatttgagaaagtctttattacttctttacttttgaagtagaatactgcacttctggcttggatttgttctctttttaagagttgaaatatttcattttgttcttttcttgctatgtggtttctgaaggggggcactggaggtaaccctgacccccttcctctgtaggtaaggtggccttttggtttttattatcctcttttgcttctctctgtctgatttttggcagtcttcctgtaacatgcctacatttaagtatgttggtgtttatcctgctttctgttctctggaccctgaactgtcaccacagcagttcttgtctgttgccaagtgtggatttgtggcatttcctttttatttcctgtctcctgctaaccatgtccacctgcttttctgttatttgcttctcctatcagcactcttagcatacagagttcacatttctggtagtatttctaataccccggtctggcaggtaggcagcattttactgcctatccgtgctccctttctttctattattttgtgaattttgccctaaaaataccttttacttattttgttcacagatagacataatgtatcaggtaaaggaagctgaggtcagagcacatggagagaacttctgtgtttatctgcctaagaggcaggctgtattgtgcagctttcatgtctgaggctaaactttgtatttagatttttttttccctgagacaatctttaaatccgaggtttacagttcttttagctgcactccttggctgttgcataggagtcatgttaatgtgggaaaagggggagaaggtgatgagaggaagaggttgtctggtccttttgaaagatcagtctcttgtgaatttaacttgggcatcttttccctacgtcagaagataaaaggggctggagtgggtatttcccttctggattgctcagatactgtaaaaacctagtcacaggctaggtaaaaccccagttacttaagttttaataaaatactttcatttttggagggaaggccttttaagagtacagagcactggacacatttcagaaaagttatgtttctttttttgtctgctataagtataagggtcttttctcagatttttactttaacaatctgatagagttactgaagataaaactcaagaaaatattgggactttgataagattgggtcctctagtaggttttaaaattttatttattaaataatttcttttattctaatatacttaacctttttcattttctccctccaaacccttccatatacccttccttgttttctttcaaatccgtgccctcttttttcattaatttttgttacacatgcaatcctgaatatataaatacaacctccttgctctgtataatgttgcttatatgtatgttttcaggactgatcatttggtattagaaaaaaatggatatgcctttcctggggaagactatttctcctgttcttcgtattcctttcttacctgtagtattgggttgaagattcctgggtttctctcacaagtttaaactgtttcagcaatttaattatatatacatgtagtacatattttaaggatttatttgttttatatgtatagtgctttgcctatatgtataactgtgtgaaccaccctcagagatcagaaggaggtgtcatatctcccaggacttaagttattaaataaataacatgtggtgcagggaacggaacccaggtcctctggaagataagtgctcctaactactgagccatctctccaggcctgctccagcaacgttttttttttttttccattttttattaggtatttcgctcatttacatttgcaatgctataccaaaagtcccccatagccacccaccccctctcccctacccacccactccccttttatggccctggcgttcccctgtactggggcatataaagtttgcgtgtccaatgggcctctctttccagtgatggccgactaggccatcttttgatgcatattccagcaacgttttaactgtactaaagaatccgcactgatgctgcttcccagtgagagcttctgttccccacatgtgacttctctgccttgctgtccatggtccagagtggtagtccatcttctgacctcagttccataatagattcagcaaagtattgattttcagcctgttttcttgttatgggggtgaaagtaatgaatcctaggttcactacattttaaaaattcaattaaagttattatttttattgtatttggtagtatgataaagactttgtatattaatgtcttttgatttggcaatactaactagaaattttattttctaatattgtgcttatatattttggggtaacattctaatttgcatggaagctttttcataggaaattgatccataatactgatttttttgaaatttttatctttattttgtttcttattactattaaaatgagtcagtatatttactattagcttgcaaatacagtttgagacaatagcaatctttgtttcctctgttgtgagattatgatttcttttttgtattcataaactgagtgtcagtttgtgccaagtttcactaattgtactttggatactatacagatgatgttcagagtattgatagtttggatttgtgaaaccagttaattatatgaaccatttacattaggtttttactttaacattttttatttattttatgtgaattagtgttttgtcggcatgtgtatatcggcactttgtgtgtgcttggtgctggcggaggtcagaagagaatgacagatgcactggagctgagttgtgagcaggggactgaactctgggtcctctacaaaaacagtgggtgctcctaactgcttgaccatctcttcagcctaacgttggatttcttaattagtagattgaatagagcataataggctaagtcctttgatttagacagaaaaaaactcatgcaaatatgttggagacaaattagtgtaaattaaaaaaatataaaatatggtttaaagattttgttttgaaaaaacttcacattaaaaaaaattcactatattttagattttgatgttcactgaagtgctgaatttgatgactcagaccccactgggttacctgtaaaagctgttaaaagattattttaagtcttctgaggctccgtgcatgcctccttcctgatgtctaagtgagagattttatacataactacatttaacctcctgtttttccaagatatttgctaaaaataaaaggaacacgtctttctgcaaaattgattaggctttgatgagcccaagataagaagaaagggattgcaaatcattggattcattttattgtaaaagtagcaaaattcctcagttgattttttttttttctttttctgtggctttgttaagagaagtatcacttatccgctatgggaaaccaaagtcttgtctactagatgcttatatatttatttacttacatcctcattccctgagtcttgtggtaccatattttcttcaaaacaaacaaacaaacaaacaccaaatcaatccaaaaaacccaaacttgattaataactactgtgagtttgaaatatgaagtgataaatgactctggaggaagctgataaatttactaggtgagttaggtctatgctaatgattgcagaacaagataatgtttgccaaattgtgaaattgtgcttgaaaataaaaagagtctgcgtgtttgtatggagagttattctgcaggctagtaggttctgaggattcaatgcatatcctcatacctgcatggtaaacaatttacccactgaaacatttctccaaccctcgaatggcacttcaaggagatcaagtttattatgacaaagaaacttttttggatcattttatataacaaatatctagttcttttatttcaattctctatgtaactgcattgtactcccatttaacaggggtggtgcattttcttatgtgcttatatttatatttgttactcttttcatattagaattcaaattctctgatatactctgatctacaataccaggcacatagtaggcagtcaggaatatttgatgaatggagtgttttgttttgttttgtttttggcgcaaaagaggttcaggtttaagtggcatataaatagattaaggtaatttaattttgtaaagatcatgggagaaagcagcactgtaataagaactcattaatttccaggcttgacagttttcattgtcatattctgctaaatatgcatcaccattaagttggggatttaagacaaaatttgattaggagagttaactttttaataaaaagtctaaaaaaattttgaagtattacaaattttatttcattttattttagaagttccatgagatactctgaaagctctagaacttaggaaatgtctgaagtaaaatgtatcaaagtaaaactttttcagaatctacaggagaaaaagaatacatattaaattataagtagggttgttattgccagtgtgggccaaccagagggtaaatgctagccagtgtaagtgggcaggtaggatggctcagtaggtaaaagctgtttgctgccagtcctcaggaccttcaggacctacacggtggaaggagaggatcggttttcaaaagttgtcctctgatgtctacaagggatacacataccatacacacagacacacacagacacacagacacacagacacacacacacacacacacagacacacagtcacacaaatgaacactaacttttaaaaaatgctttaaatcagctatttgctgagaatctcagaagtatacctgtaacttaatgttgaattaaactatattaaatatagtttataaagtcttcctcaatgttacactgtcagaagaaagtgatgacatttagtttcaaatcaaattaacttttattaataaattaaaagaatctgattttgcctgaagtagactagacggtagactggaaggaggcacattgtcactcagctgagtttctcttgtgcctttcactgctgtcttctctttagcggtgagtgctctggtagctcttaagtgctaaatctgtacctacctgtcaggttgtggcttaggcgttgagatcacctcaatcaacttagccatgattttccctgagtgtagaagaaaatgacatggaaagagcaagccttgtgagttttggaagcttttattgtccccaccgtaattgctcatttgttgtaatcaccatcagtcagttttcagattgtcccttggcagtgactcagtagctaccacagactgcagaaggtcacctggactctctgcacaaagtgacccctgatttaaaagcctgaaagatcagaaagtcagtgcaaaatagtaagacctggcaagaatttatttaaaatccccagggcttcatgatgaacacaggaggggaccccaaaaggcatcatctttttcttgcaattcctcatgggacctcagttgtcagaagtttttttgaagtccctttatggtcaccagaagccatcaaagacaaaagttacaacacattttaaagctgatgagcatttatgtgtgactttggagttggacacttcattttatgaagcagagtgactgttctgggatgagcagaggaggtcagctttaaagcactaaagggctcaaaaaggccaaagcaacaaaaaagcgatgattgttacttcctgggattagagcagaagggacttctttgagtggttctggttggctggacactactgctgttttggaaactggcccatcaaagttagttgggttacttagcacttgtgacttcattctagacatatctcatctgctggggcccgggcagaggctagtccaaaaaacaatgacatttcatgaccttgtttaacagcagtgacttgtctgttttcttataactctgcctggtgcttactctctctctagaacctttttcccccttcaaaatcagaaccaaaactgggcatagtggtacacacccttaatcttaatcctctgatggtggtggcagaggacagccttgactacatagtgactttgagtccagtttaactttgagatcttgtctcaaagcaacaaacaagaaaactgtaatcaaattgcttattagatagcaaaactttgtgctgacttcataacacatttagagggtgccttttcccaaattgctctaagtatttagctatagcttctttagtgtaattttgtgaatatctttgaactttgtacagttgaagcatcagagtttttgcatatggccatagtttcttaattatttgtgtgtgttggttttatctaatagataaaagttttttctttttttgagttctgtgtctgaaaattgaatctctaattccaccagtagtgtgtgtgcgtgtgtgtgtgagtgtgtgtgtgtgtgtgtgtgtgtgtgtgtgtgtgtgtgtgtgagagagagagagagagagagagagagagagagagcgcaagtgagctggggttgtatctagagctttgtacatgctaggcaaatgcactactataactatgatcccttatatttttattggaactttaattttcttgataagggtatctataaagattctttacataaagttatggtaattgaattgagatcaagactgagttattaaagacagtgatttcaaatctttcttgaattgatgttaacaaaaacttgctgatttgaaatcactgccttactcaaccactacttttaacttgatattctctattttaaaataatgaatattattcagttttggggcctgctaacattttagaagaataatagggaattttgaattggtaactaaaaagtatcttcacaatattattttatttatttatttatttaatttatttatttttacttaggccattagaccagaatgacttgagttctttaggttcctgtataagcaaacaactcgtctttaaaccagtaaactagtagctttaccaatcacaaactttcggccaactcttattcagatcttactactgtaaaagctcaggcccaggctttagtagtaaagctctctggatcggttgtgttttcaaatatagcctgattcttgagttgttctttgctcacaaactggtaattttgtcttaaagattctccttttttctaaacaataaagagaacatgaattctgtcaactgaatataagaatttagcagtgaaaattatctctaaggctttcactatcattttggacatgcaaggtcttttaaaacactatctttagcttttaatatattctagttaaatttgacaatatatttgtttgtaaagtgtcagggtcacaaaagttgctcagtagattttagtttccttaatatatgttttcattcttcagggtcatggtccacaaattgattattatacagtctgttgagctttaaaaaacctgcaggtacctatgacatatatgtatacatatataagtatacaagattttgtttatattttcattgcatttccactttgagatataattactgcattaaaagattttattatttttgagatttttatattcatagatgtaggtcacctttagaaaagagtgtgaacccacagattttcctcacattttctttgtgaggaaaatcacatttttttgaacactgggtattcttggacttttactattctcatttgacagaaaacatttatttgtatttttgtggtgtgtgtgtaaaataaaaactggatggagaatccaaagatacattcaattgtttttgtatcatttgttgaaaaggctgtcttttgatttattaaaagtcttttgatacttggcgtggttgctggctctggtaaatcatagcacttgggagacggagttaccagtgatcacagtacttcagagatagaggcaggaggattacaagtttgaggtagtctgggtgcatattgaatccctactcataagtctctctgggtctgttgcagggtttctgttccattgaccttttgtgtatcttggtgcttttaccatactggtccctgtggctttggaaataatggagttaagtcatgttaatctatccaacttgttgttctttttcagtatgattttggctattgtgtggctattggtcttttgttccaaatgaacctttttcctttgcttagtaaaaacagatctgactctttaaatatgcttcttctgccataggactcaatgcttagcttaggctagaaagaagtgacactactgataattattttcctcttgtatcctttgtgctggcttgcctgtctctccccaatattaatcctcatggcttccccagtagtgtacagcttttctgcataatgctttcaagtgcagaatcctgcagtgcttagaggcagatagatggtccacagtagacagagacctgatctggctgtttgtcttttttttatagcatagaatgttggtagaacgtcaactccataaagaatggatttctgtctgtttctaatggtgggtttctaggaagttgaggggagagctctagagcagcttttcagccattcagtagagggcacagtgttttcttcagcaaggatagatctcagccctggggcagttagtggttagaagaagctcttactgcagtgttctggctcaggtctagtgggtattggcttctcctgcagtacagccctttttatttctcattagttaattgggtgtttttccaaccctattatagttaatgatctctcatactaaaatttcccttttcaaattccagggtggcttctctcttttaagttgactttgcatttccatatgacttttagaagcagtttgtaaaatgcccactgtgattttaattggaattatattgtatttagacaaatttggagagagttgacaccataacaatactgagccttctgacccttcgataagatatttccatttagataattagtttctatcagtagtgttttagattttcaatatactgatttctcccctgttttgtcagattaattctttttagtattttggtttcttttttttgatgattttataaatggtatttaaaaataaatttctaattgttcattgctcatatgcagttcttcaaattttttgcatattgccataactttgataattactattttggtagattaatattatattggatcttcaacttagacattttaaatatgtattttgtgactaaagaaagttgttttccctctaatcttgatgcctgtcttttctcttgcctcacttcagtagctagtacttttaatgcatgtataatgctgagtaattagacatctcgatcttgtttctaatgttacagggaaacatctctgacaattaagatgaaacttgtgtatttctcagatctttgaaataccctttgttgcactgagaaaatattgtcatattcctagtttgtagaaattaaaaaaaaaaggaaaaggagatagatgtagtgtttgccataggcttttttcatatttattgagataaccatggtgtttgtcttttttaaattagtgtggtggttgctttacttaaatgataaaccattgctgtactcctgacataagccagttgtttatgatgtatatttggttgcttagttttgtcctgtgttcattgatggacttttcgcttctttggtattatatttggtatctttcctctgcctgttttatttgtgcagcttgtgtgtgtggcttttttttgcctccaggttcactaattttccctttactgtcttatctgttaattcagtgtagtatatttttcattttagatacagttttcatctctatagttttaggtattttaatatcctccatgtttctacttgcggttttgaatatgtaaatatatttaaaatagtctttaatattcctgtcccaaattctaacatctgttttagtaaattgttttcttcattatgactcatagttttaccctctttttttgtgcctggtacttccccagactgcctataccccccagtcaagcctcaatctcctaggccaagatgatttttctgtctcagtttcctaaggctggcactataggcatgtgtcattgtgcccagctctggtaatattgattggatgatactggaaattttatatatatataatttttttttctcttttcgagacagggtttctctgtgtagccctggctgtcctagagcttactttgtagaccaggctggcctcgaattaccttcatattttgtgttaggaatattttttaatcatttgggttttagttgtttggagacagtttgtgacgtgttttccagtttatcaggtggctgagaacacctaggactaattacttctcactactgagacaacaccctcctgaacactaccctcttaaagtcccttgttagtttggctggtaggaacaggcagtgttcctagtctatatgattgtcagacactaatctgtaattctttcaggttgtttctttcttagcttccagtagttcagtagttgacttactgtgctgaatatttgagattttataaattatatatatatatatatatatattagcaaaccttttttttttttttgttactttgtatctttgttactttctttccatattgatgcctggtcttcatggacttttaggtctgtttcactaccttcttcagctgagttcatcaacccaccttagttagttttgagtctccacaggtagagtttctaaagttggggcagtggtatgatttggtgtgcactatttcctatccctccacaacagtgttcttcacccttgggtcatgactctatttggggattcaaaggaccctttcacaggagttgcctaagaccatctgaaaacacagatatttgtattatggttcataacagtaaccaaattacagttatgaagcagcaacggtaaggaacagtattgctctggacccctaagaccaatttctcagcaaaatgatttatttgcctcagagggacatagggtaggaaataaaagacagagacaggagatagagggtgagggagaagggaagggaataagaagaggtagggatatttatcctggagaggaataaaggattgcctctgtatagagaggagacagatgtggaccttaggaaaacccagtgttaggatgaggtattcagttttaattgggcatgttaactaggtaagccaaaggtggcttttgattgctggaccttggtagtcagcctcaggaagaggaagtagccaaataagggaatagatcttggtggctagctagctttaggaatgtaatctaattttttttttttttttttttaacttgtctggctgtttttttttgtttcaagtgagaagacacatctgtttcctatttgtacatcttctgtgtttttattttaaaatctgagtagttttggtggttaaaataattctggttgagagttatcatttctttatggttcatccctagctaattcaatcttaaaaaatattgtacacaaatttgtaatagcaactttttaaaaaataaaaatgcatctctttcatgaggccattatcctctggtatacagacaaaatttagtctttttatttaatgccagaaaattattttcaataccatttctcaattgtaaaataaaaaagacatattgtatattaatggaatataattattgaactgtgatgtaaagaatagtcaactgggaactgtccagggaacaaatccttataaaacctgttgtttgactgtgatgttagattcatcatgactacatgagaggtatcaataggatatttaattctcatttgtgagtatatagggaaaggtagaatcagcacaaattatatgatgaacatatttacagcttagtgacctaattttttttttttttttttttttttttttagatttatttatttatttattatatgtaagtaagtacactgtagctgtcctcagacacaccagaagagggagtcagatcttattggttggatggttgtgagccaccatgtggttgctgggatttgaacttccaacctttggaagagcagtcgggtgctcttacccactgagccatctcaccagccccgttctttttttttttttaattaaagcagaatcaaacttggtagcctactggcctggaactcaactcaacattttgcccaggcaatccttctgcctttctctcctaactcttggaattaaaggcatgagccagcagacttactgaaagattaaaaaaaaagcaaaggaaaatggatgctctaaagaatgcagttgtttcttgtagaccggttgtctgacctacactaatgtagtttatccttgtgttgcaaatcaagaattaacctaggataattgagtttaagtattgtatttgtcacttcctaagtaggtgcatttgttaaactgcctttctgatttctcatctgtagactgagcatgagactatctcaggaaacagcgaggatgagaaaacactgatgcagtagagttcaaggcttgagaaatgtttgtcttttcctttttatccagtggccgatggaagctttactttttttctattacatgttccctagtgtttatgtgcacacagaagcagtggtatagttactttggaccctgtcaggaaaaccaacatgaagcacagcactgctgtgttggcctggaactttttgaaaggaaatcaatatcatcatatagtatgggactacattaggaaatggtggcgggagccaggtctgagggagaaagatggtcgaatctgttagagtgttcctcagaatgttgaggtcatggactagcctcacagaagcattttccctgttttgtttctttagttagcctcactgcagtccctgagtcctaagtctctgatagaagtgctcattatgttggtcttggttttaaattcttcctagctcttgatttgagaaggtagggtctttgtaatactttaaaggatagagaattacttagtttaattttttgagtggcatttaggttctttgtctttgtgctctgccttctttggtctgatccttcagcagaagaaataacactgtgtaataatgaaaaggtgctgttgaatagacacatggctggaagcgagagctatctgaatggggttttgtagcagcgattttagttgactcatcttcaacttgaagtgcaattgactttctgagagttttctcaaccttctgtgataagtctggtggaagtcaagtgaaatcagtgtttgatagttggtgctcaagcttggtgtatgcatctagcctttcaaaatctttctaggtactcagcttgtgacggaaaagactaggcatttcctttttaattttgcttttgttctatttctgtctctgcctcactatatagcctaaactgacctcgaacttgccattttactacctggagattacatgagcctggcttctcttatacttgtatttaatgctctactaattctaactgctgcttaacagcattcattcccgttttcttgcttttgctttctcacttccttccttttcttcttctctccatccctcccccatctctttttaaaaattaggtattgtcttgttatttatgacaagctgtcctcaaacttgtgatttatagttgtgtgagtcccttgtccgtgtgtccatctccctcactctctttcaataaggccttgctgtgtagccttgactagtctggaactagctagagtcacagatcttttgtggtgttttgagaccagttctcaccatgtagccttgggtggcctggaacttgctttgcagtcttacggagatccatctgcttctgcctcctgagatcaacagtgtgtgcccaccatactctgccattttgtgtttttttttcctaagaaaatatgtctgtttttattacttttggttgaatagaaacatacagttgaaaagtcttatgccattacaggcgcttttaagattaactggaagagcagagagtggtggtgtgtgcatgcttgtgatctcagcactggggaggtgaaggtaggaagattacaagttagaagtcagtcttggctatgtgtttaaaaaaaagttaataaatcaattattttaaaaattccataaatgtgtgatatttccaaaaaaaataatttgttttttgcatagctaggaatgaattgaacttttgattttatttaaatataatacaaaatgcattttaaaatgtatgtgatgtcccttttgttttatgatactgtttttataagcaattaaaatatattagaaggtgcacttgggatgatttaaaaggattctgtgtgtttattggtgtcatacatacatgttatttgggtcataggttgttttgtagttgtataaaatatgtggtataataaagagaaatgaaaaatgtatgtttctgcttctttttcaaaaaacactgaaactcaagcaagctgaccaagcttcttgtatttacgtaacaatttatactcagcgatgggaactcctcaaaatattaatcatatagtaaaaagtagcttttaacaatttaaatgttcccttttataaaaatctttagttctttaaggctactagttattgttatcactttagagagtactcaggtggttctaagaaaaacttcagaacagctgtagtaacagctgcagatttagtcaaaataggcgttttaaaggcttcttattgccctttcacatctctttcccttaccccaaataacccaaatgttttctaaaagttttggtgaaattggggttcagagacctggattaccatatgcttgctgtgcgcagacttggtggctgcctgtaaatttttgctaaggttgtctagttagcttgtgtctgcattggttttatagatgcacatggcttttacacaggccagtgtctttgatcaagagtcatctactataactactcatagaattaatagtttcagcttaaatttaagcagatgttgctagtattgcattttgactagaagtaaaggtagaaatgcatatattttttaaagtgtttcttcaaatttttactttaataagaaattgcctttagtcttataaaaaaccaaatttggcaaatctaagttttgagggaaatctattataatgaattgaaagctcagtacgtacccttgttagataccctcccctccttacagctttatgatctagcgacgggatggcattcgaggcagcttttaagtctatcaggcaggaatggctgttaagggctatggaggttaagggttatgttaaggttatggctaacgcagtgtttggaactagtttccatcacccagttacagtctctgtttgcagatgcaaatcatactgaccattgatcataagatataacagtataacctggctgttatcctggttgtacagaattatctacttagaatctggttaaaaattgtagtaacaatgctgtatcatacatgggggaatttgaaatttcctgttaaacagttatatactttctgttagaccatgtgtaacatgcccctatgcaagtaacactgtgctcaaggtgataaggacacaaacctatttaggacaaggttcctacctttaagtacactcacatgcattaaattaaccacccgtgaaaggataaatacgtatttaaatagttagactcaggaactctatatcttaaaggaattctaaaggtttgataaactctattattacgtgggaagaaacaatgaagggtaatgaattggcttaagtcgtgtattaaatagggactttacaggactttctttttttttttttttccgtggatatctttttattggttttatagcaggagctccgtgtaagctttttttctgtgattgtaaattctttgcttttagtctaagaatacatacagatttatgagactaaagaaaggatatgtaattattatatgatataaatcatttataattcatgttactaacttatattaaaatcatatatatacatatatgtatatgtatgtatatgtgtatatatatagcttaaagacagaatgacattttaaggaaaaggtatagactttgcaaaataatctaatgttgctcctctcttttaattgtagaatttatttattatttatttatttatttatttatttatttatttatttattttggttttcgagttaattgtggaattacatatgccatgttttaaaagattgaattacctataattttatttatacacgaaatttacaggatccataattatttgtgaagaaattttatttttcataatatgagcaatttgtatttaagtgtatccaagagcaggtatacattagagatttacaggactttctaaatacaaactctggagtgacagtgagcagcaatcttttatcatcttacctttaagactttaaaaagataagaaaaatgatgtgatcttggatttagctcattatcaaaaattcttttgaccatcttttatcttgtctcttccttttagacttctgagcctcagctacttagtaaaatataaaattatgtctttgtgtctaattttatgattattgggactattgaatcattttaagaattgaagtaataggcaaatatttttttttgttaaaataatagattcagtccagcacaacagattttgagcatatgatttattagatgtagcatagattttagcattcaggaagatactgtttttccttttaagagaaaagaaataaaatataatgcatatttctgcattatatggtacaatatgagaagtgatgagaagtttagatttcctatattttggcttaagttaaagagttactacttgaatgcttgaatccgctctaagagtataagactcaatttaccacaatgacaaagtaaatatttgtagcagttgataaggatgttttcaatactttgaactagtgagaatgtgttcagatttttacttgagattggcatgtggtcaaagtgtgaacttatattttccagtagctactaaatgggagcttgttaaaattttaggaatatagaaagtaattaataaccacgtcagatgtcataaagtgtgacaatcttagacacgatgaatattgctaatgggacagggcacggaggattagaagtgacttcggagatacttacctcctaaagacaattgttaccaggattcagacatggattggctgctttgtgttgtgaggaagcttttgaattatctgatgtgaaccattcttgtatctggtggttggaggtctttgttgtagcaaccccaaatgacttcttttgtcacctgttattctgtattctccatatgttactggatgtgctacagggttgtctgaggaggtgacttgacaggacagccaggaatagaaaggggagtggttgattcaggaagtgagacagaaaggaggtgttgatgattagaagagtcttaggtacttttctaatgcttatatgatctcactacagcacagatgtgatattttaatagagagcattatttaaataaaatgctaatttactattcagtggtctgtacaaatcaggaaactacttcaacagttttcacagtgagaataagcagggttcatacttggctatttgattctacagacaaaactcttaagattgccatagtatttttagacttttaagataaccctgaagttcccctttggaaatttttttctttccctttctctaaatatgacagttgctagaaaagatgaatatttctaggtcagtagtttgtgtagcacttgggaaggggtggaggagggtaaaatattagagtttatttaggatttgaaagctcggtgacgataatgcagaagaaggagcccatactttcctttgcatttcaggaaaaatggagtttttatctgactattttaatcactagatttcttgatgttctatgactatgaaagcatgatggttggcattgttcattagaaatttagtataatccatatattttaattttattctgaccacattagaagaaatgaaaactggtatactatcaatgagatactttacatttttaaatccatacttaatatttgaagtctatatatattttatatttacaacataattcagttcagactagccataagtcatatgcttgatggccatatttggctactttagtagacagtgtattcagatactgtcacaagggaaacgtttgattgcacttgttaagctcataaaatgtttcaaaaagctttaaaaaaagttcataaaaatttttaattctggggagatggcttaatttttctctgtacgggggggggggagcatttagtgcttaaaggcatcataattcaattgtgcctgctttgctcaggaaaggggcgttctttatactcagtaagaaggaaatgaggcaatatttaccaatttagttttttaggctttctgccatttgagggtgtaaagtgttaatttagttagagggattgctaagggttccaggaacccttgctattggagacactgaatctctcctctttcttcctagtgctagggatggaacccatcactacttacttttgactatacctgtgactatgggcaagtttttgttttttagtttaattcttattgtatacaatagcgtatgtggaagttcatgactgttagtaatatatgtgtaataactgtttgctgctagtttttctattttagctccaagaatgtagcttattcagaatttgaggctaacaagagagttagaagtgagcattcagatctataacacaaatttggaaatgtagggttttgttgttgtttttttttgttgtttattttttaaattgtattcaagactaatttgcatggcagtctcttggaatcttgttaaaatgtagcttacggtttgtgctctggaactcagattagtctctcaggctatagagtctagtaccaggctgtcttagccagtggtctattgctgtgaagagacactgtgaccacagcaactcttttaaaagaaacatttaattgggacttgtttactgtttcagaggtgtagtctattatcatcatggcaggaagcatggcagcacttaggcaggcttggtgctggacaagtagttgagagttctacatctggagagccactggcctggcttgggcttttggaaacctgaaagctcacctcctaatcctttcaaatagtgacacttcctggtgactaaacagtcaaatctatgagcctatggggaccatgcacatttaaattaccatacatgtgtatgcagtctgtggcctgcaggccatttgcagccagaaatcgtcctgaatgaagccaatgctgttctggaacatgaactttatagatgaaaatactgttacaatgtcaaaagtctggacacacctgttaggctctacagtattgaagttcagtcattacattcactgtggcatttgagcattctctttatactctttctggtggttaaaaatgattctaggctatgagtgtagctccttcttaatgtgcttggttaccacatgcaagacctgggttcagttcccagaattactaacaagcttgcaaatgaaaaatattctagggatatttaagtagttatttttctttaatgtgttaagttttacattttgttcatgatggaggtggggcattttttcctatttaaacattaatatatcatgggctctaaagggataactgagctttaaagagcgtgtactgttctaacagaggacccaatttcagttcctagcacccatagctggtggttcagggtgatctgacacccctggccagtcgggatacctgtacacctgcatacacaaatgaaaataataaaaataaaatgctaaacttttacattgacatgaataatatctaaggaaagaaggattataactatccattcaactagtatttagtaacatcacttaggaaatattaatatttaataaatgattagcaaatattacttatttagagtatatttttatggttttataaatgtatttaagtcatttattcaagtatagtctcaaattgaactcaaagtgggaaaggaagacagattgaaaagatactaatagtggcactgtgatcagaaagtattttctggtgctaaccagtggaataaaataaatgctaatttatgtagctagtatgaataagaagggatgggaattctcaagtgttttggcccaggttgttttattggttgtgttagtaaattaaagagtcagacaagcaatgctttgattctgtgttttttgactctttgcagtctttctgtgctttttaggatattgagttgcatctgactcacatagaccttacatattctgggtttttcaagtaaattcttactcaaattgctttaaatcgtaactttaaaattccgtgtttgcaagaatacatttcattcttagcactggtatctttagtcctcagatcttcctggctccagcatttttggttattcttttgggctaagccgctctaattttaatacccatagttctgttcattctccagcgaggtcaccagagttttgttgttgttaatgaaaaagtcattgttcaagtctcttctttttaggagcatgctcagactgaatgaagctaaaatttcttaggaatactctgccttacatacaagatacaattttgcatattttaaattcaacctatttgctagtacaatgatgttatttatatctcagaatttcaaatgcattgttaagacttgagaggcttttaccaacaccctccattttacttctcctttcaccattctcagtgttttctgaagaaccgttgggtcttaccagagtttgagttttgcctttcataattacaaaatgagaagaaaagggacattcttagaagttggaagcaatgcaaatacagagaagaaaattcacactcatttctgttactcctcttttattgagaaaaatcttgacttaatgtactttactttgctcagggattggtggcaatggtgataattattgtgatgggtcgaagtaattgtaggagtgcatttaaaagagacttaattatttaattataatatataatatataaaatatttaatttggagataatcttaaaatagatatttcaaagtggtgtatattttataatgtatagattattatatatcaaatgttcatcaataaagttgttggggaaaaagaggagaatgatatgggtgggggagactgtgaccattagcatgggatttcagttactccccaaatacaagtaataatatggctattataagaaccttttttgtaagatagttccatgttcaatattgttgtgtgtgtgtgtgagacatacaaaaaaatactggcagtgctggacttggagttaccttgtggcttactctcctttctgtttcattcttgtgctgagtgtgtgcccagacttacaacagtgctgatgtaatcctttcactattatgactatttaattattttaaactggagaaaagcatattactttttcctttatacttaacagtagttttagtcccaaaagctatacattttttcttggatgacttaagaatgtttggaatgatgtgggaagtagtattttggggctgggtgtaggcttttaagagattatctaaaattaaatctcagttgttaactcaggtatgtgacttagggcaaggtatttatttaagagtttgtcttgctttgtggataaaataagagttataaaacacccacttcatagatatgttttttttttcatagatatgttgagagttgaaccaaaataggttcaaataggtttgtaaagatagaacaatccctattacatgataggtctgaataattagctattaccattaattttctattaacagtattctcagtaaactctaacaaataaaaaaagttttaaaatttttagaaaatttccaaaagtaattttcagattagagtttaactccttcccttctctcccttaagccgcttccagagtggagtattgtccagagttttatttgcttgggcttacttgggaatgtgtaggtaatagcttgctaacagtcctgagatgttgcccttccaacaagccatctcactggtgtgactgtgctggtcctgagaccatgcctcgaggaacaaagttatgtgcttgtgatgggctggtcaatctctctgtgagctgacctgggaagctcagtctcatgtctttatttacttgtctatttcctttgtcaagctgaaggacagctcgtcagaactcttaggctaaatggcaggtaatatgaagttttctttttactatacccttctaaaaggtttcactgtatgtatgaactttctttagggtccccatttctgtctcctttcctcatttatgcaatcttctttggattattcctaatttctcagcatcttctttaatgtataacaacccaagtttgacttttgaccaacctgtctcagtaaaagaggataatgattgaggcagaagaatatagtaccttccatttctaaaattctatgatttttttttaatttaattttatttttaattcattttttacactccatattccattccccgcccctcccattcaccctccgactgctccacatcccacacctcctacccaccccatctccacgtggatgctcccacctcccaccccacctgacctctaaactccctggggcttccagtttcttgagggttaggtgcttcatctctgaataaacacagacctggaagtcctctactatatgtgtgttaggtgcttcatatcagctggtgtatgctgtctgtttggtggtccagtgtttgaaagatcttgggggtccatattaaccaagaccgctgatcctccttcagaatcgcccttctcctcagcttctttcagccttccccaactcaacaacaggggtcagctgcttctgtccattggttggatgcaaataactgcatctgactctttcagctgcttgttgggtcccttgttgggcagtcatgataggtccctttttgtgggcattccataacctcagtaatagtgtcaggccctgggacctcccctttaactggatcccactttgggcttgtcgctggaccttcttctccccaggctcccctccatttccatccctgtaattctttcagacagaaacaattatgggtcaggggtgtgactgtgggatggcaaccccacaaatgtcctgtctttccactggaggtgggctctacaagttccctctcgccactgtcaggcacctcatcaaatgttaatattttcttaactattctcatttattttatttaaattaattttttaaaaatttgttttctaaagtaatcaagatcttgttgattttattccatgtaggcttagtggatcagttaggattatgtcaggaaaacaatccatactggctacttcaggcaagaaagtttaacatagggaatgtgttacacatgtgttaggaggcataaaaagcagagtgttggtggtgggtgcagggatactagagtaacacaggtaataaattgcaggagtcccttttctcatagatgcgagagaatacaaagcttagactaggggacacagaagtgcgattcagaatgtgtagagtgctgctgtctggcagctgctgctctttttgaggggttgcctgtggcttccactaactgctgctactggggtgagggcctgtgttggggtattgcttaccggataaaacaaatactctccctttagtgcttttattgacaatattaggaagctacccagtgaaggctgagaaagtagtttcaagtgctttcttttcaacagaaaggattattgaaggatggatttggagctaagaaaatagctgaataatccatatgttttatctccctcatctttggtttgcaatatgtcatatgccttctgtttcttggactctttcctaaacaacaggcttctaaatcttagtagtgtttgagggtctagaagaaaaagaattgtcagtgttctaaccaaggccatacatcgcctagaaataagaattgttctcatagctgcactaatggattatattcattgtttgaaaacatagactatatcaaagtgactatgggtttgctaggcaatatagtcttacaagactaccactgtatgaatggaacatcaatgatataaatgtcattacgactgatttatctagttgatgtgatttgggagtatgagatagcacccattgttctaagaaaaacctagtacagctctctctctctctctttttttaaatctgatattaattattagatccacactggattggttttctgttgttcaagagcctgtgtaaattgtgatagtattaaaaattggctgcctgttggcaaaaagttcctgctgtagccaactagtatttattaattttaaaaagtttttcctttttttattagctatttgctttatttacatttcaaatgctatcctgaaagtcccctataccatccccccaactccccgctcccaaacctacccactcttgtttcctggccctagcattcccctgtactggggcatataatcttggcaagaccaagggcctctcctcccattgatggcctactaggccatcctctgctagatatacaaccagagacacaagctttggggggggggtactggttagttcatattgttgttcctcctatagggttacagaccccttcagctcattgggtacattttctagctccttcattaggggccctgtgttcaatccaatagatgactgtgagcatccacttctgtatttgccaggcactggcatagcttcacaagagacagctatatcagggtcctgtcagcaaaatctcgctggcatatgcaatagtgtctgagtttggtggttgtttatgggatggatccccaggtggggcagttcctggatggtccttccttccgtttcagctccaaactttgtctctgtaactccttccatgggtattgtgttccccgttctaagaaggtacgaagtatccacactttggtcttccttcttgagtttcatgtgttttgcaaattgattttgggtattctaagtttctgggctaatatccacttatcaatgagtgcatattatgtgtattcttttgtgattgggttacctcactcaggatatcacccagatacatccatttgcccaagaatttcatgaattcattgtttttaatagctgagtagtactccattgtgtaaatgtaccacattttctgtatccattcctctgttgagggacatctgggttctttccagcttctggctattataaataagactactatgaacatactagtggaacatatgtccttattacaagttggaatatcttctgggtacatgcccaggagaggtattgctgaatcttcctgtagtactatgtccagttttctgaggagccaccagactgatttccagagtggttgtacaagcttgcaatcccaccagcaatggaggagggtttctctttctccacatccttgccagcatctgctgtcatctgaatttttgatcgtagctattctgactggtgtgaggtggaatcccagagttgttttgattttcatttccctgatgattaaggatgttggacattttttcaggtgcttctcagccatttggtattcctcaggtgagaattttttgtttagctctgtaccccattttttaatggggttatttgattttctggagtccagcttcatgagttctttatatatattggatattagtcccctatcggatttaggattggtaaagatcctttcccaatctgttgatggccttttgtcttattgaccatgtcttgccttacagaagctttgcaattttatgaggtcccatttgtttcttgatcttacagcacaagcaattgctgttctgttcaggaatgtttcccctgtgtccatatcttcgaggctttcccccactttctcctctgtaagtttcagtgtctctggttttatgtggagttccttgatccacttagacttgagctttgtacagggagataagaatggatcaattcacattcttttacatgataactgccagttgagccagcaccatttgttgaaaatgctgtcttttttccactggatggttttagctcctttgccaaagatcaagtgaccataggtgtgtgggttcatttctgggtcttcagttctattccattgatctacctgtctttcgctgtacaagtaccatgcaggtttttttgtttgtttgtttgtttgttttgtgtttttgttttgttttgttttttatcacaatgctctgtagtacagcttgaggtcagggttgttgattccaccagaggttcttttattgttgagaacagtttttgctatcctaggttttgtgttattccaaatgaaattgcaaattgccctttctaactcagtgaagaattgagttggaattttgatggggattgcattgaatctgtagattgccatttttactatattaatcctgccaatacatgaccatgggagatctttacatcttctgagatcttcaatttctttcttcaaagacttgaagtttttatcgtacaaatctttcacttccttagagtcacaccaaggtattattatattatttgtgactattgtgaagggtgttgtttccctaatttctttctcagcctgtttatcctttgtgtagagaagggccactgatttgtttgagttaattttatatcgagctaatgcactagagctgattatcaggtttaggagttctctggtggaatttttagggtcacttatatatactatcatatcatctgcaaatagtgatatttttacttcttcctttccaatttgtatccctttgatctctctttttttttttttttttgtctaattgatctggctaagactttgagtactatactaaataggtagggagaaagtgggcagccttgtctagtccctaattttagtgggattgctttcagcttctctccatttattatgatgttgtctactggtttgctgtagattttttaattatgtttagttatgggccttgaattcctgatctttccaagactttcatcacgaagaggtgttggattttgtcaaatgctttctcagcatctaaggagataatcatgtggtttttgtctttgagattgtttatatagtggaacacattgatggatttccgtatagtaaactatctctgcatccctgtaatgaagccttcttggtcatgatggatgatcgttttgatgtgttcttggattctgttttcgagaattttattgggtatttttgcatcgatattcatatgggaaattggtctgaagttctctttctttgtggggtctttatgtggtttaggtatcagagtaattgtggcttcatagaatgaactgggtagagtaccttctgtttctgttttgtggaatagttttaggagagttggaattgggtcttctttgaaggtctgatagaactctgcactaaacccatctggtcctgggctttttattggttgggagactattaatgactgatgccatttctttaggggatatgggactgtttaggtcattaatctgatcctgatttaattttggtacctggtatatgtctagaaatttgtccatttcatccaggttttctagttttgttgagtatagccttttgtagtaggatctgatgatgttctggatttcctcatgttctgttgttaggtctcccttttcatttctgattttgttaattaggatactgtcccctgtgtcctctagttagtctggctaagggtttatctatcttgctgattttctcaaagaatcagctcctggcttggttgattctttgaatagtttttgtttgtttgtttgtttgtttgtttgtttccacttggttgatttcagccctgagtttgttttagagatttcaggtgtgctgtcaagctgctagtatatgttttctctaggtggtttttttttttttttttttttttttccccctttgggacactcagagctatgatatttccttttagaactgctttcattgtgtctgataagtttgggtatgttgtggcttaacttttattaaactctaaaaagtctttaatttctttatttcttccttgatcaaggtatcgagtagagtgttgttcagcttccacatgaatgttggctttctattatttatgttgttattgaagatcagccttagtctgtggtgatctgataggatgcatgggataatttcaatatttttgtatctgttgaggcctgttttgtgatcaattatatggtcaattttggagaagatgccatgaggtgctgagaagaaggtatatccttttgttttaggattaaatgttctgtagatatctgttaaatccatttgtttcataacttctgttaatttcaatatgtctctctttagtttctgtttccaggatctgtccattgatgagagtggggtgttgaagtctcctactattattttgtgaggtgcaatgtatgctttgagctttactatagtttatttaatgaatgtggatgcccttgcatttggagcatagatattcagaattgagaattcattttggaagatttaaccttctatgagtatgaagtgctcctttttgtcttttttgatagctttgggttggaagttgattttattcgatattagaatggctactccagcttgtttcttcggaccatttgcttggaaaattgttttccagcctttcattctgaggtagtgtctgtctttttccctgaggtgggtttcctgtaagcagcaaaaagttgggtcctgtttatgtagccagtctgttagtctatgtctttttattgggaaatttgagtccattgatattaagagttattaaggaaaagtaattgttgcttccttttatttttgttgttaaagttgggattctgttcttgtggctgtcttcttttaggtttgttgaaggattactttcttgctttttctagggtgtagtttccatccttgtgttggtgttttccctttattatcctttgaagggctggatttgaggaaagatactgtgtgaatttggttttgtcatggaatactttggtttctccatatatggtaattgagttttgctgggtatagtagcatgggctggcatttgcgttctcttagggtctgcataacatctgtctaggatcttctggctttcctagtctctggtgagaagcctggtgtaattctaataggtctgctttatatgttatttgacctttttccattactgcttttaatattctatctttatttagtacatttgttgttctgattattatgtgttgggaggaatttcttttctggtccagtctatctgggattctgtaggcttcttgtatgttcctgggcatctctttctttagggatacaagttgacactctcacctgattcccagggtcagagccctctctggaggctgactctcctctggtggggaaggtgcacagagtaaaaatcaatttaaaaaaagaagttacaactctaagatgccatcattcaaatgccaggcaacaattcttataattccatcttcttggttttctaagaagcttggactttaacccagaccagtgatcctagcatcctgggcgtgctagggtgcctgcagcgtggtgagtcctttggggacagtgggactgtcccctgagttcatgcccacctttgcccggggatggcaccgaccagctcaactagtttttaagctgaagagttttctttccccaagaggtccttgtattttagcctgtatatggagatcttgttaaaatgcctttcctatgtcattagggggtcttggattctgcattataacaagttctcagaggaggctgaagctactggtccccaagccaaaccccttcctggtttgaaaatcactggtttggctctgagcttcagttgtatgtgtttttgtatggttgaatggggaaggaatggttttggtataagaacttcttacaggtttgtctaaccaggagtattttgagcaatttgccacaggggtgaagttaaagttttcttcaatagtttgatgctgtcctggagcagagacatgtctgttgtgtacagctttcccagaaggtcttaaatcttttcagttattctgtttgtttaagggaaactgactaaccaggtatagggtcataaagcacattaatgcatcagataccgtgtatttacaatggctgctgttctctttactagtaatcgttcttgatgatagggccaactatagattttaaaaatgcatatttggtttgaatttcatactgatgacttttcctgtcagtaaccgttgcagggattttaaccttgagaacataaagtcttgacttacttaaaaaatattcatttttttttaaaacaaccttaggaacaggggagatggtccagttgataaattgtttgcttgttgcctagcagaattggtgagttctaggttcagttagagactatgtttcagaaaatggggtagaaagtaattgagaaagacacatcattctaccccctgatatctcattagtacacctgtatcacatgcacacacacacacacacactcacgtgtatacaaataaaaaagaagaaaattaagaaaattgaataaaatacaaatttatgaaattcttgattatttattagatttttttttttttttgttaacaaagtattaccaaagcataccaaactaattacttgaatgaaccattcctcttatttcatttctggcctgcaaggctcttatgcctttcctatagctttccctatgcctttacaaacctagattttcaaagattctggatattttccatatgactgttgatgtgcatttgtgtgatcttaaaaatattaatttgagctatggagtgataatttatttaatttgagtgggaattaacatagggagttgaggattcaaggggaatcctatacaatgggagttcagttttagggttctaaacaaaacattttgattggcatgtggagaccctttgttcacacagacatccatatttaaatatttatagaatataatatgtcaaaattgctgttattttaatttgcttagtttggctgattactgcaacttgatggtagttgaattctagatgaagagctctaaatacattctggagtgcaatatgctttgtccttgaagctccatgggttttcctcccacctctaaattgtggggtctttttgacaaacttgataaaccttcatactccttttagggaaaaaaatgaaaaaaaaaacctgtaaagatttgatttctttcttctaaatctagtaacatttagtgatttggaattatatgtttttaactatttctgtagactttgctttcaaagaagatgtcccttaatagactacttttacatgagatatgcttcatgttaatagcaaaagcatgtttctagataattagtatttatttattttatctcatttgaacagctaataattttcaagacccagattcaagcaataaaacatttctctgcaataccatgtggttttcttcaacatcataattctatgggggaggaaggtaagcatcatttttcagttaatattgaagtaacttttaacttaatagtttttcaatttgaatcaggaactctgactcagaaaacacctttctgttgacagggtgccactgttgcttggggcattatcaccactgttacccaggagaggagannnnnnnnnnnnnnnnnnnnatgaagatgtacagtccaaagagaaacggtagagattaagaacattgtaagaagctgagtgtggggtccactctgtaattctagctggtgagagtctgagctcaagtatggcgagcacaaggtcatctggccatgtggctgggccaccactcagctgggtgcggcttctctgctttccctgaacaggaactgagggtagttgaagagactgtgtgaaggctggttggcagcagagggccatggtaacagataggaagaagcagtgacaagtgttaggttactggcttatttggacccttagttcttcttagcccttagtccctttgccaacctggtattgggacctttgtgccttggcagaggccagttttgtatccctcagcctggggtccaagccccttgttcctgaagacttgagcttgctgcgactcttgcatacttcttttttgatctttatgaacgttatcagctttccactctcttgtctctgtgtttttttctttcttctctaaactccctcaaactgtttagtttttaaattattattttaaaatggtgttatttaaataaaaataagttttattttaccccaaaacataagttttagaccatatagttgtttgaattctgatacacaaattttgagatcctcctcttccccatacttttttttttttaaaatctagttacttagtgataagtgccttaatttcataagatctcaaatgtgagcatattaagcaagtacaacagactgcaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccccctctctctctctctctctccctctctctctctctctctctctctctctcacacacacacacacacacacacacacacacacacacacacacacacacacacacacagagccctgcagcaccttcttctcctaggttccaccatcttcaaaggctgctgctctgagctgtgtgtgtcaagatgtagccttgtgaggactgattgaccacatggggtgttatgcagctgagacctttagagtcatacatggtgtcagcatgtctcctctcctccatccttcctttgtgtgtatgttgtaatgttttcacgatttgctagaggagctccactcttgtcagttactcgtctcattggagaggtgtatctctactgcatgcttcaaaggattcatggatgagactctttcttgtgggaacttaaatgattcctggtcctttgagaacacaggaatttttaaccattagtactagattatttttcttccttaaattattcttccaggttttattttaagggtctttagttttgtgaacatgtggacttgatttcaggtaattaaattgcttctttgaaaacacagatcttcacatccctttattctaaagcgagacatttcccaacatttgtttccttggttttcatgaattctgatatgtccttgtaactcagtaacactagtggcttctacttgggtttcctcttctacatatttcagtgctccaaacaatgaaacaatccaaggctattgtggggctcacttgttctgtcttctttctttagagatcacttttcagttgtcttttcaatgtcagatgcataatagcttacatctggaaagtattctttcttatttgtttgtttcttctgcaatatagtctcactatgtagtcctggctggcctggaatttactggatagacaaggctggtatcagaaattcaccagcttctgcgtcctgagtggtggaattaaaggcatatgccactatccctggatagtggaaagtaattcttgaccattcttatttacttatagataagaagtataagtctccaaacttttttttaaagtaggagaatgatgttcttagcaaatgctggatctggcctattacgaattgattacaaatgccacataaaagaattaattttaaaatgctccctaaattaaatttattttagtaatatttccactatttttctacatgtaactgttaattgttttagctgcttttgacctaatagtaattattagtcatctgattcagtaaattaaggtccatgtaactctaatgatttataatggctgatcttgtttaggttgttctgtgcctcactgaagaatactgcctgtgaattggtttgattcctttcttacctttctctctttttttccttcttgaatttaatataacagaaccataacttttacttactatggggctttttatttatgtaaattgctgaaattgtgtgtatttgaaataattttaaacacctgatgaataagaattgacacaattatggtagtatgctgcgtggctttttaaaaaaaatttattctggctcttgagatgctgtgaagtggaatacatttattattactgtttggtcatctgtctcttccagtagtcataaagcagtggcaatataagttggggtgaaataattgagaatgtatcactaaatatgaaattaggtagaagaaaatgtgtttgggctaagccaaacagcaatgcccttcagtcctggcaaggtgtgtaaatgccagtaaatcaaattagtattagtcagtgagagagaaaattgacagaaaagagaaaataatagttatacagagatacagcctggggaaaagaaagatttacctgtgtacattataaggaccttttatagcagtaaataatacttaaaaagttgaaaacaatttaagagaaagtttaaactgccctccccccattttgttagtattgaaaatgacattaatgaaaatgacaaatttattaaatgcctgaattatgtgattttattacatttttattatcttatagagaattagttctattattgaatttttttaaacaaaattagtttttgttgtttcttaattgcattttgtgtttaaagaacagatgttttccactgtattatcttagtttcctccttccctgttctctgtctccattcttttccccactgagttggcgtatttgttttgaaacagtcttgtatcactggctggctttatattcaccatgtagttgagcataacctttagctctagatcattctggctccatccccatgcaggggctccagtaagacaggagctggccatgtaacctagggtggcctgtaggttgtgaccctcctctcccagcctcccagtgttggaatggaagcatgtgccatgcccatcactcttttaatggaaagaatttttctgcaattaatttctatttaatcactaatgtaaaagtattttttttttacacatttcagatacaatggagtcaactcaaataactagtgctttaaatagcaaataacaactgcccaactttgctattatcttaaccttttttcagacagatggagtgattataaatattcatatcacaattttttgaattaaaacaaactagaatgctttcttagttaattccatgtgacaagctgggttgaaaatttcaaatgaaaaaaaaatcattagttcaatgattagtttaatgaaagttaagtttccaaagttaacagaaagaggttcagtttgactatgttttaatgatatgcttaactgtgtttcttagttaagaaacactagggaggataaatgcttctgttttaataaactgaagtgaaatgtgtacattgacagtttttccaattgagttttatgtgtacatatgcacttgtgtgcatatatatttaattggtaacataaatgtagtaccaagagcaaacttatcaaatctgtcatgggttataaaatgtatggacagtgctggagagatgactcagcagttaaaagcactgactgctcttctggatggaggtcctgagttcaaatcccagcaaccacatggtggctcacaaccatctgtgacaagatctgattcactctactggtgtctaaagacagctacagtgtacctacatataataaatacagtaaatcttaaaaaaattaagtaaaaaataaaacatatggacagcttacccaactaaaaaattggaatgatattctatagactcaagtaattgtgagcattatgtgataacatgaataaaagtttttcaaacactgtgaaacattttataaagtctagtaaatattatctttcctttgctcattaaaaaccaaatacattagcttatttttaatttattgagtacctcttctttgctgagcagtacgaataatgctttacacatgattagcctcatttaggccttgtaacagttctgcttaaactcttgatcttattgatattgcactctagctcccagatttaggaaaatgcttagtaaaaaattacttgtatttttattgttcaaaaacaaaataaaaataacctagttttcttagtagcagaagaaataaataatttacaaacctttatccctttaaaactcagtattattaatcaaattcattggcagaggggagcttgccatattttgatttatttaacattttatacaagaagaatattataggattctaaatagaagtaagatcataaatgaaaagaaaacaacccactttgagaaaattttgtcaaggttttactcatttatcataaggcttgtctcagttactttgaagagacacagtgattttatttttgatcccttttgcttataatggtgctctctgctttcagatttgctgtgtaaagtttgatacaactgtagttgtagctggagtgttcagtttctttgtatatcatgtgagggcctgcactgcacttacttgttcagaagtttgcatttgtggttactaagtgccatgtactgctggaaggataggcttgggagacaacagtgaataaagtgaccaaatttatggagtttatattttgacagttatggtttaaacatgacgaggaaacagctagtctttgacagcagttagcagatggggggagttcaatacatactcctttaaaccatgatgagagaaattacataggaaactactcattttttaacttggtttgcttttgttgatttcatttaaaaatacttaagaactctagaattctagaaacaacctctcaaaaacagagttaagataatattaacaattaagaatatgctcatgttttacttttgtagtaatttattattttatagtttataatctcagtcttgttgcaagtatagtaatttaataccttggatattttgaatactggtttatcaaatttaatgcaatttgtacaaaaattatgtttctgtacttcactgttaaaatcatatctttgaataattgtgataatttacattatgattgcaagtaaaatgtttcaactattttgctatcccttgttacttaaattatttctttttagaagttttgttctttttgtctatcatagtagtctaggtttctttgattatggaggataacaaagttgtaaattttttgtctatatatttatgtctttgtctatctaatctcctaatatcttggaaataacttcagcacgtggtctgatggattttttcagtgctctataagttttcatagcaaactattactcagatatccattcttcaattttaattatttattaaattgagtccattgcttaggctctcagacttgagttttattttaatcaagaagccctgagtgtctgcattgtttctttatatttggaacagtaaaccttactagctggtccttcacctgtgtcagaacgctgtccacaaatggaatcctgcaaggggaattgtgagcacttgtaagaaaagtccaagaaaacatgattttgtgtgtgtgtgtgtcactcccagatctagtgaatagcaatgagtctactccagattattcattataactggctattgttatttgtttatattcctctgtggaaaagcacttttaccatgtgctgattgtttttgtgagtgtatacttttctcaaatgactcttcttaaccctcagagtctaaattgtctgatgctctgaataaagttggctattgcgtgagtccttagcccatctcatttatcagctccattctcccagatcccaccacctttagagtggtaaacaatctgaaccattacatagatttaagacttagaggttcagggttttgagaaagggaaaatatagagttcaacaacaacacaaagtattcttggtagacttaaaagaatttatttcagtagtagttaaacattaaaatagtaattgggattagtggtttttgagttatgctttccaacattagtcagtgaatatagccccttcactcattctatattttagctgaaatcagataaatggtgtttctaggatattcttttgaggtaattttttctctttgagtttttggttttttaaatgagtaaagaattgaggttcagaacaagataaataaatagctttatactttgagtttggggatcccagttcttcaactttctatttagttttccaatgacaatttaattgatgatcatgtgttttatgtatatattcttgtatatataaactttttttttacccccccttacaggaactatacaattttgttcctaaatatatgattttgtttcttctgtagctttagagttgcaaaatcactttcagtgatttttcatataggatttttaggggagagtaattttatttctaagagaattataagcatagtggttaagaaatgacaaacaaaacacataattaaagctgataaaaatgaatatttggagtttaaaatacacactcaaaaaatgcacactcacctaaggatctaaatgttgttagccttcttttgaaatttatgaatttctttattaggtcatattaatagaaaaatgggttttattatgacattttaatacatgtgtataatatacttatactcattcctataattattaatattttaaaatatatttgaaaaaaatgatggtctatcctgatccatttgaacctttgcttttgatgttttatatggttgccaactaactgatggttatgataacctttgttttgctaagattcaagtcagcttgagaatttatcctaaaaacgacaatttgcgtgttgaatagtgaaatgacagcagagtattgagatgaagggatatgagggtttgtagcactggattcactcatactgagaacttggctttgttttagatgatgaacacattagtttgaaatacatagttgaattgattttggttgattattcagatctgtaatatttcaacctatataagagttattacagaacatctcaatgaagaagagttaatggtacttagaattccaggtttagggtggactaatttgctatcaggtagaatcctattgtgtggttgacttaatatacatttaaagctttcacaaaattgtctttcagctttgtaaccaatcaataccacaaggttttttggaactccatgaatatcaattttttgttgttttatatatctttaaaaactcaagtgcattttttcactctttccacagcatgtaggatccatgaagcacaggacattcaagcctcccgcccgcgtcaccaggaagatctctttgtaagaataaccacaggattgatttccagagagattagcctgtctgaagcattatgtgttgaagcaaaagaaacctattttcttgtgtggctaactagaaccagagtacaatgtttccagttctttgagctccaggaagatagaggacagagttgaaactctgaaaatgcgggcatggactggttcctggcgttggattatgctcattctttttgcctgggggaccttgttattttatataggtggtcatttggttcgagataatgaccaccctgatcactccagcagagaactctccaagattcttgcaaagcttgaacgcttaaaacagcaaaatgaagacttgaggcgaatggctgagtctctccggtaggtttgaaatactgaaggatttgatgaaatactgggcttggcttttaggtatacaaactcattccatagttgaaaaattcttaaaatttctacaaactgtctgcaaaaatctgttttagcagtcctttaaaaagtgtcatgatacatctatatagtcaatctagataaggtctacatagttgtaaatcatattttgcatatgaattaatatataaaagctgtggtatttatgcttatattttatttacaaattatgtttagactatattgaacacaaatgttatatgatttgaattagtgcacattaacattttatattctatagactacaaagacataatttcttagttaaatttttaagatgaaaagcaaaagttcattgctaaatagaacagtgcttcagttgtttggaaaaccaaagtctcttatataagtggaaaacataaagtgacacacacacgcgcgcgcacacacacacgtgggcgcacacacacacacacatctgtaactcaacagttactgagattacgggttgtctcacacacacacacacctgtagctcaacagttactgagattacgagttgtctcacacacacacacacacacacacacacacacacacacatatctgtaactcaacagttactgagattacaagttgtctcacacacacacacacacacacacacacatacatatctgtagctcaacagttactgagattacaagttgtctgatacacacacacacacacacacacacacatatctgtagctcaacagttactgagattacgagttgtcttacacacacacacacacacacacacacacacacacacacacacacacctgtaactcaacagttactgagattacgagttgtctgacaactctgattctcttcacatctgagaatgatcatgtgtatagtgcttgttgtcacttaaaagctgcagggctagaaacaaagataggaaaacttttgcattagagatggtaattggcactactagcaagtggtacagaggaaaaagctgaaaaaaattacagtgcttttagagaatcataattaggcattgctgataatagctatcatttgttgggaatttgtcaaatgccaggtactgtgctaaagacagattgtttcactgaatttcaagatatgttcatgagattctagtactgttttcaatcattttacagaagaataatcataaggatgttaagtaatttagtttgcccaagagtatgcttttaacaaacattggaaccgtctttgaattctggtagtatagttccacagcctaaactcttattgtactaagctgaagacagaaaaagcagtgactcagaaaatcttaattaaaagtctcagtagagactttccttctagagatttttttctctttctttttcttttataatttaggctactgaataatcatttaattttctcctcattccatctttagtactagtgtttctttttttggggggtggtggtagtggtggtggtggtggtggtttgagacagagtttctctgtatagccctggctgtcctggaactcactttgtagaccaggctggcctcaaactcagaaatccacctgcctctgcctcccaaatgctgggattaaaggcatgggctatcactgctcggcagtactagtatttcttattttctttttcttactatgaagtaccttatttttgttgtatgaaggaaaacttactattaatatgggttgctttgcagaaaaataaccagtcttttaatattaatttttttattattttaaaattatgtgagcatgtgagaacctgtgtgtgggtttacactcatgagtaccagtgcccatggggtgtagaagagggcatcagactcttgagctgtacaggcttcaggtggaccctctgatgtctctgctgggaactaaactcagaggcaagatgagtacctgttcttaagtgctaagccatctctccagtccctcataagatctcttaagccacttttaaaaaatcttttgtacatctaaattaaatttctaacaactacataagagctgacatacttaataaatgtaaatgcaatctagaaacagactaaacaaatgaggccatttttataaataggcatataacacagtaaaataaatacgtggttattttccctcattagagaagtctcctgggcttttctgttgactctactagtagggctgtagacacaccatccatggggatttcattttaatgccaggacacgaatgatagcgggtacctgttagtactgagactttttttttaatcagctattttgtaattttgtactcagttcgatgtccatattttataataagacatattcataagccagaagatagattcagataaatttaaaattaggtaattcctttaggaattatttatataatttctataaaggcatataaattggagtttgaaaacaaatcaaaagcctgagatgacagtttttagaagattcaagacaataattttcaaaacagttaattaacctaattacaatttgcagttttttgatagtgacaaatttagaagacaattataaaccatatctctgaaggatataaatgtacaagcacagtgtataggtgtggtagtgtcagggatacatgaatatgtacaattatttggctcattaatgaatagtttccttacaagtaaaatttattacttttagtgttcaggtgagtgtgttttggcaatttgttacaattatgcaatcatcactatcaagttatatcagaactctgcctctttccagaattctgttgcttcttttagttaaatctgttcctgcttcctgattatgaatcctgtttatttgttgtctgtccactatgttttgcttttttagagtgtcataaatgaaatcatgcactatacagcctttggggtcttggatcttccatttggcttaatatatctgagattcatcagtattttttttaaaagatttatttatttttatggatgagagtacactgtagctgtacagatggttgtgagccttcatgtggttgttggcaattgaatttttaggacctctgctcagtccagtcagccccgcttgctccagtcaaccccagtcaactcaggcccaaagatttatttattattatacgtaagtatactgtagttgacttcagatgcaccagaagagggagtcagatctcattgcgagtggctgtgagttaccatgtgtttgctgggattttaactcaggacgtttggaagagcagtcagtgttcttacctgctgggcaatctcaccagctctcatcagtatttttatgcataataatttttatgcttttatattgccaagtaaatatttttattcttttttagtggtgagttgttacatgtatcacagattagggttttatttatttatttattattttttaatctactggggtcattagatattagatagttactacttttttttttaaaaacaattacaagcaaagtcaatattaatctttgaccagtaagttcctgtgtggctataggttttttttttccttagttaattacttgggcttggaattgctatactatatgttaagtgcatatttaacttagtaaggagctgttggatggtggggctgggaaagttactgtcttacaagtatgtggacttgagtttaggtccccatgtaaaggtgggtacagcagtatgtatccagaactgaggatgggttgaggttagggcatagagacaggtagatttctggagtttattggccagccagcctagttgaatttatgaatgtcaaggattaacaacatcagcttggagagggattctgaagaaggggtatctatctgggagttgtggaatgaatcaaagtcaaattgtgggtccaagttgacagcttgtgttctgctcaagatggctttccagattttctctctatattctgctagagacagttttcccttcctagtctaaaaactctggatagctcatttcttgcaatcaaaagcccagtcatctatttacatatcagttcagttaccacaggttcccttttgattatcccatcagtcagcatcccaggaccccagccttttgattcttagaaagagtcaacaatcacaagcacagagaataagatagctgggtggtaccccacccagaaattaccattcctaccatgcctgagcctggacctaaactccatctgtccaggctgaccttgaacttaggaatctgcctgcatttgtaagcacaaacaacttagtaagagcttgtaagagataacagctccctaaatctctttatctccttaatatctttccgacaagctgggtcatagtgcagctgcctctgttccattagctctgtgaagctcattacacaattcatgttgaatcctcatatttcacatagttgagaaatgatatatctttgaactcatgttttcagagttctttcccacagccttatggactgtcctgatagtcatgcagcatttaccattttgctgagactcacctctgggacttgctgtttctgattatcatggagtcatttaccacactgacacactgatgcctagtttcaagcaagcactcatagaggcaagaaaacaagcaagggagtatccagtttggcatacatctgattggaggcctattatagaattttttgccctttaaaatgattggttggtactggtagccaaaccataaacttttgtaagtaaatatctttaggcacaactgtaacttctgctttcttcttgattggtggttattgtggagtgacctggggaccagtgttaggtacaggttgtttaactcaagtttaaccttaggtcaggttctctaagatgcagcctaaattcaatttggattttgtttggtttctcacagcaacaatcaacactcgaggcccacgctctgctggctattccagaggcaggaaccacgacattctgtcccttacatggccaggccagactcagcatatgagcctcaggttcagtgagagactgtttcattaaggttagagagtgatggaagaaggcatctgatattgacctctgacctttgcagacatgcacacacacccatatgaacatgcatatttacattttgtattgaaagacctctgaaacaggggaaccctcactcaagtcccaggatgacgcgacgcccaggaactcatgagagaccaatcttgatgcaaacagcaagaggtttaatcgggaaaggccagtgcactggggacgactcttatcccactcaggggtagaggagtcaacctcaagctcaaggggtaaggggtttataaaggcagaaaccgcaaacacctggtattgggctatagcatttgacaagcataatgggttcaaggaacagttagagtattctgtacgaccatttcctgaaacaatggagcaagttaaacttctttgtggttagtacatcctggaacaatggggtgagttaaacttttactccctgccattagtgaggtcaattttggacacaagtctaagggcttacataattttttcactctctctcaggatcttttgatatctctctgactcattaaacagcactatctaatttctgtcatattagtgcttgctactggtagtgatttttatgtcatcctttaaaactggtatatagtatcatctcattgaagtttcagtgttcacttctgtagttaagagtgttgaagattcttttcatgtatttacttgctaagttttgatagcgtatttgagtctggttccagttttctttgtggtgtatgtgtgtggtggggttggtgggttgggggagggaggtgcatgtgtatgttgtgtacctatcatctttgctatctccacggcatgttcctgtggagatttgtggaggccagaggaggatcttttccctagggacagagcattgaccatggaacccaggctagtgactaacaagctccggtgatttttctgtgtataccattagactacaggcatgtgtgggcccacacctagcctggcttcttttgtgtgtcctgggttctgagctcagcttttcctgagccatctatccaacctcattgctggcttttaaaatagttatttattattatttttgcttaaaattggggttttaagtatataaatatatataagtaaaattatatgtgtgtatataatatataatgtagtataatggagcatagtataacaaagtaatattacagcttaaaacaaccacttatgatttttaaaatttaggatggcctcaggctatttctgttgttatatatgactgtaaacatctctgactctggctaggcaatccaggatgatttagttacatgtttagtcaaaatcttttttcgttcagtgtttcttctctatctgggtagcacagatttttagtgttagaagactttcagctgtatgtttttatgttctatgttttttctctgttatatatttgctttctgccttattgatttctactcttagtttgataatttcttttcttaccctttctttgggatttatttttctgttctaagctttcttaggaagcttatatcactgattttaaaagttgcttctttttaatgtagattgaatatcctttattcacaatgcctgggactagaacatattttagattttggactatttttatttgggaatatttccatcaactttactggcagaatctgaaatgctttgaaattggaaacttttagagttctgataaagctttttaaaaagttttaaattctgatttaatttgaattttgcattttggatcagggatgtatatacctgtatatacctgagcagcttcactttaaattaatctgtgtcttacagcttctgacaatgttgccttttcattgtcatccaataaaaatagtttcaaatattcattgtgatctgttcgcaccatatcatagttacctagtattttacttaattagtacattgggctgttttatttatcattttggatttttgcatttttcaaccaaataaagttataattctgcattattttagttcaagttttactttatggcctagtaagtgacttttgttggttaatgtttaagaaaaacatataacctgctgttattggctctaattttctatagtgtattgtttgttaggttagttgattgcggtgatcagattttctgagttcatgcatggtgtaaaatatttaaatgcttgttttgctaatttaaagatatggttgttcctatctcctttcagttctaatttttcttttcatctgctgtttaatttgttgagtactaactcagtactatcttgttttctgtgatttaaccccttatcacaggtttcttattttaagcaaaacctttttgtgtataaagttaacttatttaatattaatactgttaggtttgtttgtttgtttgtttgcttttggtgttttgtttttggttagtgtttgcatgtgtttggttagtgttttaaaccttaactgatgtgtgcctttacatttagacacaaatttaagtattcaaagtgcttctttttaataggatagtgtttcatcttttttcctccaagtctgagagcctcatcttactgaactgttttagccttttgtattgaattctatttctgggtttacatctttttaccctgctaaatttcttccccatttgtcttatctcctgtttttgtcttttgaatcccaatcttttattattctgtctttcaccataaggtatatcaacttttaaaaatatatcatattatttatatgggtgttttgactacatgtatgtttgtacacgatgtgtgagcctggtcttggccagaggtatcatatcctttgtaactgacattacggatgttggtgagctgccgtaagatgctgggaatcaaatcctacatcctctggaaaagcagcctctactctgaactctgagtcatctctccagcttcattataccaactctgaatgggtatcttagtgtttataaaatataccctttggggctggagagatggctcagtgtgttaaaatgtttgttgtgaagcataaggacctgactttgaatctcctgtacccatggacttttttgcatggctgtatgggtttgtcacttcagaattttgtgacagagaaaggaggctcacaggagctctctgaggaaccaacctagccaaaacagagaaagaccccgtcccaaggggatcatagacacctgatgtccactccatacatacacctgctgtatttgcattgtacacatatacaacgcacatatagtaaaattaaattcttccttgttattatttattcttaatatttttgcattgctctggaatttctaaaaagtcttgtaattttcaaaaatttaaagcctcttccatttggatgcctttgttgtggtgttttatagaccgttgttgtttcattacttttaaaaacaaactatatcaaaatatatgcatatgtgaaattctcaaacaattaaaaccttctctcccatcgttctgtcaatgtaaacctggagcctaaaaccttaattaattgtttgcaaaaatgaaatgtcagaaaaataactgctttgaatttttttttatgctggtaatatgatctgttgtctagatgctataaataaggatgatttagaagaaaatcattgtcatatagaaacaaacatgcccaaagtgaagacttttttttcttcataatgttctttgctagttaacattgatgctactgcttagaatttatgataacagaagttagggagagacttgggttatttgtttgtttgtttgtttttgttttcattttcttcaaaatgaaattgttgcttcccaacaataattgggatcctttagggatcctgaatattaatagaagcacagatttgaagggaagcatctgttacttaagcttttgaaagtcttgtatgttttcccttcagtgttgacgccagcatagactgtcttgtctgcttctcatggcccccaccccagacatgtgactaggaatcattggtatgccatttaaaccctgtcctactcagtacttgtaagtgatttcagtgggtatccagtcacaagtcacaaaactgtgatgtctggtgtttatcacataaagtttccttcccctttggggtgtggtaaaaaagaagaaagtctaagaagttatgttctataaattcagtgttaacagttttcaaacattcaaaagtgaattaaagtagaaaaacctagtcttaggcttgactacattttatcccttttatgtttactgttttcttcctatagtttagttttggaatattcccctagcttcaagcatatcttatcttttagtaatttttatgatgcttgttttcagggcaatagattatttcagatttttttttcattttttaaagttttatttttggacattattttttaagcaaaagtacagaatttggcaatattttaaatatcattctatgtatgtcatacttataaaatactgttgttattccttttgctactagaatgtcttatttttcctaagagaaaagactcctctgcctgagaacatttctgtgggtttatttcagtccagatttctaagcatcattacactctgttgagaattctgcagttatcatagtaaacctttgtctttggctgcatatatgtttttctttttgtcttagatattaatcaattgagtgtgatgtacctattacaccttgattttcttttacccagtttgtagtttgctggactccttaaatatgggagttgatgtctttgaagatcaatttcaggagttcaaatatggttcctgacttagtctttctcatttctccttctagaactaaaaatgcatgaattattaaacctccttttacagtgttacaagcttttattgcatctttgctaatctagtgactctgttattttattttgtgtattttctactcagctatcttccagcttatctcttgttagaaaatgtgatatatttgatattttgattctacaatatcaagtttatttctttgaacttttcaaatttctttggatattctcttttttaaaagtttgtttttagggctggagagatggcttagtgggtaagaggattgtctattcttccagagactctaggtataattctcagaacctatatggtagctcacagccttttaaaactccagttgcagggaatcccatgctctctcctggcctctctggacatggggtgcatatgtagggatacatgcacaaaataataattaataaaaactgtcaatgatttctaaatttcttttaatatttatcctagtgtaaccatgattttctgctcatttcaatttctagatcaccttttgatttacttctgctgagttttcatttgattagtgaataccttttcattttgcacatctgtattagttatatgccaagcattgcatgtaaaagtactgtaaaaaatacagactctttccttgttagaaatgtgtcattactgggcttttttgcctttgccttctaaaagtaatgatttttatgtgggttttaaaaaaattctttaatttttattttaattgttttgaataatttcgtacatgtatgccatatatgctgaccctagaccccatccccatacctcacctttccgtgtgtctctaccctcacacattgccacccactctcatgttcctgccctctctataaaagtaaccaggaccatctctgtgaccatggggttaaagctgcctgttggaacatggtggttacacaattaaagatagtccctcttccggactctatcaataagcagtagttcagggatacagggcagaggcctctgcacacttttcttttccttaactcattgttgatacggccattgtttctgggcctagttcaggtaactgcagttattgtaagttgtgattacattgataatgttgagtctagagaatgtatcttgcagtccttcagaacttttcttgatttagcttttacatgcttcctggcccttcttctgcactgttacctgagcctcagaggggggggatacaagtgacatgtttagggctgagcatacaacttttgcttattctcttcaccttgagcagaatcttttcatttaccgggacaaaggagaagcttctctgattaaggcggggagctgcttttgtctgtgggtgtatgcataattatttagaaggcagtttgctgcctactggaacacacgtcccagatttccatcagaaataactctccacaggtcaatggtctcttcaaacctgggttgttagccagattatcgttcattctttgtcacctcctctcataggacttaaatctagttagagggcagttggttatcacctatatagtcaagctcctatcacatgtatgggcatgtcttactttccatatggtcattttatatgaccattatacttcctttatcctgattaatcctccctgttctgataccctgtcgtgctgcccactcccgtctgtctaagcctttctacccctgaactcttccccttacattctgcttgcctgtgtcttactcctcctccagtcccttccttgttttctggctttatgaaaattatgttttatttttgtgcacatatatgtgtgtgcatgtgggcatggctctgccagtgcttttatgtgaatgtcagaggacagtttgtgggaattggttctctctcctcaccatgagctcaggccattggacttggtaacaaatgctcatattctaggaagcatgtctgtagaaattttgagtgttgattattagtctcttgtcacgagtagatttgacatgaggtctaacatagatatgaatagactcactttttgagaaggagcaagcttaaattaatttggatgtaaaatacaataattttacaaaagcctataaatattttataatgctaagtctaccaatacatagacgtagtaaaatgattataattcttttcagagtagagccacagctgctgttaattttgtgaagatgttctcattttgttatatttcatctcctgggtgctgagttacagtaggaaatgatgtaagaactggtgttaggttttctttttattcctgcatctttattttcttaacatttgctatagtagaaatggcaagacagaacaaaaaaatgtctcaacactcctccagcacctgctgttctttgtaaggatctagcaggccagatcatatgtgataatgaacttactttctgtatcagactccttgaccccttatttatcaataaacaaatttaacagaggagaactaacattgcaaaaatggtaaaggaataattattaaaacgtactgagccttaacttgtgtgtacctgacagcagtgtctgatacataaggcaaagagaagtagataagactgttaataataactaaaaactgcattgcccctcttagagtaataggtcaggcaaacaaaattagttaaacaaatatatccacatttgacatgggcagactaccagtgaacctgacctagttaacatgtaagagtattctatctcaccataacaaatataacaaataacaaatgtactttgccatgagtacactcttactctgatgtgtagcctctgtcatttggattagaaattttttttaatattttttattacatattttcctcaattatatttccaatgctatctcaaaagtcccccatgccctcccccccacttccctacccactcattcccatttttttggccctggcattcccctgtactggggcatatacagtttgcatgtccaatgggcctctctttccagtgatggccgactaggccatcttttgatacatatgcagctagagtcaagagctcctgggtactgtttagttcataatgttgttccacctatagggttgcagatccctttagctccttgggtactttctctagctcctccattgggagccctgtgatccatccaatagctgactgtgagcatccacttctgtgtttgctaggccccggcatagtctcacaagagacagctacatctgggtcctttcgataaaatcttgctagtgtatgtaatggtgtcagcgtttggaagctgattatgggggtggatccttggatatggcagtctctagatggtccatcctttcgtctcagctccaaactttgtctctgtaactccttccatgggtgttttgttcccaattctaaggaggagcatagtgtccacacttaagtcttcattcttcttgagtttcatgtgtttagcacattgtatcttatatcttgggtatcctaggttttgggctaatatccacttatcagtgagtacatattgtgtgagttcctttgtgaatgtgttacctcactcagaatgatgccctccaggtccatccatttggctaggaatttcataaattcattcttttaaataactgagtagtactccattgtgtaaatgtaccacattttctgtatccattcctctgttgaggggcatctgggttctttccagcttctggctattataaataaggctgctagaaaatattttaaaggctcctttagatggtcttgctataatgagtagggaagtctatatatggagttgtacattgtgtagtgtgggctccagaaaatttcacttatttatagaatcagctggaattcttttgtgcagagaaaatttctttccctcttcatttccacactctgttcacttcttaccccaacaaagatgattcaaatagaagtcagctagatggatgactgtgtccaaggctgcaatcttatgagggggtaagaagttgcttatttaaaaattatttttgcttgtctgttgtctgatgtgtgctcttattctttcatttttccatgtgaatgtgactgttcaagagcagcttgataaaactttaaatttcaaggagtattttgaacttgcctttagttttatttattttatattctgttttttcatataatctttacctatctatcatctatctatctaactatctatctctagtttttaaatatgggtttttaatttaataaagatgagtgcagaaagcctaggttatgaatagcctttgtttatgaagtgacagatggattgttgatgttgacttggaagcatgtattttgttgaatgcttgataatttcattcaaaatacagataaaaatgcaagtggaattcccaacaataaattaagctttcatgggagtaaataattttggtttcgttctccctagggatccttgtagtaactgtcttgctaaagatagattcccccacccccaccccctttaatcttgcttgggtttaaaagttggcaaactggccagtggaacaaatccagttcctctatccatttttgtttttgatgacttccaggctaagaatgcttttttgttttttggttgtttgagtggggagtgtgtgtgtgtgtgttggaggaacagggggacaaattcagaggataatattaggttttgtagcaatgaaccttaagctcttttttatctggacatttatagaaaaaattgttatctcaaaacttgtgtgaatcagatgttctcattattagctcttgtctctttcagtgtttgaattattatgcatattacatgtgggtaaagacaggctctgaaatgaaaatctagttgccgatactattctctggtccttgctgactttgctttctaagtcttaatggacttactccatatctcagatttcttttgctttttaatttgttcaaatatttgtgttttctctcccagtttcctttagatagctttgtgtttggagctgaatggtacctagggaaaggagatatggtaggctgacaaagaaaccatccgatatacagctttagagatagtggatctaggtagatgcattttatatctgaattatgtatatgcatatagaaacagatatatggacagaagcacacaggctttttttcccctcataacttggctctttgaactcaactctatgactttaaccttttttaagttgatgcttttacatatgtgaaaattttatttgttcacccttagctgtatttagaatacagtgattgcagttattgtcactacccagaaaggcccctagtgaaaagacaccagttttggagaaagatttcacatgcagcatctcaatgttcagacttctttccttaaacaaatgccacttaaagtgtgtttgtgttaaattaaaaaatgtgtgaagatttagcttaggggcttaattaaacatgttttaaatttaatgtatgtgagtgtttcccctgcgtgtatggtttgtatacttggttgcttggtaccctcaaaggtcagatgaatgcttttgatcttttggaattggagtttcagatatttgtgagctaccatataggtactggaaactgcacttgggtcctgtgcaagagcaacaagtattcttaactgttaagccctccagcgcccacatggttttctttcatcttctttcttttctgagatgggtctcaccatgtagctctggctggctaggtactcctgatgtaggcccagagattaaattccaggcagttgggccattgcttttgtgcctctggtgaaggagatcatgctggaaacacatggcagaagtggctgctcatgctatagggacagggaagttaaatagagagggaaaaggtagagttcctatagttccttattcttccaatgccttaccttttaaagttcccacagtctcccagtggtaccacagaatgacagctctgtgtttaacatatgctcttttttcagggaagggggcacttatccaaaccatagcaatggtttcagagagtaatttaaatctgcctaaggatgcagtatgcctttggaacatgtgtctttttactgttcctaatgtgcctgcaatatttctaggtatttcagaaatgttagatgaaatttaccaaggaaatagtatttagtctatttacctaataatagaaccagtttagaataaaaataaagctgacttgagtaactggatttggtatataagcttttgattgcagttgttactttgaagtgtttattcccagcatttagcctttctagaatatatgcttagaacacatgtaccaatgaacaagaacatcatatatactatatattaaaagcattttaaagtatcctatataatagcatagtagtatagaaactttggttaattggttattgataatcatctaagagaggttatatttgttactccttttacttttgtttcccaacacatttgaatgcacagaaccactgctttgagatgttatacctttgcctgatctttttcttactgaaaaccaaacaaacaaggtttatagaaattgcaacttaggttcatgcttctttagctgctcacttaccccaagtgcagagtaaccatctggaagctggtcatagtgtctgcagcctgttacaaagtcttaaattagaagagcaattagctgcttctttatgcatcagcctacatttcctataccagacatgggtttattaatcctcagagatacagtagacttgatttaagtgttctatttttaaaatttcttatatttagagactcaagcaatttaacatgtgtcttgcatttgtgcatttataaatgtgcatacattgacattcctatctccttctctatgctctttctccatctactgaaggtctgccatgtcttcaaggactatggcaaataaacttctcagagcctttccccagtcttctttcataaagttactctcctatgatctctgttaggacttgttttagagtctttaggatgtcagtgtactggacatgtattaatcccaacaccagggaggcagaggcaggtggatttctgagttcgaggccagcctggtctacaaagtaattacaggacagccagggctatacagagaaaccctgtctccaaaaaccaaaaaccaaaaaccaaaaaaacacgaaacaccaaaaaccaaaaaaacaccaaacaccaaaaaccaaaaaccaaaaaaacaaaccaaaaaccaaaaacaacaacaacaactacaaaaaaaaaaaaaaaaaaaaaaaaaaaaagagcttatataggcctgttggtctttctgttctaatttcttggaagcaatgtgtcacaaagattaagttgtgaaatatttttaaactttttattgaaaaaaagtattactgtttctatgatatgtacatgcaggggtgtgcatgtcattgccctcatttggaagtcaaagggcagcttggtggagtcaataccctcctcctacctgtagtggactccagggatcaaactcctgtagtcaggattgggtgacaagatctttgacccactgagctatattgctgtccctgtcattttttaaaggaatacaattatttatacttctaatacaaatttcaagagaaattaaagacaagtgctcccttccctttctttcctcttccttcttttatcttgactgatttttgttggggacatttatttagccaaatgtaaaactctttaagaggaaaatttgtaacactatttagttttgcaaatatcttgatattttttggttaaacttttagaaaaaatgtgtgcttttttttttacatcaaagaataaacattaggaagacttgtggtaattataggagggtaaacatgcaggtggccagcctcatgtgtcttctccactgaaccccaccttcctctctccaagtcttactttagcccaaccttaattattaagattatcattgatgcttaaagtttgtaaaatcatagtttgttcttccaggtgatggatgtttttgaaactttaaaaaagagaaactgggtattttatacattatgttaaacgttaaaacaaattgcttattttctctgtaagatacatttctttctgataaggacaaaagtgtggtgctagaatggcttagaattagacttatgttgtcatggaagctgctgaagcaattctcagtgtctgtcagcaatagtttaccattaccctgaaactccttagaatctagattcttggcttgcactctagacatactaaataacaaatctggggatggaactcagaactcatttttaaaacatacactttacacacaaatataaaatgtgtgtgtatataatgtacacacacacagtgggtgtatgcaacgtatcttgatcatatccactccagactcctgatgcatcacccttctcatctttatttttttgtttttaaaactcactgagtctaattagttctgcatatatatggatatggacctatccatggaaaacctacaaatgaccgcattccctgaagaaaagaaatagtttgagaatcatttttctaaagcatagtaatttgatattcatgttactgtgatcaaaagttcataacaaaaaaagaaaactgttactagtggtgagtcatcttagcaatttactataggttgttgcaggcatctgtaggacaccagtgaagttaagtatttatatatcatctcctgcttaaatgtagagcatcatatgttgtgggggaaatgagagttcacgtgggtcgaagtatgaaatgtagtgaatagagtacattcctagcatggagaagaccttggaccagaagaaaacaagacataaatacaaagtatttatttggcattctgtattgtactcattttaagagattgttggttttgtgatatttaccttaactatgcagccatagatttttttaatagcatgaactattgaaagaaaagtgtagaatgttgttgttgatatttgtgtcagtgaatataagacaacttttaaaatttaaaatttaaatttttaatttttttcatcctaaccttgctttcttttaatttctttttttcttttnnnnnnnnnnnnnnnnnnnncctccctctctccctccctccctccctctctccctcccccttcccttcccttttttcttcccttccttccttcctttatgttttaaagctagggtttctctgtgtaactccagctgtccaggaactctgtagaaatccacctgcttttgccttccaagtgctgggattaaaatgtgccatactgcccagttttttttttagcctttctgtccaattaaaatctcatctaatctgttttcaaagatctttagtatataatatgtgatatttgattattactagagatcaattgtttatatatatgtatataatatatatatatattttttttttgatttttcaagacagagtttctctgtatagacctggctgtcctggaactcattttgtagaccaggctggcctcgaactcagaaatctgcctgtctctgcctcccgagtgctgggattaaaggcatgcgccaccacacctggcttattctatcaatatattgacagcttaacagacttttattttcttagtttgggtagaatacaacttgtattgtctactatatcttcctgaaactattagaatattgttgcctaactataagttgtagttttgagttttcattgagggtaaagaaaaacaggacaatgttctcgactatattgtcacatgaagattgaactgtaaagtaacataaatgttagcatggtaagttagaccagcatttttttctcccacccaactaaaaccatatataaggtcctgaatttctaattgtagttgtatatatgttttattttacggtaatgccatattaccatgataaacatatatgaatttttcacttaaagtttatgtggctctgggaatggagttgtcatggaacaatacttacctagtgtgtggatgcccttgattcaatctccagcactgcataaattaggcacggtagcacatacttgtaatagcaacactttggaggtcgaaacaggaggttcaggagctcaaggctatttaagatcctaaaggaagtcatccgattttcaactagaaattgtatactattgtgaaacattttgataaaaatatgtttaattattttaggtaggtctataatattagcatttcgtggtattgtttgcttcactaacatttattctcagtatttcataatttgcatcctaaatttcagcctgtaggttgagtaaccttcagttctccaaaatcagtatgctttgcgtctatgtattcttgtatactttccctgttatgctgatttagccctgctcagctttcctaagcattttcagaacatgcatttctgtatgcataggtgcatgtggagacctgaagttgatatgagaatcttcttggtttttctttttttttgttttgttttgtttttcaagacagggtttctctgtatagccctggctgtcctggaactcactttgtagaccaggctggccttgaactcagaaatccacctgcctctgcctcccgagtgctgggattaaaggtgtgcgccaccacacccggatcggtttttctttttcttctttgaagcagggtctctcagttgtcccagaactcatgggtacaagtaatgtaggtaaccagcttgctctaggaatctcctgtctctttgccttttgatttctggaatatgggccatcaagtttacctagcgtttatgtgggcaaatgggatttgaactcccatccttacacttaagtagcaagcactttatccactgagaagtctccctagccctttcctgaagtatttctcatgagtgttaccgattctttaacatttcaactttctctgagagttctttcttggtccttttcatccccataaggtaccatttccatgtattctctcagcacttatcatttattcttgccattatacacatttatcacaatgtgttaattttatttttacatttgtctattgaattgaatctgaagtcagtgtgctgaaggagcagatatattactaattgtattatagtatccagaacttgatatctttaataaaatctatcgagtgatgaaacttgaatgaattttattcaaccctcagtttatatggggattatttgtttctgattataaattattcacacatgtccaatttgtgcctttcatgtcttagttcttacacattacttagctcagaagtttgattattgcacagataaattggaatttaggactatattttgcattggtcttaagaagcatctgtacctctagatttgtcactgtattattaaaatttaacgtcccaagatgacatccttttgttctgaatttaaggatttgttgctctgtctccctcctctcagtcaaagtacacaaaaggctttccgagattatttttaggatgtgaaagaaaaagaatatatttgctctgaggtattaagaaataaacagcaaatggtgatttctttagtaagatgacaaattgaaaagagattttatttgcatttgtgaaaatgatacaccactgttaagaatgataaaatgcttttcaagcaatcctgtagcacatctatcgtgataagactgctgaacaaggggaatcgttccattagcttgtgtattgttgctgattatatgtgcttgatgctaagggaaacttgtaggaagaagtgtgactgattttggaaataataaagtcttatttcaaggcaggctttctatggaaaaactatcattttacacaaaccttcaagagttctaaaagtaaagaaaaaaatcaaagttttaagtatgatcagtaagaatgttttagatcagttaaaaatcatacttgttcattgtcctgtgtttacatgtaaagtctgaggcaattgtcaatggattattagacaaagatctgttagggtttttatttgttttgtttttctttgcattccttgaaatattatgcatctttaaaatagtcttagactgacacataaattatggccttatgaaaccttattaatgaaattaatatcagttgtcaaaattagatatttctaaattaagtatttatatttaggcaagttcttatgaaatgaacttttgtttattaagaaacatgccatgactcttacaagattaaaaaaaagttaggccagaaatatgacctagtgcaaatctttattttgtagccatgtcagaaacctcagtcttgtgagtctttactccctgtccctccacttgctatacaggtaatagtagaaagtagtgtgttcatgggggtgtgaatatcatagcctttcaaactgctaactttttgttttgttttgttctttcattttaaatgtttttctctctatcacatacaaactcttcatccttttttagggtggctcatattttgctgcccttcttgagtacctcactatcaatgacattatgtatgcctagtgagtgagtgaggaagcaagtgaagaactatgctgtgttcacctctagccttcacaaatgcacacatgtacatgcacacagagtatgaataacgttgcttctaagtcttttggattggacatgtctttgcaacaagtatatttttagctttaacatacccagtacatttgtaatacaggatacagacaaatccacaggaaatgggaagagtgtagatgtttgctgaagttgaagtatcttgacttagcatatataattgtttttatatgtgcatctgaaggattaggaccagtgggggggggggaatcccttctttctcttctactccaaagtttaccaaactatgggaaatgctaaaaatgtgtgttatccttcagccacacagcaacaacacgcaaggaaaaccaacctttttgtaacagataacttttacgtgaaaatgctcacctcacaagggtttttttttttttttttttagtaacttaatattggcaaacttgcctgatagtgctgagggaagagagattaagctgcctaaagttaagtggtgttattacaattgtaatgtggcagcaggtggagaagctgaagaggatcttccttggtcttgacctctgaggtactaagcttgcagctcgaatgctttatgactactacctcatctctaatatcttatctgggaagtggttgtgctgtcccctaaaaaattctgcataaaacctagagaagtttgtgcattaaaacaggtttgtgtgtgccagtgtattttatataatccagcagcctcaggttttactgataagatcagtggttcaggcaaaatacagattatttgtatcaaatctttgtgtgagctggtcgtaactacaaaggtataagcgtattgcatgataacagtttttaaaactagcaataagcaaagggacattgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtctctctgtctctctgtctctctgtctctctctctctctctctctctctctgtgtatgtgtgtgtgtgtatgtatgtgtgtgtgtatatgcgcactccagcttcatttttaaaacaagcccaaatctctgtggacatgtattagtatttctgtgtctgtcttctctgtctgactgtctatctgtcagggctttcactatggttgtgagctgtagttgctcctttgctggaaagtagttcaggaatatgtgactatttgtctgtgaaataaataacttctggattaaagaatggcccacaatttactttccccttactaaataaggggagttttcttttctgggagaataaatatgtgagttgtgaagttgtcttttattatcaagggctttttgaatttcaactttagttggaaagggaaaaagtaacaactgcacacagaagatggactttgtgaactaaaggtcctccagaagcagctcagctctccagcagggctctgaccgtgggcttgtagttgaggactgccattcttccctataaacagcttttgtctgtttcattttggaatctggtaatttatactctactgcaagctttgagacccattcagccacctctttttttttttttttttttaataactcctagaaggaaacatttagaagacctctgggttagatagatgattaataataaccctattgatgtgacttggtgaaagaagacagaatataagtggagtgctatacattatagtagctgttcttactatatttttttaacactggagaaagtgaattaaggaaatgtttcaagtatttgctttgaaagttaggcagtttgttgtgataagtattcagctgggctaatgtgctctgactttacgttaaaaggactctagtcattgagatctgtataaatgtacacgttgaagtttttatgtacatctgtgtatatacatttatatatatttttgatttgtgataaaagaatatataaatgtatttgcttaaatctggactaatttatttagctttggttagttttgttgtggtggtggtggttgtggttgtggtggtgtggtggtggtggtgctggtgatgatgatggtgtgtggggcagtttgattgaattcaggtcctcatccatacgaggcaagctagttaccagtaaactattctcccaatctccctccacactgtgatcattttttttctatcttctccctagcctcgtttattctcttgtggagaaaataatgttttgtttccatagtcaaatgatgaagacaaatttataaatgtcttagtggttttgagataagcttttgaacataaaacttgttttgtctgagcccagtttccaaccttacaaacaacaagaaagcaaaaagattcagttatcaatgctaaagcagtagtaaaagaaaatggtatggctgtcctgctgaaagcaatctacagattcaatgcagtccccatcaaaattccaactcagttcttcactgagttagaaagggcaatttgcaaatttatctggagtaacaaaaaacctaggatagcaaaaactcttctcaacaataaaagaacctctctctggtggaatcaccatgcctgacctcaagctgtactacagagcagttgtgataaaaactgcatggtactggtacagcaacagacagatagatcaatggaatagaattgaagacccagaaatgaacccacacacctatggtcacttgatctttgacaagggagctaaaaccatccagtggaaaaaagacagcattttcaacaaatggtgctggcacaactggcattatcatgtagaagaatgagaattgatccattcttatcttcttgtacaaagctcgagtctaagtggatcaaagaactccacataaaaccagaaacactgaaatttatagagaagaaagtggagaaaagccttgaagataatgggcacaggggaaaaattcttgaccagaacaacaatggcttgtgctgtaagatcaagaatcaacaaatgagaactcataaaattgcaaagcttctgtaagggaaatgacactgtcaataagacaaaaaggccaccaacagattgggaaaggatttttaccaatcctaaatctgataggggagtaatatccaatatatacaaagaactcaaaagctagacttcagaaatttaaatattcccattaaaaatgggtacagagctaaacaaagaattctcaactgaggaatattgaatggcggagaagcacctgaaaaaatgtccaacatccttaatcatcagggaaatgcaattcaaaacaaccctgagattctacctcacaccagtcagaatggctaagatcaaaacttcaggtgacagcagatgctggcaaggatgtagaaaaaaggaacactcctccattgctagtgggattgcaagcttgtacaaccactctggaaatcagtctggcagttcctgagaaaactgcacacagtactacaagaagatccagcaatacctttcctgggcatgtacccagaagatgttccaacttgtaataaggacacatgctccactatgttcatagcagccttatttataatagccagaagctggaaagaacccagatgcccctcaacagaggaatggatacagaaaatgtggaacatttacataaaagagtactactcagctattaaaaacaattcatgaaattcttaggccaatggatggatctggaggatatcatcctgagtgaggtgacccaaccacaaaagaacacacatgatatgcactcactgataagtggatattagcccagaaacttagaatacccaagatacaatttgcaaaacgcatgaaactcaagaagaaggaagaccaaagtgtggatacttcattcctcctccttagaatagggaacaaaatacccatggaaggagttatagagacaaagtttggagctgagatggaaggaaagaccatccagagactgccccactcggggttccattccataatcagcaaccaaatgcagacactattgcatatgcaagcaagatttcctgccaggaccctgataaagctgtctcttgtgaggctaagcctgggcctagcaaacacagaagtggatgctcacagtcagctattggatggatcacagggcccccaatggaggagctagagaaagtacccaaggagctgaaggggtctgcaatcctataggtggaacaacaatatgaactaaccagtaccccccagagctcgtgtctctagctgcatatgtagcagaagatggcctagctggccatcattggaaagagaggccccttggtctagcaaactttatgccctagtacaggggaatgccagggccaagaagttggagtgggtgggttggggagcagggcggggggagggtataggggactttggggatagcatttgaaatgtaaatgaagaaaatatctaataaaaattgtaataaaaagtaaaattaaattaaaaaaaaaaagaaaaaagaaaatggtgttaggatatggcatccactctaggaacagtccagataatgtaatgcactgcaggaggtgaggagagaggaattatcccaaactcaccagcatccctgtgttccaaaccttctttccccatttgcactgttcatcatggctctttacctctatcttaaagcatgtctgcaagatcagtgttctctaatgaacgaaagttccctttttaggaatatgtttcttgatttggttatgagaattttggaaaatattattaaatccttactcatgctgtgagcttgtgttatgcagatgacttacaagttgtgctgcaggaggcctatatttggaggtgcaggaattattttggccacatattcaaagatactctgtctttcaagatttctgagtctcctttcaatattttattccaaatatgttacttctcaagcacagtttatcatgttgtcgtcattattctttaaaaaatttgcaatggagcaaaaattacatttcttttatttattttttttttttggtttttttaaattaggtattttcttcatttacatttccaatgctatcccaaaaagtcccccatatcctcccccaccaccccccctacccacccactcccacttcttggccctggcggtcccctgtactgaggcatataaagtttgcaagaccaaggggcctctctttccaatgatggccgactaggtcaccttctaatacatatgcagctagagacacgagctccggggtactggttagttcatattgttgttccacctataggattgcagttcccttcagctccttggatactttctctagctcctccattgggggccctgtgatccatccaatagctgactgtgagcacccacttctgtgtttgccagcacagattctcatgttacctgtaagtagcatgactttgtgtcttccccttctgtttacttgttgtattgaatggaaaattgagagaagtactttttttccagtcttggggaatgaatctgtatatttagcaatagaattttcatggatgaatattgccaagtagagaacatccttacactgtcctagtttactgatacgtttcataaggaaaggatgctgctattgcctcagttccttactctgttgtgatggcatcaaatgttttgcaaagttttcttaaaacaatttgattaattttaaaagtaagccaatctttcatttcaaagataaaaccagtttgattgtgatttactattcttatatatacatttcatttgctaaaaaaatttgtaataatgcctgttcttgagggattttggtacttttcttgtaatatctttccatgctcttgatattggggcaatattggctttatacattgaattgaattgagagtttccctgtttcttgattagtctatccagagtaggtgtggtcaatcaaaaccctcagactccatttctaccagccatatctttttgataagccacaaactaggaacaattttatattttatattttattgtttaaatgttagatatgtacctgtatatagccttgtcttcatgtgtagccttggaaaattgaaagtatttacactggggcccttttgagaaaaaattatccatatattgatttttctgatgaaccatttctctcttagagtcatggattttttcactattgatttttttttacaatttttattttattgatttcttctctgatttttgttaattctctatttctaattaggatttcatttgccctagtttttgttccttaagttataaggaacagataatcttcaataaattctagtcattgtttttctctttgactgttctcatccctgtaaattcaactatggtctttgttgtatttttaaatatgtttttaatactgtctctttagtgagtattttgtttgtatgtatgtctgtgtatcatatatgtgcctggtggctttggagattagaagagggtgttagatcctctggacttggaagtgtgtactgttgtgaactgccacatgagtgctgggaaccaaacctatgtcctctgcaagagctgtaatgctcttaaccactgagccattgctctggtccctatattgttcctttaaagttttcttttatatgtttgatgtgtgtgtgtgtgtgtgtgtgtgtgtgtgtgtgtgtgtgtgtgtgtgtgtttcagttatgggactcaaacttgagcctgaaaaatgctactcacataggcttccagcctcaagtgactgctatttatatgctaagtatgttttaattcactggtttttctcattttttctttatgggttgtcttacaagaattttttttttccagttttctctcctcctttttatggtactggggactgaactgaggatcttatatgtgctgtcagtgttttaccacttaagtagactcaaccctctactcattcatttattcattcattcatttgtctgttcatttattcattcattcatttttgaggtgaagggttactctgaatagacctggctgccctttaatttgaagttctcttgtctcaacctcccttgtagtgggattacagacttcaggctgccaggatcagttcaaatattcttaagctttctcctgggatttagttacttgaaaatagttggatattttgatattgcctataaaaataacttagtctcaagctactttccccactctgtatcccaaatccttctgagctttatctttcatggcccatataactgggaatgtcaggcacttccattgatctttctgaggaatttccttcctagtctcaagtaatttccctattcagcactttcttccatgtgttattggtactacgttgattctcaagtattgcttctgcaggtctctgggtgtctttgtgttcagctctctatgaattctatctgccatttgaactctgtgtgtcttagttttatactctagttccatttcttcatcttagggaacacaccagggtccaccagcctgtccccttctctgcattctggtgtggaaattctttttcgatgtaagttggggcagttgcagggctctcctcatatttttcatctctggaaactagtgccttttattgtttgttatagtgtatgagctcatgtgtgtgtgtgtgtgcatgcacgtatgcaatatgtgtgtatgtgtgtgtgtgtgtgtaatataccatatattataagacatatatcatgatacattttttgtatatgtgtgtacacatacagttttggttttgtttaatttcatacaggatagtaaatttggtttcttgtaatgttttcatggtaggaagtagaagtcctatgtatcttttgtatagtgaatgtgataggagaacattccattctcaagcttaaataaaagggatttctcatacagatagacgtttctagatagtgttttggaacaatagtccttttgctttcttttttctttttctttatcgtgtattcacagttggattatataattatatgtaataatgtaatataaatcactacttccattccaatttattagaattagattggatttagtacttgatgaaaatctgctgaaaagagtgcatgttatttttttatgtctattttgtccctgatattatccagcagtataggaagaaatgagataaggagagcctggagataatctttctgttgtttgaattttttttttaatctttgttatgttttggtcgagaagtcactgtcaatggcacagtgcctccacaatagatcccaagatgtaaaaggattttgttcttttcattttacatgatttccaagaaacgatccatctaattttgaaagaagagtgtcagctattaaaaattacatatcagtaatgccttgtttatgcatatgcatatttaaatactcatatattagtcaagatacatgtatggaagatgatcattttaatgcttctatttgatgttaatacatacagtttcatgtttttagtactaaatataattatactatatgtaaaacaataattacaacactaaacacattctgaagtgcagtagaggtaattaatagttaatttggcttcatcagttctgtaatatgtttaaaaagctgcttcttattaaaaagcaaaatatctatctaaccacattagtaccaaaggattgtattattgtcttggtttaggttccaccacatataacttagaaaccaagttcctgcaacagtcagtggtgttaagaatagagaaaattttttttaataattaaacttttgaagaagaatcaacccattatttaatatttacaattttgcataagaatatgtttctctctgtgtgtatttcctctgggagcacgttgctatctttaaacaacaggcttttttttttcttacctgtgattgttttggaagctagaagtcagaaatgattttctctgagctagatccaaggtgtctagaggcagtatttaatagggaagctccaggagtcaaagctctgtttccttttgcagtttccaaaaaagatgcatttctcacttgtaggtctttcctgcatcttaaaagtgagcacccatgtacccttctctattctgtaacaaagtctccccatttctctctttcctgtggattctcatgatcacatttaccacccacctacatcacactaggcagcctcccaggctcaggatccttaatcacatattccaagttgccccccccccaatataaagtaatacttataaatcccagaaattaagatgcaaatatttttggaacatctctgtctagcctacccgaagcattatttatatatttataacaaaatggagtataaagtactgatgaaagtcatctaaaagcaaggatgctagaagtgagccaggtctggaaagaagtagcacagataggttgatgatagaagcaaaggctcctagagttcctatattttttccaacaatttgtattactgaatgatttgtttgtttcagacaaatagaaaaagacaatatcaatttttaaaaatgtatttttcttcccctcttatcttcccctcccctataaaaccattgctagctatggattcaccaattgaaacagtcatataaccttattctgagattaatatagaattgctttgtctttgctatttgacgactctgcagagaccctttcagttacatgcttactccctttaagtcacttcaccttcttctacatttttgatatttttagcaccactatgaaattgaccattttaccaccaaaggtgacaccccaaataaggagaaagtttttagaatatggctctaaagatttcttaactcccaggagaacttaaatatcaattagacaattcatttctggtcttgttctttctcatgccagtccttatgatgaatcctctacagttggaaagtcagtttgtaactcttttggggtatgcttaataacctttagagacactaataaatatggtttagcaaagtatacatatgttttgttgtacagtataaatattcatatcttcctctctgaatacagaataccagaaggccccattgaccaggggacagctacaggaagagtccgtgttttagaagaacagcttgttaaggccaaagaacagattgaaaattacaagaaacaagctagaaatggtatgtgattatacacattcttttccatcttaatatgttgactttagaacagataattgaaaactcttcttaccaaaatgttagaaacacttatgctttctattctttgcaggtctggggaaggatcatgaaatcttaagaaggaggattgaaaatggagctaaagagctctggttttttctacaaagcgaactgaagaaattaaagcatttagaaggaaatgaactccaaagacatgcagatgaaattcttttggatttaggacaccatgaaaggtagtatgcccctacatgcttcatctgggcttccatgaagatataatttataaatgagacattgagacttttttctaatttcagtgcagattggcaagtggtactatttaagagtggtagattatctgatatctcaaaagataattaattgccaattgcagttgaccagccaatctatacgacagtaagatattattcaaagagtattgctaagaatcatagcatataaattgtggtagttaatatatgaaagtgttttactgtcagagtttttggaacaactgatatttgaagcagagcatgtgagttcacattaaagtgcattggaattcaaaccaaggctgcagttaatgtttctaatttccagacgttacagacttaaaaatagcacctttaaagggtttctaatgaaaggttaacaggttttggataaagggtagtattctgttaatttttctgtttatttctagagaggtgcacctaatatctgcctgcctaaatttgtttctcctatttacacatttctagcaatttaatacccatagaaaagaaaacattttggtgttagtggtcatgtagataaaacatacatgagaattattctaaataaagtgaaacatcctttgacttattatatttaaagcctatgttctcagtaagattctcatgggaattactgtacttattagtgaacaatgaaagaaaaatgattgtgttagtactannnnnnnnnnnnnnnnnnnnnnnnnnnnnnnnnnnnnnnnnnnnnnnnnnnnnnnnnnnnnnnnnnnnnnnnnnnnnnnnnnnnncccgttttaagcaaattacatataaagtctctgtgtattagaacgattttagcagtactggtttatagaaatataatggtatagatttaaatagttgtagaattattatgctccaaactaggcagtcctagtgcttaccctagctggtggtaagcacatagttagacaattaggccaaatctttagtaggcctctaccttaaagctgattctctgctcaaagcttctattaaacaggcctttgtgtttgtgtggtttacttattacagttttatagaaaaatatagtcaagatttgatataagtagattatgtggtataaaaacaaaatttgaatattgacttctgatgaaatttttgctcaaatgttgtggttaaattacttgttgaagaattaaatctgagatttttctaaataaaataattttaaattattttgtaaatataatttgtgcttatgcttttctaattacatgtataaagtaaaagtgagtacaataagtaagcgcatgataaatgtctgtaaatcatcattacagtttttggtagttgaacttttgaaaaaattataataagttctaggattgccatttagtatatattaagtgatatttctctgaaaacaaaatgcaaagtataagtacacaagtccatttcttatattgtcttaaatggagagtataatgattctaggagaaaacacagggtactaatttaattcctggaagtaagattagaatgtagtaatacaaataattagaaaacacagcaacacattagagaaataaccttcaaagtagtaaatatacaaataggaaggatttgtatcctatgggaaatattctcacactggccatatttaaattcttaaatctaagaactaaaatggactttagtatataactctacttggctttttataccacaaaaatctccatttttatttttcatagacttttttaatagcattagattcacagaatattagaatattcatagaataccaccaagagtttttatatataataaatctgatttcctcttttattaatattttaatttatgctatacttattatttgttttatttttacagtagtccaaagtatgatatgtaagttgtttccaaactagtaacagacctgtcgtttctgaaaaatcagtgtttatatgtcagtttctcatttacatttctctgtgcacctctcttactcttttagtgatagtcagtgttaagagaaatgcacttaggtgctttactgaggtataattttctgataaatgatggttgtggccataactcagtggtagggtgcttccttagtgctgggccttggatcttactgccaaaacccagagtgggaatctataagtttgtacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaggcacatgcttatatgaagttgaagtttttagattctgtctcttaagtaagcacattacagtatttgtttttctcttgctggctcatttcacatagaataatacactacagatttatccatgatgccagaaatggcaagatttcttttctttgaaaaattctttgacagtttcatataaatctatataatatagtgattgtatctgtcccccatgtctcatctccatccccctaccctctctccctgattcccctaagagattctgctcccaacttcatgtctcctttaactttcctttttatggatttactgtcgtgtgtgtgtgtgtgtgtgtgtgtgtgtgtgtgtgtacacccacgtgcatgtgtgtgtgtttagtcatcggttaagggacacttagattgttgctatagattagttagtgtgatccgagatactgatttcatttcatttgaatatttactaataaatgagattggatattgtttggtagctgtatttttaaatgttttcactaatttatatcccaaaactattaccatggttcccctttctctctaatctctccagaacttattttctcctcttttctaacctttccctccctctctgtcctctcttctccttttcccctctgttcttgtttgtttgcttgtttgttctgtttacaacagggcttctctaagaacctcagattgacctctcttgcatttgtcacccaagtactaggttgggtatacaccaccattctttacactctcttaccttttttatattaactatcctaacaagtgtgagaaaacacatcataattttaattttcatttctctgatgggtagtgatttaaggaccttttcaggtatctgttagccatttattttttgtttggaaaactgtctatttaattcctttttctatttttagtcaggttgtttatttggctgtgagtattatttattggatatataattagaaaattattacaagtagaaaataattatacttacaagcaggtaccatactgttatgtttattatagatccatagtttggggtcaggaaatgtgatatctttaggtttgttcttttttcccaagataatttcatatgatagcactcttaagttcaaaaaataattttaagagtgctttatctggttctttaaacagtgacataggaatttttatagagacaaaattgaatctgtggattgctttgtgcagtatgaaccttaaagcaatattaatttttccattccatacacatagggtatcttttcatttgcatcatatatattttttaaattggtatcttatagttttatagatcagtgcacaagtttttacctctccgaagttattcccatttttgatgccattgtaaatgtggtttaatttctttaagggatcatttgctagtctgtaaaaaaatgtaatctttttatgttggctttgtgtcctgcagctttatcaaatgtttttattagtaccaccaaatttttggtgatgcctttagagtttttgtatgtatgatcatatcagatccaaacaaacagaaacactctaacttctggtttagatttgttttttctttttcttgactaatttgtctggctgtggttaccaaaatcatattcataaaagtataggaggtgagcatcttccgtcttattcctgatttacctctgtagactcacttggttcttttaaagtgaatttggtttactcatatttattgaaggctattagtgtatataaatgaagcaggggtgctgttttttaatcttttcttgtagtatccttacttggtttggtatgacagtaatactgaccttttcaaatgagtttggaaaattctcatttttttagttttgtgagagattcacattgctttttctttaagtgcatatagaatatacctgctaatatatttggttcagggctttcatatattttgtttactaatttaatctctttacttactattggtttcctgagaatttctttataatttacttttgggtttatctctggcctcagtggttacacaggctgccttgaggaagtggagagcatcagcagtcattcagtggtattgtactgcctcagctgcacacaaaacaacacagtacaggtcggctgttggcttcctttttttattgggttcttatagcaaatactcttccaaccgttattccaccccaatcccttccagccccctagcactaggtaggagagaaagaaggttagagagaaaggggacataaaactctttagattacgtccagtacctatggacaattccagtcttaattgtcaaaatatctaacaatccagcaatagcaaaccagcagtccagcaagtgtacagcaagcacagcagcaggggttagcaaggaccagcaggaaccagcagcaggggagtaacggctgccacaagcccccttggacctctccagagtcccaaaattaaactatctgcagctggcaaaaatcatgtccctaatagtgcacaaggcaaatcataatcacctgtggtgaggcagcctcttcttccacacctgggattgaaacaaaagacatattcacataactggatttttaaagaaaccaaaattctcaatacagttgtctttcttcaggttcctataggatccaactagctgtcaaaagtggataaagaattgtaagagatttagataataaatcatctgatcaatgaaataattactgacaattgtataccagatattacaaaacctctttgacctatataactgggctttgttggcagttcttcaagataatgcagtattgacagtgtttgatcttattagtcattggaataagccaagtagtagacaagaaaatttataaggatgggtaatggtgagattgcttagctagtaaaatatttgctgccaagccagacagcctgagttccatacctgagacccacctggtggaaggagataaccagttccaacaagctgtcttctgactaccacatgtatactgtgttatgctgctccaaataaataagcataataaaaagaaaatgaataaaaggattgagtgaatttgaagtcagggcattgaatcagaacacaattgatgagatttctgaacaagatcaaaatgtaaacagcagtgctcagagctgaattgcaaaagaagggcatgtccatcagggtgaagacatccagcttggaagagaaggagaacagacttaatatcttcacctgaacatttgattcttatggcaaaagatatcctatgtctggaagggcatgagcctgacaatccctgaaggtctctggtactcttgaagcactgctagggtggataaattctaagatggcctagaaaggggcctcgagaacacatttacctcattctgttccaaaacactcaaacctcctagagaattgtgagcgccccattatgaagcagtcctcagggaggcgaagctagctcttgtttttctgttatcatgagcaaggtagtggacttttagcagggaaggagcatctacaagtgcttctgaggctggccagtgcagctcatgatatgaaaaaggaatttgtgagcttcctgttttatgaggccagtgtaaacctcgggatatgaatattttgcaccatgataactgtgaggtgggaactaagtatgaagtattgttattaccaggcttaaaatatgtccagcaaatttattccctaaatgaaatttgtggcttatagattatttttacaactatattttattattattattattattattattattattaaattatttatttacatgccaaaagttgcccccttcctggtccctcctcccctagttcttcacttatacaccctgcctctgagagggtgttctcccatccatccatctatctccatgtcacccccgccagcatccttcttccctggggcataaagtttctacaggattaagtgcatcctcttacactgaagccatataaggcagtgcactcttacacctgttcctggggccgtgaaccagtccatgtatgctccttggctcttggcttagtctttgggagctctgaggggtctgagttaattgacattgtttttcttcttatggggttataatccccttcaactctttcagttcttcctctaactcttccatattggttgctgatctcaatccaatggttggctgtaagtatctgcatttgtctcagtcagttgttggtagagcctctcagaggacagccatgccgggcttctttctgcacacacagcatggcctcagcaatagtgtcaggatttggtgtgtgtgtatgagatgggtcccaagttgggctggtcactgggtgacctttctttcagtctctgctccatttttgtccctgcatttcctttagacaggaacaattctgggttaaaaattgtgaagatgggtgggtggtcccctgcctcacctgggggccatatctatctactggatttggtctcttccagttccatctccccattgttgggcattttatatttttagagaaatatccctaagctaccaatactctctgctcttcttgtaccctaagcctatggttgacaaagctggtgtctgttgttggggaggggggtatctcttactctaaaaacaattggtagagttgttcttttttacattgattgctttcagttgcttttgacaataaacttctgttcttttctagaacttctgttcttttctagaagaaaggggtaaagaactgcaggatatttgccattctcttgtttttgtttagatgatacaagcaatgacacaaatattagaataactgtattccggaaaagcattttgatactatagggccgggacgaattttgatttcatcattactactgctgttccctaaaagctgtattgactttacaaagtcctttagggaaaaatctccaggggcaaacctgttatctttttagatgggagtatgactgggttactactacatttgctctgtgaaatggtagaaaatattgaatcttatcatgagtgctgggcttgaggaagccacaaatttgaaaaacaaacttgacttttaagagaaagtatttgagagattcactggtgttcaggaagataacgtgaagtctcaacttacctctgaatgttaccataatgactaaaccctaagtgtaaatagtagaatgctattgagaaatctagaatatgtctcagaacactacctcaaagctcttacttctggtaccctcagtaatgcaaacgcttaaattcagttcatcagagatacacttgccagcatggacagaaacagtttacccagttctgttcttccacttagctgcattgtctgagagttaaacaaaacactgaagggattacataacactaccattcatcatttgtcaagccttccatctgtctgacatgaaggcttttctttgtgttgtgtatgttctgctggaggatcctgtgcaagatagagatgagaacgagtgctctgcagcattctattaagatgtttcaagctatattcagggaatatcttggcaaataagccaaggctatacttttttttttttttaagacaggatctgattatgtagtcttggctagcctggggactggctatatagaccaagcaggtttcaaactcacagagataaacctaacaaaataaattataagatgtgacttaaatataatggtagacacataataaattctgtgtgacagtgtcccaccaagaattcaagaattcctaaaatatagaaggtttttttgttgttgttgtttttttttttttttttttttaaatttcagtggacttttaaaaccaaattttctagggctggtgagatggctcagcaggtaacctgagttatcctgaattatcactggaacccatgttgtagaaagagaaaaccaactcttctaatttgtattctgtccatcacacatgaactaggggaagacacatacacaccatttggaagaaaagccaataagtataataagtcatataatcactgaatatcttccctgtattttctccctagctattggtagcctacatattttgtacttcaccttagtttgtacatcttctagttccttaagttttgagttgagatgtttgagatatttctttttaaatgtaggtatttacaactgttgatagctcttagcactcttgcatccaagcatgagcttgttgtgtttacactttgtcttgggatatcttgatttatctcttacttctacatctttgccaaaaggccaagaagcgattacctcttatttctttgactgtgtattattcaggaaaaaaatttcctttgttttttgtttgtttgtttgtttgtttttgttgttgtttacagtcagtaattgtacccaatatgaggctgggggatagatagtacattggtaaagcatttgtttaatatatgcaagaccctgggttagagccccagctcaggaaaaaaaggggataaccaaaggctgaatgatatctccttaatatggttttaatcattatatttgttaagccttatttgaagcataacatatcatgtgcattgtaaaatgtttcatgtgtgcttcagaagagcatgtctttggctattaatagaatgttctctttggcctgtgagttaaagtctactgttcctccattgatttcatgtcaggatgatctgtgcattgctagacatgaggtatcaagtttcctgctgttactagttctgttgttacaagagtttctttttagttcttttaatatttgctttgtctatatgccattgtgtttggtatgtctacacttgctacagtctcataataaagcaacccctttgttataataagtgagcttgtttgacctgtgtgagcagttttgactaagagtccattttgtctggcatggcattgccatcccttctctttgatcccaacttcacttccctctttcccatccctcacgttcagccactctatatccttaaactaaactgagcctcttgcatgcatcttcttgttggagcttactttttcttagctagtttgtgtcttttccttgaataatctcaagtaattgtagattgtaatagattcttggatgagcagagctcatcagactgcagctgacaggacttactatttattgcatcgcatagttgtaggatctgctgtaggtgtaagatctgcaggtgtgtctctgagagcacagacccagtttagacaggactgctctaaagccagatttgagaagggctggggcctacttccaagatttttttcataatagagattaaggttgatggtaagaaaggtagggaaaaagttcttttattatctacatgataactgttctgcaacatgactatcatagtttgttactctaaattccaggattatttaggaaaaaaatcctttgtttcttttataatcagtaatagtgcccaatatgagactagactatagcctagaagctaaatatcatgcttatatctaggttttagctcacctgataattttagcaaaacagtatttatttgattaatctgttatgtatgactaataactgctgaggtcctgttgtctactaccaatgtgggtaatcacttggtagcaattagtaatagtttatcgggaatgtagggggctttagaataggctctgaggttaatggcacttgttgctctcacagaggaattgagtttgattcctagcacccacatggcagctcacaaccatctataactacagtctcaagggattctatgcagttttctgacctctctggataacaggtacacattcagtacacctttatacatacaggaaaaacacccacatatcaaataataaaataaataaatcttaaatagaaatgaagaacttagaggggtatgctgcctaatcgcatattccctgctgcatagatctcaagccatagcaccgctgggtctccagtgaagttccttcattgcttgctaatgtgtttcacagtaatgcagccaagtagtttctcttgttttgtttttattttgctgtttttaatcattaatcatgactggactcagcccctttctttgaagtggtgagatggaagtaaatattttgggatgattgtttttgccattgtggtcttattatctgtatggtactatggttttagtgcttaaatttgtcccttgacctctgagtttactgtgggtttttgtattatcaccctttagattgctgcagagctgtattccacttaattactactactttgattcttttttgccttcttcatcctgccagataccagtttatgaaataattgctagagcttcttctttctgcttttaaatgataacagttattgaacttcaaattgaaggacaggaaggctcacagaaccaaatagccagtaatctatttctcaattatgttgactaaagctcttgaaaaagctatctgggaagcagcactctcgtcttccttgctgaggctgtatatctcattatcagtaatatgtaatggcagcattattaatagcaaataataaatgatacttatggttgagtgtcctgattagagattggctgatatacaaaaggccattatggaagctggaaaaggactttagagatacgggatatagttatctgtctaatgatagggaaagattgataggctaaggcttgtacattgtaagattttttttttttttgatcatagctgttgtggcctagtaactttgttttgtttccactcactttgaaaggtttaagaattggtgtttccactcttaaaatgttgagttttaagagttcttcagatcatatttttgtgtttttttctctctctctttctccctcttctctctctctctctctctctctctctctctctctcacatacacacacacacatattacatggagagaggagaaacaatcttaatttctttgagattcttcttcttattcttaatgtttataacttttctcgacttttggaattctttgactaaaatattttctgtagacatccaggtatattttcaaatgataataaacatatttcctagtgcttatgagtacaggcaggtatttgtgtggaaagttgttctcattctctttactacttagtctatctaccagatactaattcttcattttcttcagggaatgtcccccttgcccttaaattgtagttttaaggatctaggtgaaaaagcatactgcacctggtacccattgttctgttttgtctgcctccattattatttggggggaggtgtccaaactgaagaaagatatacatattgaaactaatgatttactaaagattgtgtatatgctaatcgtactaatgataaagtgtcttcattattgtcttagttagggtcttactgctgtgaacagacaccatgatcaaggcaagtcttataaaaaacaacatttaattggggctggcttacaggttcagaggttcagtccattatcatcaaggtgggagcatggcagtatccaggcaggcctggtgcaggaggagctgagagttctatgtcttcatccaaaggctgctagtggaagactgacttccaggcaactagggtgaggatcttatacccacacccacagtgacacacccattccaacaaggccacaccttcagatggtgccactccctggtccaaggatatacaaaccatcacaattatcaatataaccaccttactagttcaataaccctctgaagtaagcagaattacagtagtaccctcttatctattgtttgctttcctagtctgttagccattgtcaaccacagtccaaaaatactaaatggaaaattccagaaataaacagttcacaagttttaaattgcatatcattctaaatgacatagttgagatctcataccatcttgccaggatgtgaataatctctttgcatattcaatccatactgcacatgctaaccaacactcacttagtagctatctttgttaccagatggactatggcagtgctgtagtgcttgctttcatgaagcccttgttttgtttcttaataccacaaagtacagaggtagacatattgatttcttgctacatataatctataaagtaaacattactatgggtttgtatgtattgggaaaattggtactgcaaatttcaagcatctactggatgggggtttccaaatgcatctctgatggataaggaggaattactctcaacctatttttagctaatgtttcagttactttccttgctactgtgatcaactacctgacaagaaacaacttaaagcccaaaagttattttgatgctcagtttgagagtacagtctactattgcaggaaactcaagttggcaggggtgttaggctgcaggtcacttgtttgcagtcaggagacagaggaatgcaggtgctccacttgcttattccttttattcagtctgggaccccaacacagagagagataggcgatgggtgcctactgttgtttgagtctgcagtcaagcctttttgaaaataccctcattcacttgatgcttctaactccagtgtaactggcaatgaaaatgaccaaccagcacagcaagtttagacaaatttcaagtaatttttcttgactgtgaaccagatttacccagggtctagactttgctgcaatctcttattccagtttatcttggatgttgaaacttcaccttcagaatattcttgtatgaattataactgtactggcccttgagggaagtttttatgttttagcattttgaatcagaaataaataaaaaccttctgtgttatagtttccctgatggcaaatttaagacagactagacatcctctttttacacataaaagttttatgattatgaaaatagaagaatcactctgggaagtgcaatagcacaaacatagacatcatttgctcatagctggctgactctaaagtctgttctaatgtacccattgtcatcaggcatctgtacccttattttgctgctatctaatcttgcctagccttatatatgctaggccttgatgtggccttatataaagccaccatctcactactcaactatgaaatttcttgatacttccatgataaaagcaaaagacagaaaaatttccagctttggacgctctaattgggaacatggcttaggtgtagaatccctgaaaaaccaaaggtttctgcagaatgcttttttaatgactataattctcagtaataggctacaactttctgatttgattttaacacagaaaactacattttgtaccaatgcaacttctagacatcattgagttcatgaagaaataataaaaatttaacttttttcctgtcataacttacttatgtggtgtctaattgtgaggggggtttgtgttttaaaaattaaacagtagtgtgatgaattggtattctgactgattgctgtgccttatttacttttatgctaacatgttggttttgggtattaatgcaatccatgtgttgcttcaatatgtgtacattgtgtagtggttgaatctagcccactttatataccctacccccattttctcaacatctagctagcactattttatattaaagttgacttttaaaaaacttttgtatatggaagaggaatgtgctacttacttttctgtttctgtcatatttcactcaacacagtgtacccatgaatcttggtgagaatgacaggatttcactgttctttgcagatgaaaatactcagttgaaacttcatcttaaaatttggctacatttgtgatctttgtattttctcttgttatttttctatttctttttctttctgttatttatttacatttcaaaagttgctccccttctcagtaccccttacttagtttttcacgacccccacctctgagaggctgctcccctacctgctaacccacccctacttcacctccaacagcattcctcttcactggggcatgaagtttccataggattaagtgcatcctcttacactgaggccatattaggcagtgcagtgctacacctgttcctggggccatgaatcagcccatgtatgctccttgactcttggcttagtctttgggggaactctgaggtctcttgagttaattgacattgttgttcttcttatggggttataatccccttcaactctttcagttcttcctctaactcttccatattggttgctgatctcaatccaatggttggctgtaagtatctgcatttgtctcagtcagttgttggtagagcctctcagaggacagccatgccaggcttctttctgcacacacagcatggcctcagcaatagtgtcaggatttggtgtgtgtgtatgagatgggtcccaagttgggctggtcactgggtgacctttctttcagtctctgctccatttttgtccctgcatttcctttagacaggaacaattctgggttaaaaattgtgaagatgggtgagtagtcccctgcctcacctgggaaccatatctatttactgatctatttactggaggttgtctcttctagttccatctccccactgttggacattttggctaatatcattcccattgagtcctggtagcctctcacatcccaggtctatgttcccctgccccctagcccccactgtacattttgattcattcttctggctctcttgtgagaccccgacttagagtgtttctccctagaaggtaaagccccaagcttgttttccctgatctctaaaaatacagccagaaagaagctctctgttctctatagccagcaaaaagcctttttgtttttgtgccttacagccagagatgtgataattgtaggaagacctataaggacatagagatagacaccggaaaagaggctggagctcactccccccctccccgcccctaccagaaaggagctgtagccaactctcctcccaactcctcccaactctcctcccaactcctcccaatccctcagctagctgttaaaagccccctactgttattgctcgggggggggggggtcgaactcccctgccctgcaaggcaaaaggagtttgtcctcagctagctgataataaaacctcttgcagtttgcatcaggtgtggttttctcttgagtcattggggtgctagccagctcatcccgggacttgagcagagactaagcttcggggatcttacatgtgggggctcgtccgggatttatggcctaccccaattctcagagaccccacttagaggtaggatcctatctttgtctatatctttgtctatgtctttttctacaggctgtatttgaacggtattctcggtttgcagtcgtccgtgctcgggagaacaatgaactccctgtccaggataggggagagggttactgacagatgtgtcaggagtaaccgactgctcctatctctcccctcctaaaacaattttgtgtgtgcgaatttggtagtgggggaaggggttgtctagtctgtttcttttccttttttaaattttattttattgttaacttaatttttacactccattttccattccctgctgcccccatccaccctcagtctgcttcatattccatacctcctccccaccccaccccatctccatttcaattatgtcttcaatgaaaaaataaggaagggtttttatttggttctgattcacaatattttattgtgctggctagttttatgtcaccttcacacaagctagagtcatctgacagaagggaatcttaactaagataatgactccataagatagggctgtagtttttaatcacaattgctctgtagtacagcttgaggtcaggcgtggacagacaagtagaccagtggaatagaattgaagacccagaaatgaacccacacacctatggtcacttgatctttgacaggggagctaaaaccatccagtagaaaaaagatagcattttcaacaaatggtgctgtcacaactggcaattatcatgtagaagagtacaaattgatacattcttatcttcttgtactaaggtcaagtctaagtggatcaagaaactccacataaaacctgagacactgaaacttatagaggagaaagtggggaaaaacctcgaagatatgggcacaggggaaagattcctgaacaaaatagcaatggcttgtgttgtaagatcgagaatttacaaataggacctcataaaatctcaaagcttctgtaaggcaaaagacattgtcaataagacaaaaaggccaccaacagattgggaaaggatctttaccaatcctaagtcagataggggactaatatccaacatatgtaaagaactcaagaagatggactccagaaaatcaaataatcctattaaaaaatgtggtacagagctaaacaaagaattctcaactgaggaataccaaatggctgagaagcacctgaaaaaaatgttcaacatccttaatcatcagggaaatacaaatcaaaacaaccctgagattccatctcacaccagtcagaatggctaacatcaaaaattcaggtgacagcagatgctggcgaggatgtggagaaaaaggacactcatccattgttggtgagatttcaagctcatacaaccactctggaaatcagtctggtggttcctcagaaaattggaccggaagattcagcaatacctctcctgggcatatacccagaaggtgttccaaccggtaataaggacacatgctccactatgttcgtagcagccttatttataatagccagaagctggaaagaacccagatgtccctcaacagaggaatggatacagaaaatgtggtacatttacacaatggagtactactcagcaattaaaaacaatgacttcatgaaattcttaggcaaatggatggatctggaggatatcatcctgagtgaggtaacccaaccacaaaagaactcacatgatatgcactcactgataagtggatattaacccagaaacttagacacccaagatacaatttgcaaaacacatgaaactcaagaagaaggaagatcaaagagtggatattttgttccttcttagaattgggaacaaaatacccatggaaggagttacagagacaaagttaggagctgagacggaaggaaggaacatctagagactgccccacctggggatctatcccatataccaccaccaaacccagacactatttcgtataccagaaagattttgctgacaggaccctgacatagctctctcttgtgagactatgccagtgcctggcaaatagagtgagataactggatcatatgattgaactaatctatattcctaccaagtgtctgagagttcctttctttctttatctctttctctctccctctccccctccctccctccctccccccccctttctctctctctctgtgtgcgcgtgagcatcatattaattggacttgaaatgactgctacattgtagttttatttgcattttactatgtcataccgtattgagcacttttcttttttttttgagatttattttatttttttatttttttttcattaaattattttttttattaggtatttagctcatttacatttccaatgctataccaaaagtcccccatacccacccaccccctctcccctacccacccactccccctttttggccctggcgttcccctgttctggggnnnnnnnnnnnnnnnnnnnnttttgatacatatgcagctagagtcaagagctccggggtactggttagttcataatgttgatccatctatagggttgcagatccctttagctccttgggtactttctctagctcctccattgggagccctgtgatccatccattagctgactgtgagcatccacttctgtgtttgctaggccccggcatagtctcgcaagagacagctacatctgggtcctttggataaaatcttgctagtgtatgcaatggtgtcagcgtttggatgctgattatggggtggatccctggatatggcagtttctacatggtccatcctttcatctcagctccaaactttgtctctgtaactccttccaagggtgttttgttcccccttctaaggaggggcatagtgtccacacttcattcttaatttttcttgagtttcatgtgtttaggaaattgtatcttatatcttgggtatcctaggttttgggctaatatccacttatcagtgagtacatatcgtgtgagttcctttgtgaatgtgtaacctcactcaggatgatgccctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcatcttctggatatatgcccaggagaggtattgctggatcctccggtagtactatgtccaattttctgaggaaccgccagacggatttccagagtggttgtacaagcctgcaatcccaccaacaatggaggagtgttcctctttctctacatcctcgccagcatctgctgtcacctgaatttatgatcttagccattctgactggtgtgaggtggaatctcagggttgttttgatttgcatttccctgatgattaaggatgttgaacattttttcaggtgcttctctgccattcggtattcctcaggtgagaattctttgttcagttctgagccccattttttaatggggttatttgcttttctgaagtccaccttcttgagttctttatatatgttggatattagtcccctatctgatttaggataggtaaagatcctttcccaatctgttggtggtctttttgtcttactgacggtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttctttgatccatttagatttgaccttagtacaaggagataagtatggatcgattcgcattcttctacatgataacaaccagttgtgccagcaccaattgttgaaaatgctgtccttcttccactggatggttttacctcccttgtcgaagatcaagtgaccataggtgtgtgggttcatttctgggttttcaattctattccattggtctacttgtctgtctctataccagtaccatgcagtttttaccacaattgctctgtagtaaagctttaggtcaggcatggtgattccaccagaggttcttttatccttgagaagagtttttgctatcctaggttttttgttattccagatgaatttgcaaattgctccttctatttcgttgaagaattgagttggaattttgattgggattgcattgaatctgtagattgcttttggcaagatagccatttttacaatgttgatcctgccaatccatgagcatgggagatctttcccatcttctgagatcttctttaatttctttcttcagagacttgaagtttttatcatacagatctttcacttccttagttagagtcatgccaagatattttatattatttgtgactattgagaagggtgttgtttccctaatttctttctcagcctgtttattctttgtgtagagaaaggccattgacttgtttgagtttattttatatccagctacttcaccgaagctgtttatcaggtttaggagttctctggtggaatttttagggtcacttatatatactatcatatcatctgcaaaaagtgatattttgacttcctcctttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaatcatccctgcatccctggaataaaacctacttggtcaggatggatgattactttaatgtgttcttggattcggttagcgagaattttattgaggatttttgcatcaatattcataagagaaattggtctgaagttctctatctttgttggatctttctgtggtttaggtatcagagtaatagtggcttcataaaatgagttgggtagagtaccttctacttctatcttgtgaaaaagtttgtgcagaactggaattagatcttctttgaaggtctgatagaactctgcactaaacccgtctggtcctgggctttttttggctgggagactatttataactgcttctatttctttaggggatatgggactgtttagaaggtcaacttgatcctgattcaactttggtacctgatatctttccagaaatttgtccatttcgtccaggttttccagttttgttgagtatagctttttgtagaaggatctgatggtgttttggatttcttcaggatctgttgttatgtctcccttttcagttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgtttcttcttggaggcactcagagctatgagtttccctcttagaaatgctttcattgtgtcccaaaggtttgggtacgttgtggcttcattttcattaaactctaaaaaagtctttaatttctttctttattccttctttgaccaaggtatcattgagaagagtgttgttcagtttccacgttagtgttggctttctgttattttttttgttattgaagatcagccttattgcatggtgatctgataggatacatgggacaatttcaatatttttgaatctgttgaggcctgttttgtgacctattatgtggtcaattttggagaaggtaccatgaggtgctgagaagaaggtatatccttttgttttaggataaaatgttctgtagatatctgtcagatccatttgtttcatcacttccgttagtttcagtgtgtccctgtttagtttctgtttccatgatctgtccattggtgaaagtggtgtgttgaagtctcccactattattgtgtgaggtacaatgtgtgctttgagctttactaaagtttctttaatgaatgtggctgcccttgtatttggggcatagatattcagaattgagagttcctcttggaggattttacctttgatgagaacgaagtgcccctccttgtcttttttgatgactttgggttggaagtcaatcttatcagatattaggatggctactccagcttgtttcttcataccatttgcttggaaaattgttttccagccttttattctgaggtagtgtctatctttttctctgagatgtgtctcctgtaaacagcaaaatgttgggtcttgtctgtgtagccagtttgttagtctatgtctttttattggggagttgagaccattgatgttaagagatattaaggaaaagtaattgttgcttcctgttatttttgttgttaaagttggcattctgttcttgtggctgtcttcttttaggtttgttgagagattaccttcttgttttttctagggcattgtttcccgttacttgtattggtttttttctgttattattctttgaagggctggattcgtggagagataatgtgtgaatttggttttgtcgtggaatactttggtttctccatcctatggtaattgagagtttggctgggtatagtagcctgggctggaatttgtgttctcttagtgtctgtataacatctgtccaggctcttctggctttcatagtctctggtgaaaaatcttgtgtaattctgattggcttgcctttgtatgttacttgacctttttcccttactgcttttagtattctatctttatttagtgcatttgttgttctgattattatgtgtcgggaggagtttcttttctggtccagtctatttggagttctgtaggcttcttgtatgttcataggtatctctttctttatatttgggaagttttcttcaataattttgttgaagatgtttgctggtcctttgagttgaaaatcttcattctcatccactcctattatccgtaggtttggtcttctcattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctccagtgttgcctcactttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttttcgagtgtgttggggtgccctggactggacgaagtgggagtgctgggttctgatgatggtgagtggtcttggttcctgttagtaggattcctacgtttacctttcgccatctggtaatctctggagttagtagttatagttgactctgtttagagattgttcttctggtgattctgttaccgtctctcagcagacctgggagacagattctctcctctgagtttcagtgctcagagcactctctgctggcaagctctcttacagggaaggtgcgcagatatcttgtttttggacctcctcctggtcgaagaaaaaggcccaaaacagggcctttctcagaagctgtgttgttttggcagttcccagaatctgtcagcttctgtggtgcagactctcacctgtgcaggctaaattcctaagctccagggagtcctggaaccaagatggcgaccgctgctgctgaggctgaggccgcctcccaagccaggcggacacctgtcctctggtccggacagtggccggctgtctgcggcccgccaagggtgctgcctcagcggctctgtgcttccgcctttcccagaagctgtccggttctctggcgcaccctctaacctgttcagactaatttcctaagttctgctgagtcccggaaccaagatggcgaccgctgctgctgaggccgcctcccaagccaggcggacacctgtcctctcttgagcacttttcttatgtttagtcatctagttgtttgatcattctgaattccacagaggttgggataaaatgaatttgcgagacttagtatgtatttaagttcagaactctgctttaattttggtgatacagaactgctgatttctaagaccagaaaccatagctaggtgtagatcctaatactctagagagtgatgcaaagaagtcacaagtttgaagccagactggactacattgccagagcctgtgttaaggaaaaaatacattaaaaaaaaggagagagcctaaaccacaacagcttttatacactttcttccaaattaggcttagtgtggtttttttccccagtaggaactaaatatcaataaaacttaccactttttccctgtgcacgtgcatatgcgtacatgttcattttaattttaaagctaatcgtagcatattgggtttccttctttcctcctacaagtatttgcttatagagtgggtttttattctactgtgctttatcttcagcagtaacactgttatttaacactgagtttgcaataggattcataaccattactccttgatgagtagtaggaggaaatgagttgatgttgtaaaacctatggtatatatagcactatgagtgtgttgtgactgaggtttataaaactgagaaaagattgtaaatttctaactgagctttaaagtataatactagttaaagacttctcagttcaaatcataattctgtgaggtcagtatgttaagcagatttgcattaccatagtgaaatgtctggaaacagccaattttataaagataagagacttgtttttaggtttttaggcttggtactgtctggctcagttccagcagaagtcctcacagcagtatggtagtatgtgtggaagagcttacatggccaaggaggtagtcagagagagagagagagaaagagagagagagagagagagagagagagagagagagagagagagagagagagggcagagagagggcagagagagggcagagagagggcagagagagggcagagagagggagggaggacgacagagacaaactatgaatataaatgttgtcacataacttcttttgagggtgcttctcacccaggaaccttaggacctcctttaagataacctgttcccattctgtcacctcccagtgtgccctactctgaagatttaagactttaatcacaatgggcccttggggacattcagaacatacttaagccatggaaagtagtaactttcagaaacaacaaaaacaacaacagaaaaagagtattgtgggctatataatatttcagaagaagctcagtttaacaatatgaaaaaattatatttgaaactgttctcagtgtgtaacctagcagatttgttaaagaagcagttaaaagtttcttctatataaaaattatttttaatcttaagtaagaatgacaaatataaaaattcataaaacactacattttagacacgatgttcaaaagggtgaaaatggtaatggctaagcttcagagtgtcctgtagtaagtaatattgataccaataaatatctaaaatgctttgaaaatgaccctttgtttcaaagcatgtttaaagtgttcttctactaacctaggctgaatagtctaaattgtatttaagattttacttgtcattttcaagtcaataatttcttttttcaaatgtgttatcacatatttgctgtatgatcattcatagtccagttttctgtgagttaaatgaaggagggaatggagagggagcaaagtaagttaatctaggaaagccttatggagaaagtgacatttgaaaaaatatttgaaggatatttggttggtactgtgactgaaatataaaataaacagtgaagccatttggaagggatcagatgaaatgatagactatggtgggggtgtcatataagtcaaaatagtaactttggccttgactcttgagtgacttgaagggtcaacttagtgttaagtgcaaagcagaagtgttatttgattattaatctggccactatgaataaagtacaataggcaaggctagaagctgggagaattgttagaaagctattataataattctggtgtgagaagatggtagcttagtcaatagcattaatgatagagattcatagtaagtaactggttatatatttatttgttgatgattattggggcttgttagagagagatggatgctttatttactttctttactactaagtgaaagtcattgcttttatttaatgcaatatagataaagccatgtctaccagttcttttttttttttccattttttattaggtatttaactcatttacatttccaatgctataccaaaagtcccccatatccacccacccccactcccctgcccacccactccccctttttggccctggtgttcccctgtactggggcatataaagtttgcaagtccaatgggcctctctttccagtgatggccgactaggccatcttttgatatatatgcagctagagtcaagagctccggggtactggttagttcataatgttgttccacctatagggttgcagatccctttagctccttggctactttctctagctcctccattgggagccctatgatccatcccattagctgactgtgaggatccacttctgtgtttgctaggccccggcatagtctcacaagagacagctaacatctgggtcctttcaataaaatcttgctagtgtatgcaatggtgtcagcgtttggatgctgattatggggtggatccctggatatggcagtctctacatggtccatcctttcatctcagctccaaactttgtctctgtaactccttccatgggtattttgttcccaaatctaaggaggggcatagtgtccacacttcagtcttcattcttcttgagtttcatgtgtttagcaaattatatcttatatcttgggtatcctaggtttggggctaatatccacttatcagtgaatacatattgtgtgagtttctttgtgaatgtgttacctcaggatgatgccctccaggtccatccatttggctaggaatttcataaattcattctttttaatagctgagtagtctaccagttctaaagtatctctttatagtttacaaagtattttaatttattgcaaggaaatctaacatgttatgattgaaattattaaaacaattactgatggctctagagtgagaaagaatcttaatcattacattagttttgatgaaagaacagcaaattatagcccgggggcaaaatgtggctattttcctactttagttaataaagttttattgtaagagagccacgcctattcagttacttattgcttcaggcagctttactgctacacagataacaaaggatgttccctgtggcagtgggtatactaaaactggaatgatacagaaattagcatggcctctgcacaagggtgatgtgaaatttatgaaacattacatactttcaaaaacaaaagcaacagaggttcacacaacctaaaatcttagttacctgctcctttaaagaaagaactcattaatgctttattctttaggacactgtatgagatttatgccatgtttttcctctaatcttttcccagttacccagagtagagtgttagaggggttgtgaagtgatgagcgaggatacagtggtgttactcaaataccagtgccatgtctgctgaattgcattttttatactttggtttgtttgtttctttttattgctgtagctgattggcttgtgggagaaagttgtttgtcctttttggtcaaaaaaaaaagaaagatttgctatagggatgaattgtatggtagagacttaaattttaagtttcacagtcttgatggaaaataaagaccagataccttcatctacttgagcatgagtctttctgaacagttgggctcttttatggttttgtgtaatgcagtgaaacagtacaaataagtggacctcaattgttgcttactttcacaggtctatcatgacagatctatactacctcagtcaaacagatggagcaggggattggcgtgaaaaagaggccaaagatctgacagagctggtccagcggagaataacatatctccaggtaaggttaggttaagaaataaatcttgagtggaaacaaaatcatcataaaataaaaaatgaaaataacttttgctttttaaaagcttttcctgtgcatttttgaaaaatgactcacttacatatttattcaaagaaacagtgttttataacttacaaataaagcagcagttcaaagtgtctaaaactgccccaaaaggagctacttctttgcatatacacaaactacacagttgtgagcatgctgtattttgtaggaaatgcttattggcattttgacaaaggagctatcaagggaagtttatggaggctgcagcatctgaccctaactgtgaaggtggtcaagtctgatttcacaacaagaagtgaaggcagaggatatagtagatgaagtgtgtattgagaacagtggcccatagcaggaaaaagtaagacaggatcccagatgtgagctgaactctctagtttgtctggagttttaggtatgaaaaaggtatggaaatctgcaaagaggttcggaagcttgagtattgagggtaaactatatggcatatgaacattaaatgattcttgaaagataattgttttatggatgtcattttgacaagaaataaagactgatcaagctgttaagggccttttatgtcttttgtgtgtattcttttaaagttcttattgatatgcatatatagtcttagatatttctaaggaaaaccttggaattttattttattgttagtactctatagacaatttctgattttggtttcataacatcctggtattctttgttcttcccccccagtggtagggtttaaacccagggccctgagccacagtaagctagtgacaacctagttttaaaacagtttttgtacacagaaggtacaacaaatgactgaacctaaaagtagtattttggttgaactatattagtatttgaagagactagaagcagagaaagcatgtaggacaaggagtttgtattacaggcaggatgaattgagaggtgataagagtttgcaagtggaaacaaacttagagagactagagaaatataatcagtagacctttctaagtagttgaaggagctgaaatactgggaatggaagcatcttcaactgtcaataagttgagagaaaattgttttgaggaaaaaacagtgaattaatggacatttaaaactgagtgagagatgctttaagttgaagtaaacatctccactcaatccttttgtaattctatgatagcatagtttccatgtacaagaactctttaagattagaaggtgggcctggtgagatggcttagctgttcttccaaaggtcatgggttcaattcccagcaaccacgtggcagctcacaactgtctgcaactctaattttatggaatctgataccctcaaaaaccaatgctcataaaataaaaataattagattatttttttaaaaagattagaagcaaaggggggatagtccttgacatgcacctgtatattttagcatctgttttcatacaggtgaatgggagaggtaatcagggttagggggtcactaaaaacacacttgatgttggcatgttctcttagtctcatcctcccaatgccgttcattagaggaggctgcagaatgagaagccgttcacctccgcaggggagaggtaattatttcctatcaactagatcttcattcagtgaactttggacagatggtggcacagagccatcctctcctttattttgtaaaatagaaataacaatggtttgtgagctgccacatattcattaaactttcagccactgtgttaaactatggtcaggttgtcatcagctcagcacagtataataagtacctgccacttgctttatttttttctctctcttttgaaaaatatactctttgggttacattgtatatatcaatcttttattacttttaactatgagtcatactacatttgtggatgcaccactatttatttattttgccttttttcttttaagatttgcttatttattttatgtataggaaaacactgtcactttcttcatatgtaccagaagagggcatcagatcccattatagatggttgtgagccaccatgtagttgctgggaattaaactcaggacatctgcaagaacagtcagtgctcttaaacactaagccatctctccaaccccttattttgccttttgtaagacatttagttatctccagtttggggctattatgaataaactcttttgaacatccatccacaaatgtttacatgggcttatgctttcactcttttttttttaagtacctacgagtagaattatgtttattttctttttaaattgaagaaagtttatgagatttttcactcattcttccttttgccttgcatcccaaactgacaattacagaagtgggcacattcacaatacgtttactttccataaaagttgctttctgtaataattcagatgctcagaaatttaatattttcaacaatttatagattaaaaaatcagatagtcatagttttagtttcattgaaaatgtaatttgttatatctcctttgattcttgatgggaatgatgtgatacaggacatacttaggtacctcgtcagcacaattctcagaattctaactattctagaacaattataccagtacttaaaatattgtatgtaatatgggtttcttctttttaaattgaaaatagattgtttttcatataatgtatcctgattatggtttcccctccctctggtcctcccagtacctccccacctcccctcccatctatatctaccctctttctatctcattagataacaagcatctgaggggtcataataaaaacaaaacaaaacaaaaacaaacagaaggaaatgagccccctaaaggtgtaaggaacagatatagatacagagacccactcatcggcacacttaaggaatcccataaaaacacaaacctgaagccatagtatatgtgtaaaagaaagaataaaaaatgaataaaatgaaacataaagaaaagggaagagtcctgacatgacactgtgaagcaaggaacctccaaagatgcctttgagttggtttttgtcagctatctattagtagacatgaatgtgaggtcagaggaccccttgctagaactggttctctcctaccacgcacaagcacctttacccctgatctaccttggtgtccccgcttatactcttaaaccagttctcccacatcctctctaacagttggtataatcagtcttattttagcattttgtatgtttttaataataatccatcagtttaatttgtattttcttttgactgtagttggatatctctttatttggttattaaccatctttgtgtcctatcctgtgtgcatatttgtgtgggtgcatgtgtatagcagtgcacatatacttgggataggcaggggacatcagatgtcactcctcaggtgcttatcactgttttgtttcattttccttgagacacatggttgtgtctggctttccttcacatcagttctggggatcaaactcaagtctgcattgtatcgagacaagccagctacgctatcttcctaatccccttatactttctttagtgaagtacctgttcaagtcttttggtgaacgttttattaggacgtttgttttcttatgaatgagttattaaggctctttattcttgatatgagtcttatattattaatctaaaaatcttttcttccagtctgtagcttaattctttcttttatcttctgaaaggaagatatgggtgtttacctgtattggatgtatatgtaccatgcacatgcttgtgtctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttccccctcctccccccattattttaatgtttgtgttgaaaatcgggtagtatagtcctgataataccataccatttaggttaccataagtttgcagtaagtattaaaactggataatatgatttctctaaccttgttcttcttttcaaaatattgtcataaattcttcatattttatttatattctacaataagcatatcttagttttacaagtatgtaaaaatacagtttaattttatatgttgattttatgtcttgcaattttgccaaaatcagttactaggtcaagtaaattttttgcagattttatcaaattttctacatacattactatgtcatttgcttttatttttttatttttaaatttggtgacatttggcaataaattattacttttgagtagtgtgcttactttaggcatggtttacagtaaactgtaaatttaagttctccattcaaagctcttgccaaagtggtttcacagtttcgatatttttggcaagaaaataaatatttcttgacatgtttaatgggtttctgaatttgtgacatgtgcttactatagctcactacatattattattttaagtttatttcgtatatgatcacatcttcttagttatcaatagtaaaaaggttttctgtaatttattattaaattgcagaattgcaaatgaagcagttaacatctgtggttctagaaatgaaatagctggtaatactgcagttgtcacttcctacccagttcatctcaaagagtatgccaacatacctagcaaataaatgtcttgaatgtaagctgagttgcaattggaattcttcagcttttggtgtattcaacatcttattgtaaaagttccccagaagttagaagtgatactacaattctaaaactgattatgtcatacatatgttttaatgaaaaatcttaaatcatactctcacatgccctgtgatcagttaaagcagaatgatctcactacaatgctgaaaagattttaacagttaaattgacatttgaaccaagacccttaaagaaatcgcaaaaaacattcattgtgaatccaaacaatgtgactacttcataaaatagaaaatgcaaatagaaagtagagtctcatcataccaagaaccaggaaaaatctcaatttaaatgatgaatgataatcagcagacaccacaagagacagcacaggtgttggaattgtcttataaagattttacaaaaactgtaatactacaaactctccagtagcaattagaggctttaaagaagtgaaaaaatatagaaagcctcagcaaagaaatagatgatagaagaaaaaactgagtggaaatgttagtagtgaaaacacagtgacttccagtgctctgtactatggctgttgcggagaagagaactggtgcactggaggctaaggcaataaagttcagccacttgagccgcagtgagtgaagactaaaggggttagcagacacctaggggcatttggaacaggaacaaaacatctttttattttcttccttgaaagcccagaagagaaattgggatgaaagattaaggaaaatatttaacatcctatttaatatcaatactaaaattttttgatctacaaattattaccctgttaaagagaatgagaagtcacagagaagaaaatctttacaattcgcatatcaaaaaagtcttgtgtgtagcatgtattgcaacctctcattccaattgtaagaatcaatctcattgggaaatgggcacaaatgttaacagacaacttaatatgagatatattgattagaagtaagcacaggatcttgactctagctgcatatgtatcaaaagatggccttgtcggccatcactggaaagagaggcccattggacatgcaaactttatatgccccagtacaggggaatgccagggccaaaaaaatgggaatgagtgggtagggaagtgggggggaggctatgggggacttttgggatagcattggaaatgtaattgaggaaaatacgtaataaaaaaagagaaaaaagaagtaagcacaggaaaaaatgttcagtagttgttaagggaacacagcttaaagacacgaagagattgcacctgtcaggacggataaaaaggaaacaaacctaaaataccaggtatgtgaagtaactagctctcattgatggcttgtgggagtgtaaaatagcacagctatcctagaaaagtgtgccagttcctatactcgttatatataaccctgccatataacccagcaaacacattcttggttttctttttcatagaaaaattaatactcatatctacacaaaaacctatatcctcgtgctcatagtaacttaatttttaatagcgtcaaacaaaacaacccaagtgtcacccatccaaaagaccaataagctactgtatagtgggagcagcacaatagagtactactcattagcaaagtgaaatgaagcaattccacttgtgtggatctcaaaagctttcatacttactagtgaaaaactatcttcaaaaaccaagtaccgttattacttttgtatagagaatatgtcagcgctttccagagattaatggctggagaatgattctgcaggattaacaggatctggagaaatggctcatcagctaggaatactcactgcttttaccaaggacccaggttcatttcccagcacccacatggcaacttacaaacatctgtaacttcagttctagaggatctaacatcctcttctggcctctgtaagcaccaggaatgaatgcatacacacacacacacacacacacacacacacacacacacacacacacacacacacaataagtcaaaaggggtggcacaaggttttcattctgttttttgtttgttgagtggaacagttagtatcttgattatggtaatggtttcacagatcagcgcacctttactatcagtgtacatgtaaaaactgtaaaaataggggactaatgagatggcttagtaggtaaagaggctgccatgatgacctgggttcagttcctggggtccacatagtggaaggacaggactgactccataggttgcctctgacctccacatgtgcattgtggcaaagagaatccattgctacttgagaataatttctctgcactcactcaaatactgttttttaaaggggagaagcatttaagcacactttgttttcttaaactaccttcacataattaacaatgctctatctaagtaattcattttaccttttttactgttcaaaattctttaacatcatgtttaaacaatttaacacacaataaattaaaatgttactgttaccttctacaaagtttcctgcaaggagaacttattattcaactacagtacattttcaaaacaagaaaagatataataatactattaactgaattccaggctttgtgtatattttcactttttaaaaatttttatatttttatttatacctttaaaaaactttcttttattacttatgggagaggagggagagagggagggggggagaagtgagggagggggggagaagagagggagagggagagggaaagagagtatgaatgagagggtaaaatggtaggagtctttgggcaggaacatagtatcaggcagtttcttatgctgttgcttcatcttttcatcctccctaggctaatagccttgtcttccttctaccctgccctccttttctttcttgttttcctgcctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctcatttgtttgctactttgtattagatatttaggattttttttttagaaattggtttaaaatgtttgatagagatatgtaggcaaagagctgaagtcttttaaaaaatacatgtaaaataaggtaattgctgctttacttaacaagataagcttttttttctcttatactaaacagtaactgtctacctttgatgcaaagagccagtttgtaaactacacatcttgatatcttttcaactgtttatcttcatatcttttcttcattatgttgccacacttaaattttacaaaatatcatagggaaattgatttctggaagcacttggtagcctgcttgggcctgagctattgcagtgcactgactccttggatcaggttgttctttcctgcaagggtgaaaggtcctccagaccatcttaactctgccaggcaaagattcttgtttaatatgtctaaagccagtgatttccaatctcgtctttaaaaaaaaatgtgaatgcctttactttcactttgatggctattgactatgcccagagtcttcattgtaattaccagcatgcagcacttcagttctcttagttacttcattacattttctacattggtttagaaaataattttagagaaatgaaattagcttgtttccaatacaatgaaatgattttgccacagtattaatgaatcttttcttcattatcaacaccaaactagatattgcaaatctttttaatcaaacaaattttaaattgtttatagtcttgtgattagagaatacaaacagcacaataaaatttaacttacgttgtttctttttaccaagctttctttgttagaaagagaagctgtctgtatcttaatgcctcccaatgtaaggaatgtttttaagagggaggtagaaggttcctcctcgattatgaatttttttcaatgttttattaaatattttcttcatttacatttcaaatgctatcccgaaagtcccctatgccctcccgctctgctcccctactcacccactcccgcttcttggccctgcgttcccctgtactgggatatataaaatttgcaaggccaaggggcctctcttcccattgatggccaactaggccatcttctgctacatatgcagctagagaacaagctctggggatactggttagttcatattgttccacctataaggttgcagaccccttcagctccttgggtgctttctctagttcctccattgggggccctgtgttctatccaatagctgactgtgagcagtggattatgattcttaattagtagcctataaaagtagccaactttgtgctccaagcctgcatttcttgctgcctcttatattgaagacaccttggagaaggtagattgaaaatcataattctgccttgccacctataaatttagtgttgtgaatgtgaacatctcttttgtctttcaagcagattcaattgagctaatagttactgagtgtttcttctttaagacatgtgggaatattatattctgtttatattgactacatatttttatttgttcttcagtcatttttatagtattttggtcaattataaaaatgtgagaaattttattgtgagtgaaatttgtacctcaaagaggcttttatttaattgtgtatggggaaaatcttaaatagcaaaaaaatctgtgatttgggtataattgtagcttagtggtaagagaatatgctcggcatgcacaggctctgggctcagtcccagcgaatccacactgcactctcaaagactgtctctcagattgtatgaataagtaatact

SEQ ID NO: 1862 - DNA, 1004 bp, Mus musculus
aaaaagcactgtcctttgcattttagaaacacagttcctgatatagaataaacattgggaatttatgagagttattaggtaggttgcattcttggcaggctacgacctctttaatgtcttttctgtgtttttttgattactagcatataaaagggtggccctgtttactcagagatacgtttccaaagtatttactagtatttatctgtgctgggaggaataattgtcttgagggcagcttttctactcagtcacccggctgagtcctcaggcttgggatctggtccccaggctacagggaagagttcggcacgggaagctcatcttccggccctctgattggccagttcgcactccactcactggttttcccgctctgattggccccggcagcaccccttcggcccgcgactactttgtgtgccctggctgcgcggctgggtcctcccgcccagctcgccctcccggacggtctgtcggaggtggtcatttggttcgagataatgaccaccctgatcactccagcagagaactctccaagattcttgcaaagcttgaacgcttaaaacagcaaaatgaagacttgaggcgaatggctgagtctctccgaataccagaaggccccattgaccaggggacagctacaggaagagtccgtgttttagaagaacagcttgttaaggccaaagaacagattgaaaattacaagaaacaagctagaaatggtctggggaaggatcatgaaatcttaagaaggaggattgaaaatggagctaaagagctctggttttttctacaaagcgaactgaagaaattaaagcatttagaaggaaatgaactccaaagacatgcagatgaaattcttttggatttaggacaccatgaaaggtctatcatgacagatctatactacctcagtcaaacagatggagcaggggattggcgtgaaaaagaggccaaagatctgacagagctggtccagcggagaataacatatctccagg

SEQ ID NO: 1863 - protein, 258 aa, Mus musculus
  VARIANT (1)...(258): Xaa = Any Amino Acid
GQLFYSVTRLSPQAWDLVPRLQGRVRHGKLIFRPSDWPVRTPLTGFPALIGPGSTPSARDYFVCPGCAAGSSRPARPPGRSVGGGHLVRDNDHPDHSSRELSKILAKLERLKQQNEDLRRMAESLRIPEGPIDQGTATGRVRVLEEQLVKAKEQIENYKKQARNGLGKDHEILRRRIENGAKELWFFLQSELKKLKHLEGNELQRHADEILLDLGHHERSIMTDLYYLSQTDGAGDWREKEAKDLTELVQRRITYLQX

SEQ ID NO: 1864 - DNA, 350764 bp, Homo sapiens
catgcaccatcatgcccagctaattaaaaaaaaaaaatctggggctgggcgtggtggctcacacctgtaatcccagcactttgggaggccgaggcgggtggatcacaaggtcaggagatcgagaccatcttggctaacacggtgaaaccccgtctctactaaaaatacaaaaaattagctgggcgtggtggcaggcgcctgtagtcgcagctacttgggaggctgaggcaggagaatggcatgaactagggaggcggcttgcagtgagccgagatcgcgccactgcactccagcctgggtgacagagtgagactccgtctaaagcaaaaaaaaattgtagagatggggttcttgccatgttgcctatgctggtctccaactcctgggctcaaacaatctcctgcctcagcctcttaaagtgctgggattttaggtgtgagccactgtgcccgcctggagtatattttaaactaaatgatcagtcttgaaataaatacaagttaaccccacttgacctctatctatgtaggtttataagtctacttgtaaatcacaccagcacaatttatagggagttgtttttagaacctttagtccttgctttaaataccaacagttgtgttatagcatgtactgcagaactgaaatgacattcagactttggtctaggaaatcttgtcaatcacttctttcttctgcttccttagattctgttttcatgttatcttgattttggatttagatcagataattatagggtctgcaaaggcttgctttagtttaggatttttgtagagccataaatggctaatatttatggtgtacttattcagtgtcaggctctgttcttaggagtattatatgtaataacttatttaatactaacaacaaccctatgatgtagatactattattattcctactttacagatatgaaaaaatgagacagagagttttaaagtttcccaaggtctcacagctattaattggtgagcaaggattcaaatatagttagaatcaacattctgaaccatgattttatatggccttgttcccatggaaactagaagatcctgactaaccagaggttatgtttctcaatcctgttggcagttatattgcaatgaaaattaattaactcattcaataaatatgctacatggtggggatcaagacagataggcaggatctctgctttcaagagggcctctggtttttcagacttttgtcagtttggttagagttagtgttttcccatcagactctaatttgcccttgggttaacatataaggtagaatttttgcctctgaaaagctgaacattggaactttagtgactttagcaaggtttattcttgctggagcaagtatttatatcatactgatagtggttaatttttttttttttttggctgcaatttttccttatgaccttgctcctacccatccttccccagattgtctatttttggatttttaatttttaaaatataataatatgtacttgtttctgtaatagttctttcaagatcctttctagatttgtttctttttcttttctttttttttgagatggagttttgctcttcttgcccaggctggagtgcaatggcatgatctcggctcagtgcaacctccacctcccgggttcaagtgattctcctgcctcaacctcttgagtagctgggattacaggcgctagtagagacagggtttcacgatgttggtcaggctggtctcgaactcctgacctcaggtgatccacccgccttagcctcccaaagtgctgggattacaggtgtgagccactgtgcggggccagatttgtttgtttgtttttctttgagacagagtctcactctgttgtccaggctggagtgcagtggtgtgatctcggctcactgcaacctctgcctcctgagttcaaatgattctcctgtctcagcctcctgagtaggtgggattacaggcgcccaccatagcgcccagctaatttttttgtatttttagtagagatggggttttgccatcttggccaggctggtctcgaactcctgaccttgtgattcacccacctcggcctcccaaagtgctgggattacaggtgtgagccactgcacccagcgttgtttcttttttttttctttttgagacagagtcttgctctgtcgccaggctggagtgcagtggcgcaatctcagctcactgcaacctctgcctcccgggtcaagcaattcccctgcctcagcctcccaagtagctgggattacaggcatgtgccaccacacccagctaattttttgtattttagtagagacggggtttcaccatgttggtcaagatggtctcgatctcttgacctcgtgatctgcctgcctcagcctccccaagtgctgggattacaggcgtgagctgctgcacccggcgccggccttgcttctttttatacagccttattgatccagcctaactcaatatagtttattaaattgcaatggtattgtatcaatagtatcagaatttattaaactgcaatggtattattgtatcaatagtatcagaattagtggcatataacagtaaaacctagataatagtggcttaaataaaacagcagcttacacaaaataattttggaaatgagcaatccaggattggcgtggaggcttgacaaagttgtcaaggagccagctccctcccagtcactattatgttattcccagggtacagctatcctcctcatggtccaagatggctgaaagggctccagtcatcacatcatcatgcctcaggtaatgggatggagagaagcgataagaagggtgcatctccttcattttcatgatttttttaaaaaatgtaagcactgcacaatatttctgcttagatctcaataggcagaatttagtcatgcagccacatccattgcaggggagactaggaaaagtaagattttagttgagttccaataggactatccagaaatggggatttgtgattatggaaaaatgagaaaagatataggaaggtaaatctgaagtgtcttctactgggagcttacatatagttagtatcttataaaaatttgttgattcactttcataaacttgatggtcatattcttagtggtatcatccaggtcattaatgaaaagtaatacatctaaaaatttttcctcttcttattttttttactttatgataatagagcatattattgcattaattgcatctacaataaacctacctggaaatagcttaggcaagatggaaacaatattggaaggatacagggaaagcctagaaacagaggagcctaagcagaagaaaaggcagaaattcaactactggtcagcaaaacctggaactgagaattccagtataaggatacttctgtcttctctgcttcctctttccactgactttattctctaatgcagaatgagtttctccacttggcaaatgactaatgacttctcccagattttatatctaggtgaggcctgagataatctctcttctcacatctataaacattctggaggaatgggttcattgtcccatcttgggtcaggtgtccccctcttgaccaattaggtgtgggcaatggacagcggtcacacagctctcgctgccatcataataaaaatgtgggcatgagagcagtagttcctataggaaaggtgggtgctggccacacactaatataggtatacgttaaaattatatgagatgataaaatacaggtcgatggtctgaattaaatgaatggtaaaggagaacaggatctatcctaatgcataaaaatggtttagctatgaataaacatcatttaatagggctgcaatgtatacaacatttactatatgtcaagaattgtactaagtgctttttgtatgttgagtcatttattttatacaaccccatgagctaggggacatcatcccttcttatagatggaaaaaccagagctcagagaggttaagtaacttgcccaaggtcagattgtaactgagcactgtttaatgtgcatagaggccaatggccaataccatggcactggcttttgagaaaataaaagctttattgcaagtcaaccgcaaggagacaggaagatatgctcaactctgtctccctgtgcagggcttgttttctttttcttttcttttcttttcgtctctcgctctctctctttctctctttctttctgagatggagtcttgctctgttgcccaggctggagtgcagtagcataatctcggctcactgcaacctccttctcctgggttcaaatgattctcctgcctgagccttccaagtagctgagattaaaggtgcccactaccacgcccagctaatttttgtatttttttagtagagacagggtttcaccatgttggccaggctggtcttgaactcctgtcctcaagtaatctgcccacatcggcctcccaaagtgctgggattataggtgtgagccacagcgcctggcctgggccaggttttataagcataaagtcatgagatgtgatctgattggatcttgcaatgaggtgatgctgggaggtatgatttgattggatcctgccatggggtgatgccaagcttgatacgattagatcctggatcctacaatgtggtgtccccttcttaattcagtcctcactcctcagtcagagcacttaggttcccgctgtagttgcagactcggttcatctgggcatgttcaggttaggtgaccttcaaactggggggccattggtaactgaaaaacaactcacaactttgttacataaaagttgaaccagattggtgtgatgtggttacaaaaaagctagtaagtctgagagtaatatactggctcaatacttctctatcctaagttggaaactatggtcaattttgatgaagaaattattagctatttccctacttcaattttgccataccaaagctatatgagcttgataaaccttgtaatgtcttacaaggttttaatctcttcatctgtaagaagattggattgaatcaaattactctctctccttgttaatacagataatacttttttttctgaaggcaagagtatgatctattacattaaaatgtttttaatgtatccaatatatttaaaaaaatagagacaggggtcttgctatggttgcccagcctggtcttgaactcctggcctcaagtgatcctcccaccttggcttcccaaaatgttgaggtgaaggtatgagccataattgctggctatatccaatacgttttagtgcttcttgagacatatctgtgttaggaactgagatgaaattaaagatatacaagatagagtttttgcttacagtgttatggtgggaacaaacaaacataattattattttgtagaattaatagtccaggaaagaatagttttcaggagtggtatgaccacagctcaatcaaatctgcaagggttttctatctgtctgccatcgccagtaggttgacttcattttcaggttagttcctcttgcaagattgctgccaatggcaatctgggttacaggttgacttgctcatatctggcaggaaagagagaactccttcccccagatatggactgaaaatcctttccttcagtctgattgggctagtttatcctggtcctaatggttttcaagtgtatcaattagaatagtctaggactattctaattctagcatattctagtctagcataacctagatgctaggtcatactgcattgaaaaatgcccccaaatctcagtggcttaaactacaaaggtgtatttcttattaaaaccagatgaaaatgggaggcaggctgctctaccttgtccttttttttggaagttaagccgagagaggctttaccgatactttcaagataatactggtcttgagtctggagaagagtaaacactgtaaggacttacgctggccatgaactgttctacctggaattgacacataccacttctgcccacaacccactacagactggtggctatagctagtcagtcacatggtccagcccaactgcaaggggaggagggtatctgggggtgggtgtggaaaaatataatctttttgtatgtctggaaagagagagtaagcatgataaatctcctaccatattagggaacccatttattggctaattgagttgcctttctgtagttggagttttgggtggttacctaaagaattggcagatgaaaacaaaaataaacagccctattaataaggaaggacgggagtgaatgttcaattagaaatcaatagtgtgaactatatgctgctttatcccagtggagaagacagaaatttcagccatggaggcaagtcatagggagggatagtctggctagtttcatcagtctttaaatcaatcacttcatttactcttgtaatgggaaagatttgctctggctttttaatgagtaggtatagagtttgtttaaggagctggctcaaaagtgacttaaaacacattgaatttgaaaatatagattcttagctactcaggaggctgaggcaagagtacagcttgaggccaggagttcaagacgagccttggcaacattctgcgaccttgtctctaaaaaataaaaatgaaaatatagactttttttccctatatttcatttttgtagttattgtcaatggtgtgtcaagttggctagatttatagttttagaactgacgaacaactaaaacttacctagtccaacccttttattttacaaatgagaaaactgaggcccagatgggtaaaatgattatctcaaggtcaccccttcttgctcttggcaataacaatgctgccctttggatgacttcctggaaaatcggatcctgtaagtgaaatgtagctagagcaacaattataaaacaacgagaacaattaacaattattcagaatgcttccatggctgacagtcagttggtacacgttggtagagatagaaaaatttctaaactatttggtaagtagcttatgctaagccttctgagtgcctcaaccccttgctggaactccacagatctccccaccgtaataacaggatccacctcaaaggtttgatttgagaattaaatggtggaggtaaagagttttgcatgaggcctggtgctcagcactattacactttggctattatttttattacagtcataataaaatggtagtaaatttcaaaccagtttctacatgaatgttcacaacttaggaaatgtgatagcattcacgttcattaactttgatctagctaatctctcaataaaatggccactcatgtactcactttaactttcattttgatcttttccatagtctaagggttgactccttcttgccccgggacacccgagtccccatagctctagctgatggttaagaatttgaccgaggctatatacaagaaaacaatgcactgacaaggccctgttacttgttgtataacagatcataacgattgttctgtctaatcttttgttgaacagaacttgtctttaacttttgggataagcaaagatgggtccaaaacctagtttggtgagggaggggtggagtaagaggtggagtacctgtacttacttaagcaactattacaaactggcagtgatgagcagcagaggcaagcagttgggagaagagaatgagagagcgcagcaacagggtgggacctgcagcttgtggaaaaatgcttttgacacagatactttctgatggccagtgatgtttagaaccttttgggggattccttctctctcagaatttaacctggcaagagaacgactgagttctaggaattttcttgtctggagagagtaaaataaatgtattttttaaaagctgggactgttatccacactgagaagaggcagggtataaaattccctttcataagtgaatttcctggaaattcatgattggcttggaacttaatgtgtaaagacttgttctcaaatatcagttgtttgacagagacctccagttttgggatggcagctaaatcctgagcctgccttggaaagggttttgataataatgttccatcacaggtggagaagcacattgattcaacaaagcagacttcaaaaccactgaagaattagtttctgagtgtattcaagagataccaaagttatttgttattttaacgtatattatactgttctatacaaatgcaccaaatcctgggcaaaacattcctaggacaggtttttttttttttttttttcagttggaaggaggtagggaaaataagtgctttaattcctaggattttggaagtaaaaatggaacaccagacaaaaatggaatttttaggcaaatgtaaagctttgtacttgggtatctcaaagtattatacagtgtaaactatcatgattattaaccaactagaagtagttcttttttttaaattttatttttaattttagacatgagggtcttgctatgttgcccaggctgaagtggctactgacaggcacgatgtggcactgcagcctggaactcttgggcttaagtgatccttcctgcttcttctatcttaaaaaaaaaaagttacgcttgcttgttaaaatatttttaaaatgctgtgtttaaactaagaagtaaatatccaccccacctctgacttctaaaaattatctaaagtatgactggtaagatttttacctttaatcccacataagtctaaaatttgtgttcatttccaacaaccaaagtgtgtcacttttataccagaattttgtcctgcttatacgtttagtacagaaatctcatgggagagagcatccatgcatttacaaattgttattgaattattttattgaatgatgacacccaaactgagctagaacataattctggctctgctagtacatcttctgtgtgatcttggacaagtcactctactttcctttcaattttcttttctcacagggagataatcataaaaacgactgtaaagtacagcacttcatagagtgctttttgtttaaagagctgacaataaatacgagtctcaaggtctaggaaagcctccctcacaacctgagctgcttgaggacaagggattttcttttgaatcagcagtaccttatttgtgtatctgtgatagagttcctggtacataagggtctcaataaatatgtgaatttatgaatattaggcagattgcaaccttgacaggccactgcctcttaaatctcctttctgtgatcttttaatatttaacatctaaaaggccgccgctacttgctttgggataagtatccccggtatgtactttaaaatgcccaagcctagagaaatgattcttgtcttaagggcaccatttcgctctcccaccgtaaagcgccccaggcttgggatctgggtcccaaggctacagggaagagtttggaacgggaagctcatcttccggccctctgattggccggctcgcactccactcacgcggcgcgcagctctgattggcctcggcggcacccctcgtcccgcgactactttgtgtgctggggcggcgcgctccggtcctcccgctcagctggcggtctgggctgctctggggcagcccttcggtccactgctctgcatcgcgggcgccgggaattttccgagtccgagcgggtaggacgcatcctagggcaaagcctctcccctctccccgtgctgttctctttcccgtactaaataaacttccgcctcagaggggctgtcgcagctgcgggtcgggagaggccgggcatcgaactcaggccctcgtggggggggtctttctcttcgagtgaatgtggaaacagctcttacaagataaagtagggcttcgctgagtctcctgggggagcgatgccattgtaggatcgcgctggaagcagcagtcaagcggccaaatgcgggctgcaggggctgagcagcagcagcgcgcacccctaaaagtagcaaggagccagcttcaaaacctctagtgcgggtgccccctagggccgccgactgagctggcacgggccggtccattcccggcgctgtagggagcacagcattctctggaggcgagtctcctcccgggatccaggatccgctcgcgccccgctcagcctccggccttcaggcggtagagggcggcctacgcctgtgtgcgagccggagccggcgtgcgcagccgctgccctgctggaactgtgccgtcccgctgtggcccgcggctctgctaggcggtggatgctgctgctacgctctccaccggcgcagcgaggaagggggcggggagaatccctggcacatgccagggtcgccgtaggtggcagcggccggcgcatgcgcgccctctcccagaagccaggaacgccgaggggcgcgctcccccattcgcgcgcgcacgccggcgctggccgaggcttccccgcctgcgctcgttgtcagagccgctccggcgcgtgcgcgcgttatctccggccgacccgagcagccggttccctcctctccaggccccctccccatcccacccccgccgcctggccccagccgacccgtcccttcgtctccccgcggaatggggccggcactgctcagggtcgcgcgccctggacccagctcgctctcggtctcgcgctgtcagcgactgcccggctcgcgccgcctcgcgctctgcctcagtcagtggcgccgaaggctccgttaagcggcggcggcggttcctgtttccgtttcttcctctccgttcggtcgggagtagcatcctccactcagccacccttcccactcccccatcgtggggcagctgcggctgagggctgtggctttggcagctgcgacggggagcggcggagaccgcctctgctcccgcctggggtaagggggcgttttgggagccgggccccgcgcgcctcggggtcttgggctgggctgcgcgcgggatctgaggaggctccgcggctgtccctgctcgttcacccgggcctgttgctgcaactgctgccggttaaccagcggctctcggaaaagtggggagggagcccccgggacgctctggcggatgccttggcgcagccccgggggcgcgggcagagggtgaggggcgcccgcctctccagccgggacgcggagctgcgccgctgctgccctcggcgtcgcgcatccttgcctagggcaggggccaaagcctagggaaggagaagggttgggggcgggggtgggaggtgtccgtcgtttcccctccacacctaccttcccttcgtcagcagctcggtccctggagtcgcggtttgtggggaggaagatgcccgtgcgttatgggctctttctgagtgctgctcgggctagaaagcagggagtggaccctcacaaagatccgcgagggactgatgcagggcagttaaaggcttgagtgcagctgtactcccttttgatgtgcaaatgacgagctggcggcttttgagtatcaacttatttgggaaggttaaatgagtccatatttatcagttctaggaggtttgtcctgcaggattgagtgggttgtcgggtgcagcacctgttctttcttcacagtggggattgcaatcttcagagacgcagtgtatttcttaagtggcagtgtcatgcttagggtttgtcccggatgagcttttattttagcattttgccatataatatatagattgaggccttggttaaaggcacggacaggtggtgtttttttccttcctatgttttaattattcacagtttatttaaacccactcaggaaggtggacccagaaaagccaaattctgtagtacataaccccaaatttcaaggttttgcggaacaaattcaacacaagttttgtgtcagtttagagttaaacgcatctcaagtaactgacttaactggcttgcctctatgaaaactgtaggcaggtttcattatagattttttttttcttgttattccggcggttaggtgcatgtttattttcttgattaaatttacattctatgttttatgactaattctttaaataggtgcatcatatagaaagtattttaggagagaaattattatttaagcactacagtatatcagatatatgagaaataatggagttgtagtctctgctctttaaaataactgtaaaaacatcttaaaaccctatgccaaataataaggccctgtaccttgctgtccttgtgaaatctggtatgtgtatagaaaatcttaattacttgatttgtaaatactacagtagtattgaaaaggtgggaattcaagcatttgtaattgtgatttcacaggtttagtgtgtaaaaaatgcagggagttagagatgaataggctataagacacgtacaaaggtagttccaagacatggattttctttttgctgccttataaattgagaattctatttgaattcaagagctgaacagctggaatgaaacttgcatagattgcagaaacagatgcaaaaatgtatctttggtcaagttgtgagttaacttgaagagtgtcttgtgtaataggatagtgattcaaaataatttccataaagtacggccttatataggttatattttgaggatatttttgaatttaaaaagtcacctgaagttgttttcctacaaatcagttctgtttaagatgtatggaatcgaaaaaaacaaaacaaaactaattctgattacatcctgcattgttttgttgcaaattcttaccagttatttttacgcaattggagtgtccttaaaagtggtgaatcttaaaatttgccagtggattggaaaaaactgttaacttattatttttaaaaatgctgttatattagtacattggtctggagggggagctagtgccaaagcaaagtatagcttaatagctgtttgaacttttaaaacacccaaaaccagatttttatgaccaaaagaaacataaatttttaattaaaagagtaggaaattgatgtgggcatatatatgtacatagttatttgtggagtgaatatattgtgtattacaaattagtttaaaaaagtcttttcatgcgctgcaataatggaaagctaaatgcttaaagatttattggatttctcacttaaaaatctctaaaatgtacccccaaacttagagtatgttatagtattttcttaaccttcttgtcctgttcatcagaatctaaggcatgtattcttgacccattgtacatgttgtgtgttcttaaattttgtttttataatagctacaatcctaaaatttcaaaaacgaagcttcaagtagaatcttatatgggcgaaggtattaattgtgtggtaagctaggtatttatcaaaagtagatataattccttttttttttttttttaaagtagagataattccaataaaaaaatggaccttttagacatctggagaacaatatccccaggtcacttaacccttatctcctgcagtataatgcagtgcgtccagctgatctaccaaattgaatgtgtgcctttgaatacgaagcagttgttttgtggcctgtggcatttcatttaggtttctaagctgtaataaattagtatgttaatttacttctttccattcacatattctttaaatccaagcctagaaactgatagttatatgtatattaaaatcattggaatattggtttttttgcagatagtgtttgggctgtttattatccatagctcttcattatgtaaatagaatctcaatgctgataaagtaaatagattcttccatttcattaatggttatttttgatttatgataaactgcatttaataaatctcttgatttagttaaatggtggatacatcatttcatattatagcaaattgataaatataaaagaaagttttacaatcataagagtaaatatttaaaaaaacttgaataagttactttactaaacataaaattaagatttttaaacaactctgaaactaaaagtattactattatggtacctttttttttttttcccccaaagagatgtgatcttgctgttttgtccaggttggccttgaactcctgggctcaagcaatcctcctacctcagtctcttgagtagctgggactataggcatgtgctaccacagccagctttattatagtacttttgtaccctgcatcaatgctgcttctgttgatacttttcaaaggagatatcaacttctggtcttcaacagtagtgtagcatcctcttattgattctctggctcatatttcactaccgtatagtatggagtttctttcttggagtttgaattgtttttacattgcagcttgttatagtgaaacaattaaacatatttaaaagtaaaagatatttacgactgatttttaaagaacctgtaaaaaaatctccaacagaagaatattatatggggatgtgtagatttaacattttattttctttaatttttttttttttttttttgagattggggttgggggttgtctctctatgttgcccaggttggagtgcagtagtggcgtgatcacggctcactgcagccttgaactccctggttcaagccattctcccgccttagcctctggagtatctgggattatgggtgcatgccaccatgcgtggctaattattttttaatatttgtagagatgagaccttggtatgttgcccaggtttgtcttgaactcctggggtcaagtggtcctcacaccttggcctcctaaaatgctgggattacaggcgtgagtcactgtacccggctcctttattttattaaaaagatttttgtttgtttgtttgtttctaagtttaaaagagacagggtcttgccatgttgcccaggctggtcttgaactcctgacctcaagtgatcatcccaccttggcctcccacaggcgtgagctaccatgcttggttgtaagatttttaaaaaatggattagtttcaaatctcaacttctctttctttcaacattctaatctcctggcattttttcctttccccagctaccccccatcatccaacagtcttccatttggaataatgggaaatcaaaccaataaagttaatcttacctcccaccaggcaaaggtttttcttaatctctacaatattctgaacataaaacccatataaactttatatgatactacacattttccttttaacagaggaagagcaaatgggacctatggaattatgccgtatttgtcaatataagggttacttttgtactcttactgaaagcagagttatagggctaatttcatttaaattttcttacccatctactttaaaaaaatacctctttgtggtagtcttttttttggtcagaaaatgacaatgtgaaggagaaatacgttttgaatttataaatcttcttttaattaacaaattataccaatataagggtagtgttaatgtggttcaaatttgcctttgctattctgccttttcttctatagtgattgtatagttatactataacttcttcatcgaagcactggaataaaagaaaaacttttaaagatcactacgaaatgctcactgtatttgttgtattttataacttgggtttttaaaatttatttttccataaactgaataaatatgaaaacgaacttgaaagatcttgtcacagccttgatgactggtcagtataaagttcacattataaaataataaaacattgataataatcttagatgaaaatggaaaattaagctaatgtttattttagaacctgagtaatgagtttatatcatgtagcaatgaggcacatgaagacggttagaattagtttttctaatgaataaacttcatgatataaacttgaaagtgcataaatgctataactttctgattgtaaacttgaacaaaagtaaaatgaaaatgggagagtcctcttaattacctttaacgtataactaaaatgaacctgtgtatctgtctaagtcttatttgatcaagactttcaatggacaatgaatgagttttaagtttttatcaatgttgtgactgatttttctataatatcccttaaatgagatatcaaattctaataatatctagaaccagattaaatttggttagagtataaacaatatttacaaaccatcaaaactataataaaagcattgtaatgttatttaatgacttaagccaacattccataagctaatctaagcatttttacaattaatacaattgatagtaatatcttaattagtggtaaagtggacagatataatttatagattctgtattgtctgggaccttggggcagtcagtgaagagagggagatagagagaggagcatactggttgatgagcttgccttatttggagatgaaggagatttattcagtttttctctttccctctacttacttctccttgtttgtcatcctcttctagcaatggtaagaaatgcgggaattgaccatctttacagtatacttttttccttagagttcatagaacatttccaggtaaaacattagcttttatgttataataggtttattataatgatatcatttccttttgaggtggtaggcaagagactagaagaacttcatttgtatagcatttaatattatttattaaaaatgattttataggccgggcgcggtggctcatgcctgtaatcccagcactttgggaggccgaggcaggtggatcacctgaggtcaggagttggagaccagcctgaccaacatggagaaacctcatctttactaaaaatacaaaattagtcgggcatggtggcacatgcctgtaatcgtagctacttgggaggctgaggcaggagaatcacttgaacccgggaggctgaggcaggagaatcacttgaacccaggaggcggaggttgcagtgagccgagatcttgccattgcactccagcctggacaacaagagtgaaactctgtctcaaaaaacaaaacaaaacaaaaaaacaaaaacaaattctaaccttcatgtgcctcattactgtaatgtaaaaaaaaaaactatgttcattgaagagaactaacatattaaactaaaaatgaagcacagtgttctccactcatgggagtactgttagcaggtttaagacagttactgtgagaagttcacaaggtgaaagtgtctttgataattagggcctaatcaattgggatttgacttactcaatttctccaacacatggaattgtactggtacctgaaggagaaaaatatataatagaagttgtattagtttttatgtcttgagctctctgaataactacttgattcattcagttgccaaatgtcaaaagattgtaattttgagaaagttgattctttacaattagaactaagccagggtaaacaatttgctttctttttctaagttttaggtttttctttctctcttaggaagtttagtgaaactctaggggttaggcaggttgtaactgaaattcttgaggccaaaaggtcctgtcttatgcttggtaaaccgaccccctcaacagcgtgagaaatgtagatgtactgataaccctgattgcttcgtgacataattacagacatccagccctctatcaactaaaattccgtttatttttaaggttcaaatattagaagtatctgcttgatacatctcataggttgtcaagtgtgcatacgatgagagatataatgttacttttaatttgtaagtaaacaaacacacaatattatgttctcaatgctgagtaagctgaaaagatgtatacctactgaggatgcaccaaataataagcaacagaaacctggtaatgtgcaattaggaatagttcctcttaataataataaaaaaaagattagtgtttaggttttaatggcataaagatgtaatgaaaataaaattaccaaagaagtctattttggagaaatttttgtcagactagataacaaagaaaagaacacatcctttttttatttttattttttattttattttagagatgaggtcttgctctgttgcccaggctggtgttgaattcctaggctcaagtggtcctcctcccttggcctcccaaaatgctgggattacaggtgtgagccaccaaacttggccagaacacatcctctatatgactgtctacagaggcttagagtagtacagaagtacctgaaaggaaataatgataaataatgaaaatgttttaatagggatcatgtgttcatttctacatgtatatcagtatagtacctatcgtttgctgtttctgcttgtaaatgcacggttggaaaataagatacccaacctttggaaattattcagggaagtgcatctaaagtttagagaaaagttggtttcttcatattttaatgacacttttcagcacgtatagttcacccttgaacagcactgggtttggggcacagacccccatcaagatgaaaatccacatgtaacttttatctcctcaaaaacttaattactaataaactactgttgacttccagccttaccgatgacatagtcaactaacacattgtaccttatatgtattatatactgtgttctcaaagtaagctagagaaaagaaaatgttattaagaaaatcataggccgggcgccgtggctcacgcctgtaatcccagcactttgggaggccaaggtgggcggatcttgaggtcaagagatcgagaccatcctggccaacatggtgaaactccatctctactaaaaatacaaaaattagctgggcgtggttgcatgtgcctgtagtctcagctattcaggaggctgaggcaggagaattgcttgaacctagaaggtggaggttgcagtgagccaaggttgtgtcactgccctccagcctggcgacagagcgggactccatctcaggaaaaaaaaaaaaaaaaaaaaatcataaggaagagagaatatatttactcttcattaagtggaagtggatcatcacaaaggcctttatcctcattgtctccacattgagtaggctgagaggagaaggaagcggaggaattcgtcttgttggtctcagcatggtagaggtggaagggggaaggggaggcgtgagaggcaggcacacatggtgtaactttatggcaatacgtcatacttctgccttttttgctttttcatttctctgaaaacatttccatatggtaccaatccttcttccaccgtttgctttagtttcagtgcccatatcagagaagggtccatgtcatgaaggagtcaaaagcagtcttgaacaatcagacagtcttctgccatatcgtctgatgtcattttgttttcttgcattccttctacattacctggtactggattggaagcacttaccgagtcatctttttaaattcctcttgtgtgatgtctatttcttgaatttctccaagatttgtatcttgaaaccctttaacccaccccccccccttttttttttttttgccatatccacagtctttttcgtgatttccttgattggccctgtggcaaatcctgtgaagtcatgcacaacatctggacacagtcttctccagcaggaatttattgtttcaggcttgatggctttcatggctttttccataacaacgacggcttcttcagtggtgtaatccttccagactttcaggatggtttctttattggcattctctttcatagagttgacagtactttctgtagtgtactgtgtccagtgatcctcgtgaccccctgatttagaagctgaattagagacattttgtttgggggcaagtagactacttcagcacctttggtgttgaactcatggggttccgggtggccaggggtattgttcaataataaaagaacttacaggcaaaatacttcctgacttcagggacaaagcatcaatggaaccaatccagaaaaagggttctcattgcccaggctttttttgttctatgaccaaaagactgggagctggtgtttatcttttcccttcaaggcttgggggtttgtagcattatagataagggcagttctgatcataaaccacactgcattttcaccaaacagtagagttagcccatcccttcctgcctttaatcctggtgctttttctcttccttactaatgaatgttttttatggcattgttttccagaatagggcacttttgtctatattaaaaacttgtttaggcggatattctttctccatatttcttttttttttaagagatagggtcttgctcaattgcccaggctgacatgcaaatggcatgatcatagctcaccgcagtctcaaactcctggacttaggcagtcctcctgcctcagcctcccgaatagctgggatgcaagtgtgcaccactatgcctggctaatttttaaatattttttatttttttgtagagacagggtctcactgtgttgcccagtctggtcttaaactcctggccttaggtgatcctcccacctgggccttccagagtgctggggttacaggtgtgagccattatgccttcccccagctaattaaaaaaatgttttttgtagaggcagggtctcgctgtattgcccaggcccaggctgatcttgaactcctggcctcaaacgatcctcctgcctcatcttcccaaagtgctgggattacagggatgagccactgcacctggcctcctcagtgattttctttctttctttcttttttttttttttttttcgagactgagtctcgctttgtcacccaggctggagtgcagtggcgcgatctcggctcactgcaacctccgccttccgagttcaagtgattcttctgcctcagcctcctgagtagctgggactacaggtgtacaccaccacgcctggctaatttttgtattttttgtagagacggggtttcaccatatcggccaggctggtctcgaactcctgaccttgtgatctgcccacctcggcctcccaaagtgaatgattttctttcttttttttttttttttgagatggagtctggctctgtcggccaggctggagtgcagtggcgcaatctctgctcactgccagctccgcctcccaggttcacgccattctcctgcctcagccccctgaatagctgggactacaggcacccaccactacgccaggctaattttttgtatttttagtagagactggggtttcacagtgttagtcaggatggtcttgatctcctgacctcgtgatccgcctgcctcggcctcccaaagtgctgggattacaggcgtgagccaccgcgcccggcctaagtgaatgattttcttaatgtcatctggaaagtcgtctgctgcctcttggttggcagaagctgcttctcctgttatcgtgacgtttttaaagccaaaactctttctaaaattatcaagccatccgtggctggcattatattcttcagctttagatccttcgccttccatttgttttaagttgtataatgactttgctttttcttgaaacttattaaagtttatagggatgcctttctttatagcaatcctgtacccctataaaagctacattttcaacatgagataaaaaactatttcacaaaacgtgcacaatttttgcacctgctggtgtgccttcagcaatggcttcatgaattctttttttacaatggcccttatgctggattcatttattttgaagtagcacgcaactgcagctgcagacctcaatctacagtacgtatcaagcaattcacctttttcttgtaatgccatgatttttctctgcttcttgggagcacttccggcatcactagtggcacttaggtgtcatttgaggtttatagtatcgtactaaacataatgaaaccgcgagagatcactttttactggaatatacaatttattggaaagatgaactgcttgcttggagatgattaatgtcacatggtactttaagcaaatattcactcttgagctcacctcattaacaacaggaggtggctacaaaattatttcaatagtacagggtgtagtacagttaaatttatgtagttacgatttaatactgcatctttactcttttgagacagggtttctctcagtgtcaaatgccaccatgtgtggctaagtgtgtggtataagttgtgacaatttttaactttttataatagatttgtatatatttgtagtagtaaatgataaaatagactagtatctacatatattttaagcactcatgacatacctcttactttctatttttcttttcttttcttttttttttttttttttgatgaagtctcattctgtcacccaggctggaatgcagtggcacgatctcggctcactgcaacgtccacctctggtgttcaggtgattctcctacctcagcctcccgtctttttctttttttgacccagggtctcactctgtcactcaggctggaatgtcatgattcaatcatagctcactgcaacctctgccttctgactcaagcgattctcccatttcagcctcccaagtagctgggactgcaggtgcatgctaccatgcctggctcatttttgtgttttttgtagagacagggttttgccatgttgcccttgtccagggtggttttgaactccagtgctcatgatcctcctgccttgacctcccaaagtgctgggattacaggtgtgagccactgcacatggcctacttttttgatatttctaggttatatggttgtctatgaatattttcaaattgtcacaaacctcccccaaatttatcaacatatttattgaaaaacattagcatatgagtggaccctcaaaattcaaacctgtgttgttcaagttttaagccctgagagctctaagagtttaaagctaaaaacaattagaaaaaaaatggagtttctttttttttttttgagacggagtttcactcttgttgcccaggctggagtgcaatggcacgaactcggctcaccacaacctccacctcctgggttcaagcgattctcctgcctcagcctcccaagtagctgggattacaggcatgcaccaccacacccagctaatttttttgtatttttagtagagacagggtttctccatgttagtcaggctagtctagaactcacgaccttaggtgatccacccgcctcggcctcccaaagtgctgggattacaggtatgagtcaccatgcctggccgttttttttttttttttttttaaacatgaaatgttctttttccccctggttttattgaggtataattggcaaataaaaattgtatatatttaaggtgtacaacttgatgttttggtatatgtgtagattgtgaaatgtttaccacaatcatgctaattaacacatccgtcacctcacatagttatttttgtgtgtttgtgtggtgagaacatttaaaatctcctttctggctgggagcagtggctcatgcctgtaatcccaacactttgggaggttgaggcaggcggatcatgaggtcaggagtttgagaccagcctggccaacataatgaaaccccatctctattaagaatacaaaaaattagctgggtgtggtggcgggcccctgtaatcctaggtatttgggagtctgaggcaggagaattgcttgaacctgaaagacggaggttgcagtgagctgagatcacgccactgcactccagcctgggtgacagtgcaagactctgtctcaaaaaaaaaaaaaatctactttcttagcagatttagtgtgtacaataaatattattaactgtggtcaccatgctgtacgttagatctctcgaacttactcatcctgaataaccctttggccaacatctccccatttcctcctcaccccagcccttggcaaccaccattctgttctctgcttctatgagttcaccttttttagattccatatataagtaagatcatgtagtacgtgtatttgtctttttctgccagtcctattttacttagcctaatgtccttcgggttcatccatgttatttgcagataacagtgtaaaggggaggcaaactttacctccacctttttaaagttttttttttttttttgcttggcctcacaaattaccataagatagattatcaggagaaaagcacacaaatttattcaatacaagttttatgtggcacaggagccctcataaggaaacagacccaaagatacagttagaattgaatacttacatactgaattggacaaaggataataacttgtgaaaaataaactggattatatggggaggcttaaaggatagaagttattttaacaaagtctgtatggaattctctttgtctccatatcccgtccttgatgataaaaatgttgctttccttttagtttaaggaggacatcattcacatgggaatttcatctgcttttaagaaatagaagaaaggtcagagcgctcttcttacacctgctgtttttcaagtgcctttgactcaaaatagtcaatatgtcagaatggcgtatttaaactccaacaggattgtcttactttttaaaagctgaatatgaatcctgtgtgtgtgagcatgcacacacacatgcacacataacacattttctttctttttttttgagacggagtctctctttgtcgcccaggctggagtgcagtggtgtgatcttggctcactgtaagctctgcctcccgggttcaggccattctcttgcctcagcctccctagtagctgggactacaggtgcccgctaccatgcccggctaattttgtttttgtatttttagtagaaacagggtttcaccatgttagccaggatgatctcaatctcctgacctcgtgatccgcccgccttggcctcctgaagtgctgggattacaggcgtgaaccaccgcgcctggcctacataacacattttctttacccgtttatccattggtggacgcttacgttgactccatatcttagctatatgaataatgctttcatgaacattggagtgcagatacctccttgacatactgatttcatttcctttggatgtatacccataagtggaattggtggagcatatggtagttctatttttaatattttgaggaacctccacactgttcttttataatggctgtctcaatttacattcccaccaacagtgtacaagattcccttttctccacatcctcatcttttgtctttatgtgaatagccattctaacaggcgtgaggtgatacagaattgtggttttgatttgcatttttgtgatggttcatcagtattttttcatataccaattggccatttatatgtcttcttttgagaaatgtctatttaggtctgtagcccattttttaattgcattatttgttttcttgctattgagttgagttccttatataccgaattccttcttagtaattttaaaaatagcattattaaggtataatttatataccataacattcatagttcaagttctagtaaatttatatagttgtgcaacaattatcacaatccagttttagaaaactttcatcttccaaaaaacccattcttgtccatttgcagtcactccctgtgcctatccccagctccaggcaaccactgatctgctttttgtctccatggttttgccatttcttgatttttaatattaatggaatcatacaatagtgtagtcttttgtgtactcctcctttcatttagcatgattctgtttagtaatgggaatgaatggataaagtacaaaagctttgaacttggaatcaggagacttggatactagtagtgtgtgccaccaaatatataaacatggttaaccacttgtcccctctcggcctctgctttttcttccataaaatgaattattttgactttcttatatcccacttttcacagctgggtagacattcactgaccttttcttaaaaggtacattaactcttcctcttaaatgtagccactgtgtgtgtgtgtgtctttttctggatcaaaaaaatgaggcttatgtcagctatggtctgaatgtctcttcagaattcttacgttgagacctaaccttcactttgatggttttaagaggtggggcctttgggaggtacctacgtcatgagcgcagagctctcaggaatgggattagtgtctttactattaaagaggcctgagggagcttgaacccccactttctgccatcaccagacaccaaaccttgatcttgcacttcctagcctccagaactgtaagcaataaatttctgtcatttataagttacccagtctaaggtattttgttatagcaccccaaacggactaagacatggtctaatggatgattcagcaatgaacaaatttggaattgtctggaagaatcaagatgggtgattaaacattttcttgggcatttcttagttcacacatacaactctgaggatggggataatcttaaatgctgagttaataaagatttttgacgagaacaaagccatagttgaataattctgtgaggtagagcttcaaaagtgattgaaacttgttatgaagagaagtacaagactatatgctgttttagttttttgttttgggagtagaaagtgggttggaacaatttcagtgaagtttgtgccaagctgcactcaaggtagtcaagtggggttagatagtttttcaagaagaacgaaggaaagtgcatgactatcattgggaaggttgtcctagaggcaaagctgacaggtaacattcaggttataaactaggaaaacaatacatgtatgggggatttaaaaaacagtgtacatgtgtatatgtgtgtgtttgtaacaggagtagacaattgactgagtaggctggtgtcaggtatatgctaaaagagtaatgttcattttcagtatagtataaaaaaagagaattgaatcacagctgcctaaatttaaaaatcagtgttgtaactgctttcaaataatcaataatttgacttttagaaaccttcagggcttgttattttacctacagtagtaggaagtatggctattaaatgattgaactttatttttacccaacatactagagcatatgagtgataacccacagagcagacactggaggaggggaatgtagctataaatgtattttaatgatggtgtcattacagcggcgtaagaaaatttgtttcatgttttagagtcacactttttgttcaaaagtagcatttccaatgtaggtaaaccactttttgataacaaatatctccaaatcaaaactatgtttattttatgaagatttgtcactctgacaatattataaacattatattaagactttaaagcaggccaggcatggtgcctcatgcctgtaatcacagcattttggaggctgagatgggaggattgcttgagcccaggaatttgagatcagcctgggcaacatggtgataccccatctttacaaataattaaaaaatcagccgggtgtggtggtgtgtgcctgtaggcccagccatttgtgaggctgagttgggaggatcacttgagcacgggaggtcaaggctgccggtaagctgagattgtaccactgcgctccagcctggatagtagagtgagactgtctcaaaaaaaaaaaaaaaaaaagacttacaagagactttaaagcagctacaaaagttgaatcccaaagctttttatgaaatgtcagtgtcagcgttatggaaataaatgtagaactctctgaggtgactgttcttattgcaagaatctttttttgtttttgttttttttttgagacagggtatcactctgttgcccaggctgtagtgctgtagtgctttcatggcttactgcagcctcgacccctggggcagaatctatcctcccagctcagcctcctgagtagctgggactgtagacacataccaccacgcccagctaatttttttttttttttgatattttttgtagagacagggtttctctgtgttgcccaggctggtctcgaactctgagctcaagcgacctgcccacctcggccacccaaaatgttgggattacaggggtaagccattgcaccagccaagaatgttcttttgaaaatgtgttatgccatatttattttaaaagtcccactgaatttttaatacatataaaatactgaaatatgagttgtgtaattggaaaaatgtcaatgtaaatgaaaagagacactttttctgttctgaagcttcaaaatattaaagatcatcgttcatattttcctggggaatttttatttttagtcataatagtaaatgagcagccgtcagaagatatagccatttctaggtttagaattccttttctttatatagttctcttgaatacttgtctttaagaaaatagacattaaggatttcttgagtaatcaaatactactttgatatttgtacagagcatgagagcaagactagaaccacattaaagcaggaagaataattaaaagttttgtaacatagcaaagaatagatggggtaatttacaatggaaaagtagacgtacagaacatcattagatgggatatagaaagctctctttaaaaaagggatatcagatcaaatagactgaagaatttgtatcctacaagttaagtaaaaaatgagatgagcaattaatgagaaaatgtgctctaaaatacttggttgcattgattggcaattcttttccacttcctataggggctatttcagaccttttctactaattttttttttttttttttttttgagacagagtttcactcttgctgcccaggctggagtgcagtggcgcgatctcggctcactgcaacctcctgctcccgggttcaaatgattctcctgcctcagcctccggagtagctgggattacaggcatgcgccactatacccggctaatttttttttttttttttttaagtagagacaaggtttctccatgttggtcaggctggtctcaaactcccaacctcaggtgatccacccccctcggcctcccaaagtgtgggattacaggtgtgagccactgcgccggcctttttttttttttttttctctcaaatgagacagggtcatgctctgttgcccagactaaggggagtggcgcaatcccagctcactgcagcctcaacctcctgggctcaggtgatcctcctgccttagcctctggagtagctgggactacaggcatgcgtcaccatacccggcttttttttggtattttttttgtagaggctgggttttgccacattgcctgggctggtcttgaacacctggcctcaagtgatttgcctgcctcagcctcttaaagtgttgggattacaggcgtgagccaccactctacttcttcctagggcctgattccagtgtactgctcttagactttgtaggttcacttttttttttttttaatgtaagatcaagactatccaacagaagcttcttcagctttgcttttctctctctctaaattgtgtaagttctgtctcccatttggtgtcagggatatgcaatatgccctttaggttttcatggctacctcttttatcccttctactgttagaatgtataggatcattaattaactcttttatcatttttattttaatcttccctagcaacaatttaatggcttaaacaaaaacctttccttattattattatttttaaatactgtgcaacaggccaaaggaaaaaaaacaatttatgtctgttgtttcaatttggttaccttattttttactaaaactgttctttctgttgttaccagtgaccttctgaattgccaaatggggattcttcagtcttgttgcttcagatttaacactgtgaaccacttttcctcctcccttctccttataactttgctgtcctcttggctcatttacaaagtcaacttgtttctcaagtatttgccttacatgtttttcattctctagattctttttcttgaaatgttacctattcttttggctttagtgagaatctcttccaggtgacccctatactgtaagttcctgaacgtcagtttccagctggagattgtcatctaattgtcatgctgtcatgcttaacccactcaaatttgaattttcttttcttttaaaatgtattttttctactttcctttttttttttttaaattattggcttttccttcccattatccaaacttgaattgtgaatcatctttgtattccccgtcagattcattcgcttgtcaaactatcagaggcctgtgaaccagagcaattgcatcttaaacaggagttgggtaaaatgaggctaaaacctactgggctgcattcccagacagttaagacattctaagtcacaggatgagataggaggtcggcacaaaatacaggtcataaagaccttgctaataaaacaggttgcagttaaggagccagccaaaacccaccaaaaccaaaatggcaatgagagtgacctctggtcatcctcactgctacacttccattagcaccgctctatgacagcttacaaatgccatggcaatgtcaggaagttaccctgtatggtctaaaaatgggagacataaataatccaccccttatttaccgtatcatcaagaaatagccataaaaataggcaaccaacagcccccgagactgctctgcccatggagtagccattcttttatgcctttactttaataaacttgctttcactttgcactgtggactcgccctgaattctttcttgtgtgaaatccaaaaaccctctcttgggatctggattaggacccctttcctgtaacatgtttctctgtcctgtaacctatttctggcaaccacggaagagactatagtgcagaaaccctgacccaacggctacctttgggtaagtgttgggatcctgtaacaaaactgcgaattctatcactacagtgtttatctcattcatctgcttttttctgtttcatttttttttgataacagtttaggttctcattaccactaacatataaatatataattataattcagtaattgctatgatgaagggtgaggtggcagaggaagttctagtaggatatggtacatagtgatgattagcttagcatcaaaaacaagtaggggcattccaggaagacaaactgaagaaaggcttattaggagtgtgctatgtgtttgttgtcaacttgtgagacttcttctttaatccttactgcagttgtgtgcttttcgtatttgcatatgctattgcctttcttcagatattgattaaaatttgtgaaagagcatgcaatggcagaatgacacaaagtaacatacatctttattacctagctttaagtgagtagagtggtaaaatgtaaggtaatgaaaagtgagtactgcctgcactgaagatttaaaacctgatataatttgcattaaaagctgtcttgaaggtttttcactatttgtaatgtaaatcttcactaggcagctgttctcagtctactgttgttatatgtggctttatcttttatttctacctctcttctgtctcttctctctctctctctctctctctctctctctcgctgtgttgcccaggttggaacacagtggctattcacagatgtgatcatagagcactgcaacctgaaactcctggcctcaagccgtcctcctgcttcagcctcctcagtagctagggctaaaaatgtgtgccaccaggctcagctatttctacctctttcaaatgtgtgtgattgccctacagtggggttgggtaatatcttgatattagtagccactaatactgaaaataactgaaggccacagcaagtaaagagagaatttactatttttgtttccttagagaagccaaatattttgtgattttaaaatgggaagcattaaaaacaacaattctaaaatgccttatacagaaaggtgatttattggctatgtaaataggaagaatagagatggagaagtccaggaacaaccagatccaggaacttagatgctgtcttcagagtattctagcttcattttattttttctcctgttggcctcattttctgcttatgttagaaagcttctttcatggcaaggatgcatggcctcagacagctgagaacttagttccctaggatggcctctgacaggcttatctctgggctaatcactgtggggaattgtcgttgacattaacatcagaaccacacaaatcgggggtagtgtcagttccccagaggatagatgttgttaaccagagaaatagggaaaaggaatttgaagtagcaaaaacaatgtaaagccatttcagaggcagaagaaagaaaaggcaatagtagacacagtgaaagagaaatacttacataggagagagaagcagggaaagggaagggaactagaatttaagaattcaaaactaagaatttactgtgtggtaagcctgtgttaagcgttttacattttatctttacagctcagtggaggcagctgtattatctccagaggataaccatttgtagatctggtagtgaaaagcccccccaccttttttttcttttatcccaatttggcatatttcctttattttttatacaacttttttcatttttaaattatgcattaatacattaaaatccacactgcaatacacagttctatggattttggcaaatgcatataatatgtatctaccctcataatcaagacacagaactcctgctgcccatttgtagttaacctctccccctaagttcatcgccctggaaaacactgatctattctctatggctaccattttacttttccgaatgtcatacacagttgtcactccttatctgagggaaattagttccaaaaccccttcagatactaaaattcacagatgctcaggtcccttatgtaaaatgacctagtgtttacatatacacacacatcctcctggtactccagtcatcgctaaatataatatacaatgtaaatactatatacatcgttgttatgttgtttatatgtattatttttgttgtattttttttactataatattttctatccatattggttgaattctcagatatggaactagtggatatggagggccaactgtaagtgacattgtagttatatagacttttggatcagcctcttttacttagaaaattcattgagattcatttatgttgcgtgtatcaatagttcgttcctttacattgctgagtagtaatctgtggtatgaatgtaccatggttagtttatccatttgtctgttgaaagacgtttagcttattgctggtttttggcaattatgaataaaactgctatagacattcatgtatagctttgtgtgtgatcataagttttcatttcacttgggtaaatacctaggagcagattgctggatgatatggtaagcatatgtgtaattttgtatgaaactgccaaattgttttccaaagtggttgtaccattttgcatttccaccaacgatgtttgagagttccagttgctctacatccttactagcacttggtagtatctgttcctttttctttcttttttttttttttaattttagctcttataataggtgtatagttgtatatcatgtggttttagtttgcattttcttacaattgacttttggtgtatttttattttcgtgtgctttaagatatcttcccttttttttttttttttttctttaaaagacagagtcttgccgtgttacccagactggagtgcagtggtgtgatcatcactcactgtagcctcagacgactctgaactcaagcagttcttctacctcagtctcccgagaagctgggaccacaggtgtgtgccaccatgtctggctagtttttaatttttttgtagagacaaggtctcactgtgttgcccaggctgtaaaatatctttcttgagctggtcctgatggcacaagtgtgtaatcccagctactcaggaggctgaggcaggagaatcgcttgagcccagaagtttgagatcaccctgggcaacatagcaagaccctgtctcaaaacaacaacaacaaaaacttttctttaacattccgagaatgcttattggctttaaaaaacaatgatagtggccaggcacagtggctcacacgtgtaatcccagcactttgggaggctgaggcaggcagatcacgaggtcaggagatcgagaccatcctggctaacatggtgaaaccctgtctctactaaaaatacaaaaaattagccaggtgtggtggtgggcgcctgtagtccagctactggggaggctgaggcaggagaatggtgtgaacctgggaggtggagctggcagtgagccaagatcgtgccactgcactccagcctgggcgacagagcgagactccctctcaaaaaaaaaaaaaaaagtttttttccaaaatagaatagtaaatggccctgacaaggtctttgacaagcattggggttgcacactcaactgtaccacacaattccaggggacatcattcacataaaatttttttttcttttttcctactggagttgtgcagtgtagcagtctgggctatatatttacagttattatctaggattatcagtgattaggttccatggaaaatttgagtactaccaaatgatgcatttaaaaagcatttttcaatgtttctctgaaatgaaatttttgtccaggagctagttctgaagaaatgccctacaggcagtatgtctaatggatcagacctgggagacataaaggcctatttcaggtactcaactctgccatttactgcatgagtgaccttgggcatcttgtctagcttctttgagttcattctttatcagcaaaacaggattgataatctctcctttttatagatgtgacaagaattataaataatgcatgtaaaatatctgatgtagagcagacctcttcaagttgcaactgcttttacttctgtttattagcacttagtactgattagccacagctttttatcaaacaaaagcttagggtatcagcaaagcagaaagaaaagaatttgaaaaacaattgaaagcatttactacctaacatttaaaaaaatactgaagtagaattaggaaagaaataagaatttattggattaaatgttagctgtttagtattgtttttattttgtatttaatagggagagaatagagggctatactattatattttctgtacttgggacctccaaaggtcttaatttggtcttatcaccactaacaccaccactgccatctccatgtcatgcttatgttaaagaaagactttgaaatacgtcacctaatgtttagggtcgtagaaatgcaatttactgttttgggactagagtacatgaattcatattacttgacatcattagttcttcccagtaaaatgagaatatttgaggtcccagagtattttataaggttttaaaaacttcataatttcttaatgtttttttgttattacccatagtgattacaataaaatccttaaaacagcaaggaaggagaaccaaggagattagatgtgctttatggatgcaaggagagaggtttagcaagcaatggagtagggagtaaagaagaggagtttagcctgagtttctggatctaggaagtaatgtagaagtcttaactgtagaagagtctttatagtgatagtgattttttttctttgattttaaattatttctgctttggtgttttctgtttgttggacatgttggtttcatacctctgtatagtaaagaggttttaaaactttgacccaaactattttggctcacacttttacttctcatatgggcttttataataatatggagagaggggataagaagttgtctaaagtaaaatcaaaagttgtttgtccatttcctctctcaagtaagaatatatcaagaatatttcagtctagccattttgtagcttgagattagagaaggaaagtttacattcacatgttaccttcatctgcctttcttgtctttgacctgttacaacagaaattaggcagttttttttttcccctcacatattcattctctgcttctctcaagttaatgaaacctagatagagggcccaattgccacttgctgaaagaacaaatttctgaagttctcttgtagcaagttactaccttgtgactaaattctggtcagttagatgtcagtagaagtatttggtatttcccagaagtctatttaaaggaagagctttaccattctttatcattttttccagctgccaacttagatcatgaggataggggctatacttgtaaggatggtagaatggagagctggaaagaccctgtatatttatgtcatggtagagcagctctggagtattatcagattattttatgtgagagagaaataaacttctgttttgtttatgccatagttattttggattttcttattatgcattgctgaacccacgatccttcacacctccatctaaggcatcttcccttctgcttcctgttctgtggttgaactcttggtgctgtttcatctctccactgctaagtccctgaattctcttgctctccacattttctataatgattgttcacaggcacagtgttgcagttagaagctgctatgcattgctagttatgtagcacctgaaattttaattttttaaaaagaaactttaacaggaatatgaaggaatgtgtaagcacagttacacatattttatttcctaatgaaaaatataatttctaaagaacgatgtgtccattaagtctcccctgccctccaattttagttgatacagattggtttggctaattggctgccagcagttcctctagagaatatgtctagatcactaacagacccctttttacttgcctcttttggaaaactcatcctatccctaccctagtaacatgatccaaatggaagcttgttactgtcacagttattggttcaaggatggatatgtaagcaaaaataccagctctgtcctgggtttttagaactgcatctagcagaaaggagatcctctctacttttgaggctataaggatgtggacaaactggtttaggaggatcatagtaataatactcagaacagaagtagagatggagggaaacaagtcagtcttcctcagagaatggacatgtacctcatataggctaattagaatattttgtttagtaacttgataatttcaagtcagactctgttgggcacttgaactggagggtcatgtgaaggacagaagtttctttaaagccatactcctaaatgtaaataaatatatttaaaaaattttaaagggtgatagaaactatttcctttcttactttgaagggggttcctagctggtacataattcatactgtctcagttattcaaacaaattactcatttaataaagcgtttcatggagaggaaaagaaactacaagttttttctctatggatgtggagtacttttaaaggaaaataaatgctcccttaaacaccaatagcaacaataaaatatgcacaaaagcctcctagtgttgagaaaccatcacgtaagtgctgagcactctagttctgctcgtggatctctttacaaatagaaaattatcttatctcttatgtttgttaaagcattatttgccatagctaagatatagaatcaacctaagtgttcatcaacacatgaatggataaagaaaatgtgtgtgtgtgtgtgtatatatatatatatatatatatatatatatatatatgtacacacacacagtggaatactgttcagcttttcaggagaaggaagtcttgatatttataagaacatggaagaacttggaggacattatgctaagtgaaataagccagacacagaaagacaaatactgcgtggtctcacttatatgtagaatctaacaaagttagactcatagaagcagagaatataatggtgattaccaggagctgtcagctggggagaaatggggagatgtggttaaagtgtacaaagtttcaggtatttagaggaataaattctggagatccagtgtacagcatggttgactgtagttaataataaagtgttgtatacttgaaaattgcttagaaagtagttttttttttttttaaattgaaatgggatctcactgtgttgcccaggcttatctagaattcctgggcacaagcaatcttcctgcctcagcctacttagtagctgggattacagacatatgccaccatgcccagctagagagtagattttaagtgtccttactattaaaacaaaaaaagcttggatatatgagataataggtatgttaattagcttgatttaatcattccacagcgtacacatatatgaaaacatccagttgtacacaatacatatgtgtaacttctatttgccaattaaaatgaagtttaaacattgtatccatctggagttcctcttgtgggaaaatgacttctttggccacctaaggtctttttttttaaactcttaaatttgagacatctatagttggtataattggtaagtcacaagtattagtgagaattttatttgggtccatgaagaaccaatacaggcaataaaacacaccaagaattagggaaaagctaaagcatagtccaattatctcaattattgtaaatgagaagtacccttcacctaaatgaggctgagtagaaacttccttacctctgcaacaatttataactgtggaattagaatttagattcaagctagcaaaactagagctacattttatactcaaaactatgtctgccacttaaaagaggaaaaaaaagaatgaatataagctggttatattgaagtatattttacacagattttttttagtagttaatttcttatttagataactaggaagggtaagtggaaagatacatatgtttttaaagaggggcaggtaacttttaattttctttgtaactttcagaatttctttccctacttgatatatggagacctactgtagaggatgtttgtggagttagaagagattagggttgttgaaatacagatgtcagtttaattgtaattcatagtattgaaccttagaatagtgaccattttctgttttcacaaattttagaaaagtatacatatatgttgataattattaaaaaatttgaaccaagctttcgttcacagtgagatttgtttagtaggtaaattattttatgtttaaaaatgagtacaggtctgggcatggtagtttacacctttaatcccagcactttgggaggccaaggcaggttgatcacctgaggttgggagttcaagaccagcctggccaccatggtgaaaccccatctctactaaaaacacacacacacaaaaaaaaattagccgggtgtggtggcacatgcctgtaatcccagctacttgggaggctgaagcataagaattgcctgaatccgggaggcagaggttgcagtaagctgagatcgtgccactgtactccagcctggtgacagagtgagattccatctcaaaaaaaaaaaaaaaaaaaaaatcagtttgtatttactcagattttttttttttaattatactttaagttctagggtacatgtgcacaacgcgcaggtttgttacatatgtatacatgtgccatgttggtgtgctacactcattaacttgtcatttacattaggtatatctcctaatgctatccctcctcctcccacaaccccacgacaggccccggtgtgtgatgttccccaccctgggtccagttgttctcattgttcagttcccacctatgtttactcagatttaatgggattttatctgggttttcaaagggctcccagatttaatctgggttttcagagggctccctagataattcttagatgcatccagattgagaagcatgaatccagagcaaaacagaaacagctaagggtggactttttttttttttttgaggctgagtcttgctctgttgccaggctggagtgcagtggcgcgatctcggctcactgcagtctccaccttccgggttcaagtgattctcctgcctcagcctcctgagtagctgggattacaagcatgtgccaccacacccagccaatttttgtattttgtatttttagtagagacatgtcggccaggatggtctcaatctcctgacctcatgatccgcctgcttcagcctcccaaagtgctgggattacaggagtgagccaccacgcctggccaagggtggacatttgagggcacaaacatttgaggtactgaccatcataaatacatacatacatacatacatacatacagtataggcccgctgtggtggctcgcacctgtaatcccaacacttggggaggccgaggcaggtggattacttgagcttaggagtttaagaccagcctgggcagcatggtgaaattctgtctttaccaaaaatacaaaaaattagctgggcatggtggtacttgcctgtgatcccagctacttgggacgctgagatgagaggattgcttgagcccaggaggcagagtttgcagtgagccaagttgggcctgggtgacagagtgagaccccatctcattaaaaaaaaaaaaaaaattaagaatacagtatagaggggcatcctacaaggaaaccttactcatgcaccataaaagtggtcatcagaaacagggaaatctataaaactgtcacagacaggaggaacttaaaactatgggctttagttaatatatcaatattcattaagtatagaaaatgtaccatactaatataagatgttaataatagggaaaaccggatagaggagtagtatatggaaacttactgtattatcttcagaatgtttctgcaaacctgaaactgttctaaaaaatgaagagttttggggtgggtgtggtggctcacgcctgtaatcccagcactttgggaggctgagatgggtggatcacgaggttaggagatcaagaccatcctggctaacgcggtgaaaccctgtctctactaaaaatacaaaaaattagccgggcatggtggtgctcacctgtggtcccagctacttgggaggctgaggcaggagaatgttgtgaaccctggaggtggagcttgcagtgagccgagactgcgccactgcactccagcctgggcaacagagcgagactccatctcaaaaaaaaaaaaaagagttttgaaaatcaaggctgggtgcagtggctcacacctatgatcccgcactttgggaggctgaggcaggaggattacttgaggccaggagtttgagaccagcctgggcaacatagcaagatcccatctctacagaaaatttaaaaattagctgggtgtggtggtgtgcgcttgtggtcccagctacttgggaaactaaagcaagaagactgcttgagcccaggaggttgaggctgcagtgagtcatgattgtgccactgctctccagcctaggcaacagagcaggacctctaataaaaaaaaaaaaaagacaccccaaaaagtagttgattttcaaaaatcatgagtaatataaactccttgagttcagagtcatttgacttaatattggtatgcttagggtttagcagagttaatacaaaataagctttaaagaagtgctaagtgacaatgttacatttatgttattttgtagaaatggcttttggaaagatgagaagtaacttgacaagctttttaatgttttcaataagtttttactaaaagtttataaaaaattttaatttagtaaaacaaattgaaaatatttgcataaactttctcttattgcttgagaggccactttgaaactcttaatgttgcacatggttctgaaaagacatcaagcttagtttagtttataaaagcatttcattaacagactgggtgctaaatagtaaacatagttctttgacaagtagagttaaatgtaatatttcttttaaaaaactgagtacataaacctatttatccagtaggaaatgcaagtagaaatcacgagataccattacttacctattagaaaagcaaaacaaaaacaaaccaacaaacctagacaatagcaagctgacagagatacagagcaactagaactctcctgccctgcagatggaaatacaaaaaagtatacagctacttcagagaacaatttggtggtttcttataaagttaccatatgagctggcagtcccacttctaagtatttacccaaggaaatgaaacatgttcctgcaaaaaccagtaatgctctgttcataattgcccaaaactggaaacaacccaaatggtaatgtacatatagacaaatattaatgtgtgaatggacaaactatggtacatcatacaatggatgatgtaccaattataaaaaggaatgaactgttgatacgtgtgttgtagcaatttggaggaatctcgaagacattatacttttttaaaaaagctagtctcctgattccatttacatgatattttcaaaaaaataaaactgtagtggtagagaatgtgtactggttatccagtgctatggtttgaatgtttttgtcccctctgaaaattcatgttgaaacttaatcaccaatgcaacagtgttgggaggggggcccaatggaaggtgtatgtattggttcatatgggggagccctcacaaatggattaatgttgttataaaaagggcttgcggccgggcatggtggctcacgcctgtaatcccagcactttgagaggccgaggcgggtggatcatgaggtcaggagttcaagatcaaccaggccaagatggtgaaaccctgtctgtactaaaaatacaaaaaaaattagatgggcgtggtggtgagcgcttgtaatcccagctactcgggaggctgaggcagagaattgcctaaacctgcgaggcagaggatgcagtgagccgagatcacgccactgcactacagcctgggagacagagcgaaactctgtctcataaataaataaaaggataaaaagggcttgctctcttctgcttttctgccaagtgaggatgtaacatttgtctcattttgtcctccacctttcaccatgagtgtttacagccagaaagatcctcaccagatgctggcgccttgatcttggacttaccagcctccagagctgtgagaaacaaatttctgttgtttataaattaccctctctcaggtattctgttatggcagcacaaaatggaccaggggttatggtgggggagggtgtgtgactatggagagacagcatgagggagtttttggggtgatagaactgttctgtatcctgagtatggatatacatgtgttgaaattcatagaactgtatactcctacttcctcccaaaagtctgttttactgtatgctaacttaagaaataaaatggaagacatacaaagaaactgaacatgtgtctactttataaggcatttggtctaactactggtcaaataaacttgtataaatactgtctaatgttttctctattagattttttttacgtctcaaggatttgtatgaaaagtgactgatgcacagaaaacctttattttttattttttaaaaagtagaaacagagtctcactatgttgcccaggctggtttgaactcctaggctcaggtgatccccctgccttggcctcccaaagtgttgggattacaggtgtgagcgactgtgcccagctagaaaacctttcatattaaaataattagcactataatcatgtgcaaagaattgggatggtcacctagtacagcttcacattttaaaataggtaacaactatcatttattgaaataatgctgttcattggttttataacccaagtgatactatatccttagacactgtaatactacgtatatatatatattttgaatttgatacgtcttttaagccttttaatctacagatcccccatctcatctgtctctttttcttacaagttagctattgaaccctgggctgtttgccttgtagagtttcccacagtttgcattctgctgattgcatactaatagtgcagtttaacactttcctctgttctctgtatgccctgtagattttcagctggattcagaggcttgatcctaattaggtgtgatccctttggcaaggcaataggaagtgtgtcatcagaaggcacttggctgtttggatgactctctttgtgacgttagcagccattgatactcactacttagatggattaattcattggaggttgcaaaatagtgatagtgatattctaaattatttctttttaatttattacttagcatacttccatagaatattttcttcatcactgtttggttattaaatagtataattcacaaggaaagccaggataaatacttgattctttatttttatttaccagttttcaagatactgaaattgttacatctaaacctgtgaagatgttttagggcttttttttttttttttttaacatgtttagattttcattcattgcaattaatatgcttaatgaagctcaaattgttgttacatctttgaccagtgggagcctgcccctcaccctctctctctttttttttttgtaaagatagggtctttctctgtttccctttcctttccttacttttcaggcagagttttgctatgttgcccaagctggacttgaactcctgtgctcaagcaatcctccagcctcagcttcctgagtaactgggactacaggcacgtaccaccacacccgactctgctattgtttctttaaataaacattctgcccctttgtctgtctcttctctctcttcagctcttataatctgaaaattttctctatgctatcctataaatgttgtaacctttctttattttcatgtttttcccttctgggtggtgaaatctggtctctactaaaaatacaaaaaattagcagggcatggtggtgcatgcctgtaatcctagctgcttaggaggctgaggcagaagtcgcttgctcctgggaggcagaggttgtagtgagctggatgtcccacactgcactacagcctaggtgacagtgaatgagactctctcaaaaaaaaaaaaaaaacccaaaagaaagtaaattttgtttgagtttgttactaaacttggtgaatataagctgcattttttagtttccagtaaatcaaggcgcagtgtaatcattgtacattttatgttgaagagttataggaaaatacctttattttataataatgaaggaaaaggactttttggattggaaaggaatgttttgacaaaagattaaattaaaagattaaaacaattttttcttctgaaaattttttttcttcaaccagacaagataccattttttcaaatacatacatttttttcaaatggtatcttgtctggttgaattactagaatgtttttggcgtgtttagtagcaagtggtaagttcaattgaaatacaagctgaaaaattctaatggcccctggaagatggcagtataggcttttcatctcagaattttagatctggaggagacctttaaaatttattccagttccttcattataggagaatatctagacatctagggataatgatatgttatttctgagatcacatagtaaatttctgtttagagctgggactagtactaaacctcttcgtttctgtttcgggattagtttctcaatgccagaatgtgtttcttgaaaggcacgataaccagctcctgggctcctcatatcctacctaaattagtgcaactaaggcagtgtgacatatttatattggtatttttataaaggcacagaaacagacatgatttattcagtatcacagggatagtgttaggtcataagacccctgacctgttgattctatctctttatcttacctagtaagagatagcttagagatagtagccaaaatatccaatggttatgaactatagattgggagctggaagtggagctggtactagaaaccataaaaacgccagatgatgtttgtggtatggtgaagagtgctgggatgatgcaggcagggggtgatgaaagctttggtcatgagtaagtgggtctagaacctatagaatgggggggcggaataaaggaggcaatggagccaccatcaaactcatgcttatcaggaggatcgtttgttctgttctcattccctatagcatattgctactttccagctaagatttagaataatcatagacaataataaaataaaatacatctgatatctgcacaatattttaagcacagtactcataaatattgtactatttgatccttgcagtatccttgtgagataagtagaagggatattggtgagtagaaactattaaatataatatgtgttaaggtagtgtgctagaaatcactaagggatataaaggtgaataaccacaggctctgttctcatggtgtgcccaatcttttggggatggggtgggaaaaataaacagttacaatgtataggaagttgaaaaggatttagaaattcaagctgtgtcccatgggaatttagaaagagtgatggtattgtaacaggaattttggtattttgccttcttaattcagactaactgaaaggataatgactgtaaaagcatcttgactgtaatagatactgatacgattttcctttataattttcagattattttttattttaggtgattttacacagctatttatatgaatgaatttatgaattaaggatgacagaaatcacttaaattgttttagtgatttttggcatattagtctggtttgagaaggagggagaaaacaagggaattgattttgtaatgtcaaacagaacttacaaatttaggacagatttacctagaccattatgaataaataaatagatccttttaattggtaagaaactagaccaaatttaatatagttgatttagtactagtttatgttgatgatgtagacaacttcaccaaaggaaggggagtagtgaataaattagttataacttattttactgtaaagtaatgttaattgttagaataattataggaaatatttgcttaccaataaatatgactttgacagtcttacaatgatgaattcgtttttgttgaaatagcagacaaaacagactttttcgttttgttcacttattcctagaatccattttagtctctagtttttgttagtatgtatcacctaccttaactatttttctttttgccaaaacagaaagaatgcggcttccgttgatatactggagtcacttagaatatcaatatcaacactacagagaaaggagaaggaaaggaagcaatataccattgtcagtgtgcttttctcttctgaggctttcatccttcttgtgttttctctcttaacattggcccatagctagaagacattgaggtcctgccttactgcatttttatcttagccatgagcagcataccccatactatatttaggttgataaattttcaatagtaaaattcttcatagtgagcagcctcttctaggctgtcgccacccctgccttaccctatttcactgtggaaagctcactttcttggttgaagcatctccctgtttgaagtccagctttggggaaacctagaatggccttaggaccatcagtgttacaagactcagtagtgcctgagtcatacttagcttttaaaacatgtttatagctttcactttttatgggtaaatagcccttttattatcaacacagtacttttctctttttcttaaaaatgaccaatttcaccactgatagagttaatttttgtcatctgttaaacatgttttcccatgactttgggttcttcttcatttcatatgtgattttgtgtgtatatgtatgcatgtgtgtgtggtttccttttttagaacaagatgtatttctttgaagatgagactcaatgggccatttgctgtttttctttcctcatctagggtaccttcagtttagctcacagttgtctttcttcctaatggtgtgggtaaaaatgactgactctgttcaatattacagattgaaaataaaacctgtgattcctagcctctttattttatacttctttattttaaagtctaacatttttctttctttatgctttcttttttctatcatggagataacttaagatgtttatttagttctataggtattctgtttctcctgaaaacttatacttatcgttttacttctcttcctttattatgttcatgttcagttagtctacagcagatcttgtaacgttcgactgaattctagttccactaacgataagcaagtatagcatttcttcttaagtgaataatttcttccatatatttgatgtggatatgatattatatgctgcactcttggttgtatcttttcaggtatatttctttttctcagagaaatctttcagtttgtatcttttctaaaatggggtttttcttacgttgggtttttattattgctgattactggatattgtttattctttggatgctgttgatattcacctatcatgaaagtaaactttcatggttaatcatttttttctattacgtaatgaagcaggatatttccctgactcctttgtgggactcgcaacaggggtgccttgtttacccagcctaccacccttccaccctattttttttttttttgagagggagtcttccctctgtcggccaggctagagtgcagtggcgctcactgcaagctccgcctcccaggttcacgccattctcctgcctcagcctccctagtagctgggactacaggcgcctgccaccgcaccccgctaattttttgtatttttgttagagacgaggttttgccgtgttagccaggatggtcttgatctcctgacctcgtgatccgcccgcctcagcctcccaaagtgctgggattacaggcatgagccactgcgccttgccccagcccaccactcttaactccttgtggaagggagtgcacaagtgaacgggtgtgggaattggagtgaatgagtactgaaaccagccggctgctttggcgccagagggctcaacctccactcactcagacccactgcgttctgcccctcgcaggagggagtgcgcatatgagtgggtgccggaacggccggatgctttagccacagcaggagtgaactctctgcaggccccacagcagtgtccaggagcgggtgcctgcgactattgaagctccagagggtgtgttacagtgctcttttagctccgctgtccgtggacagcttaagtgctaacaactcagtggaccctttgccttttttttgtgaagtggcagccctctgccagtgaggccaaagggccactgtgaaagccttttgtatccacacttgtggctcctgagctcttgtctggcgcccaggaaaaatgaggttacatgaatgaattgaaagatggtaaatgcaggggattttattggaaatgaaagggactctcagtggaaatggaagctgaaaaggggacagggtgggtaggtaatcttcccctgggaagttcagccatctctggcaagattcttctctgtagtaatgccatcaagctgtccttctgaagtcaagccacctctctccaatatctagccatcgtcttgtctaccagctgagtctggggtttttataggcacaggatgggatggggcaggaccgtgggtgatttaggaaaaggcaacatttgagccagaaaatggagatataagctctcactttgggccatggttacaggctttttggcttgagggtgaggttatgctggggacccaccattttctgcctagaatttctctgtcccccgttcctgtcaataatatgcatttcttaaatatctttagtttctcctatggtaatattttgttttcatatgagttccttctcattcttagatcctatttatgcttctttgctttaggataacttattgacatataagtggtatttattgaatacatctaatttttagaaaatttcagcattcagtgctgtcacaaagttaattaagttcatagtccccctttaaaatacagtgtttccaggtaagatggactaatagggatggtctttccacctaagacaactaaagaatgggacgaaataatgaaaccacagttctcaagacatttgccgtcaagcagcaaaagacattgatccccaagggatgggaaacaaattaggcgagatcatgcggttgctctagctcacacctagagagggtttgtagggatggaacaaagcagtggaacccaggaggagcctagagatttctctgtattgaagaggtagagctagctgggagattggggggccaaggcagctagagttcacaaggtagagtatgagaaaggagaaagctgcaagagacagaaattcacagatctgtagaaattgctttcaataattcaattgactactgatcaatacatgcctgtaaggaaactatgggaagctgcggaagaaccaccaaaaaggaattgagggaataatataataattagagctcacacatggttaggagtagggcctgaatccatcagacaaaaaaacttcataattcaacaggtatgtcaggtagaggacttccaacgttctagtttttatttctagatgttcaacttgggtcttttttgtctgtgtcttaatatacttaacctttcttctggcttttagtacatatggaacagatatataataacttttaatgtcctagtctcctaattctatcaaccctgtcatttctgggttggttttgattgattgatagctttccttctggctctgttttcttgccttagtttttttaacctgctagttaattaattgatgcatatcaggcatgtaaaataagacactgtaaattgtgccctgttgggtgctggacatttttatattcctatattctttttttttttttaagagatggggtcttgctctgttacctgggcagtagtgcagtagcatggtcataggtcatggcagtattaaactcttgggctcaagtgatcctcctgttgcaacttcttgagtagttgggactacaggtgtgtaccaccagccctagtgcctgcagatatttttgaactttttcctggtctgtattgaagttatttgaaagtgttttttaacttttaggtattgcttttaatctttgttaagtgtaaccacttaatttaattttccccactactgaggcaaaacccttctgaatattttatgcttcatgaattatgagacttttccattctggctgttggttacagatgttaaattgaggatcagattgtcctttcatggcttgtttttaagctctattgggatcattatagagtcatctttattctagggcaaatttagccctcctgaggtctgtacctatggcctagagtgtaaagagatgtctctgctgtggctggatggaactcagatgtctccaagctcagtgtcagcccagagttgttcatattatagctcctggaagatgttttttgtctgactttatggaacttcaccctaagcatgtgtagattagtatttagttgatgactcaagtggaccccaatgtacatatctgtagcttttttctgcttaagtttctcctttctggtatatcattctagtaatttttgccacctccactgttccaaactctgttcttttcaagttagcaagactgctgtattctgctttgaatttccctcttggcaatggtgtctagaacatgtctctaggcagaaagccagggtggtcataggccttatctagtttgttttcttgtttcagggaacacagatctacactaattgttgttcactatctggaaactgtcatgtattttgtctggttttgcagttgcttaccatctgagggtaaatctgttaccagttattccataatggctggaagcatacatttcacactattggattattgaggagtttggcaaagacttttgggtgaagttacaggaaagaattacaataaacctttgctgactttagacttgatggctgtttaataattgtatgtttatgggctttgggagtagttgactatgtcttcttcaaatagatgtatgagataatgtaaataataaagcattatacaggctgggcatggtggctcatgtttgcaatcccggcactttgggaggctgaggcacgaggattacttgagcccaggagtttgataccagcctgggcaacatagcgagacccagtctctacaataaagtaaaacaaaataaattttaaaatcttaaaaaaaaagaaaatagttgtgttacctttgtggtgggaggagtttaagttggtgatattgcttttatattagttgtaattgcctaaaattgttttcagtagactttgatgtcattggagaaaaactgcttctcacaattaataatgtcaatcagagaaaaatctcatgttgttgacataagagtaaagcaagtggcagaaacacacatttctatagaatatattgtgtctttgtactgttcttgggtttttgtacttggtgacttgcgcatactacacactcagtgaacatttgatgtgcgaatctttattaaggccatttcacttttcagttaatcatattgattactgtgtgccaaacatgatactggatgagggagaggcagcaacaaatgaagtaggagaagggcccctgatcaaaagactgcatgagatggtgcatgtataaggcagcaaaatactctactgaagattaatggagtatagaatgattatgtcagctctcaggcagggaggtatagaggggctggattttgagaaagttgatggatatgcattgattgataaaggagaaaaaaaatccctgttttttaaaaaaaggaatgttgtattgcagggtgacaactgagaataaacaaattgttctatggaaagaaagcaaaattaaattggtgttagtggaagtttgtgtagaagatagtaagaaactaggttatgtagctaaccgaggtgtcatacaaaatcgaggggaaatacaaaagattttgagctttggtctgaaaagaggtacacttctgaatgccttttatgttaaaagatagacaaagttaaagaattttatattcacaaagcaagttatatgagcgctaacttattgtaagttgaactatgaagcaaattaaaccactgagtgttactgagtttgggtataatttgcaaaatgaaaacccattttttgttgacatttggaaagtgcttacagaataagtcagtgtacaaaataagtgaatttgcatgttatgactggctacataaagaaaagttaaaggtatttaaaaaattatataataatgctaactgaagcttgagtagggctgaatttcatatatttttattttgtttcaggttgctgcttttgctcagaggacatccatgaccctaatggtctttttgttcaagataaagtgattttttgcctttgttgattaactggacaaattcaggttagtgtattttgtggacagcacttccctgttctaattatatgttaatattttgagaaatagataattttgtggttaaagctacatgttatgtaccagtaaagcagaaaggccaagtcagtctaaactctgttgaattgtgtattagttaagaaacattttcttactgcctactatatacaatattcactgcataaattgaaaaaaatttacttccttttaaatagttttgtactttaaattatggggctggataaaacaagttgtggttgaatgcggtacactgaacttttggcatcgttgtgtggcatatttggtgctaaaaataagcaactcatcttaaacatttctgacatttttagtagctggcttttaaaggtattcttgtccagatttcagtcctacattaacatttttatttatttttagtgttcattctattaattttgacaaatatatatcaccacaattaaaacattctctaaaccttccaaatttgctcgtgttgcctatttgtagttaacctctccttatacctcaatccctagcaatcactgatctgctttctatccctgtaatttgccttttccaatgttatttaattggaatcatctaagatgtagtttttaaatcctggctttcacttagaataatatatttgaggtttattcatgttgctgtgtgcatcagtagttgtgtatcagtagtttgtccttttttattgctgagtagtgttccattttatggatataccataattagtttattcatatacctgtttatggatatttaggctgtttttagtttttgatgatcataaaactgctgcaatcatacattaaaaaaatgtgactctatgttctttaaaaaatttggtggggcatggtggctcaaacctgtaatcccagcactttgggaggctgaggcgggtggatcatgaggtcaagagatcaagaccatcctggccaacatgatgaaacctcatctctactaaaaatacaaaaattagttgggtgtggtggttcacgtctgtagtcccagctatttgggaggccgaggtaggagaatcgcttgaacccgggaggcagaggttgcagtgagccgagatcacaccattgcactctagtctggtgacagagtgagactctgtctcaaaaaaaaaaaaaaaatttttttttgcattgatgcatgttaggtgtacatacttatattcagggtacatgtgataatttgatacctttatgtaataaaatcagggtaattggaatatccgttaacttaaatattcattttttctttatgttaagaaaatttgaattattctcttccctagctattttgaaatgtacagtcaactaagtaaggttaactataatcaccctattgatctattgaacaccaggtcttatttcttctaagtgtatgtttgtacccattagtcaacctttcttcatcccctgaccccatgtattttttactaatagaaattactttttgttgttgctactgttaaagcgctgtgatgatttaactattgccttttaggccatggttgcatttcttttttaaaatgttattaaaacataatgagaacacaatttaacagacattgtggctaggggaagaaacttgcaatttatggtcattttgagtatagaaagagaaatgatgtaaaattattagaaaggggatctattggaacttgtggtgttccctgattttggagatactaggtagccttcttgaatatagtggtagtgtagcaagacgagctgcagacaaaacctctcagacaccgagttatagaaggaagggctttattcagctgggagtatcggcaagctactgccttaaaatctcagctccctgagtgcacaatttctgtcccttttaagggctcacaacactaaagatttcacatgaaagggttgtgattgattggagcaagcagggggtacgtgacaggggctgcatgcactggtggtcagagtgaaacagaacagagcagggagtttcacaatacagtgcctgaaatctatgtgtaacatcgggttctaagtcatgagttgatttttaactactaggtttaggccaggcaggcccaggcctggttttgggcctggtgccgggctgcctgtctttgatttcacttccttgttttttttcttaaaacaggtactgaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttaggaggctgaggcaggagaatggcgtgaacccaggaggcagagcttgcagtgagccgagatcctgccactgcactccagcctgggcgacagagcgagactccgtctcaaaaaaaaaaaaaaacaaaaaaaacaggtactgagtgtaaaacaatataaaacaacatgagagggtctctcttccctcagtagaccagaaatatacaggtagattaataacgtcaagcctcatataggtagcttcaaaagtcatctagaaaagtcaagtaaattagaattctatattaaaaacatacttaaagagggtaaaggttgggcatggaaaagtcagtttaaactttcttgaatgaatatgtaggatgaaagtgatagaaactgtctttctgccttggggaaattaatgacctcaaaaagtagcttgaaaccctatttgaatatttataaggaaactgtagttcattatttgttatagaaataaaaaggtcttgagaaagtattatgctctgactcagaaaatgtaggatggtttagactctagcttctaagcctggacattaaaagacttactgcaactttaaattgttttcttgtttctgaacatttttagatgaattatgtaattttcatagtatctctgtagatacgtggcctgctgtattgtgttctcagaaaacatttctttaaaacctttttttcctttcctttcttttcttttctttcttttttttttttttttgagacaagaatctctctgccactcaggctggagtgcagtggctcaatttccgctcactgcaaccttcacttcctgggttcaaacagttctcatgcctcagactcccaaatagctgggattacagatgtgtgtcaccatgcccagctaatttttgtatttttagaagagatggggtttcaccatgttggctaggctggtctcaaacttcttggctcaagcggtctgcccacctcagcctcctgaagtgctgggattatagatgtgaggcactgtgcccggtcagagaacatttcttaaatagacaaaacattttaggcagagtcagagcattttagagctatttctgaaagagaatagttatctgttcaacgggcaaatacaacacagagtcaaagataatgctgtgctcagaagtcatgatttcttcaggattttagggtatttagattttaaaccacaattctaaggtcaatatttatgtaaagtatttatgaaaataaaagccatatttaaatttaaatttaatatgctttaattcacataaaatattttgaggttgttacaaaataaaaaaatttagatttttctagctatatattcaatatcagcatattttttgcatatttgaaaattgagattctgtcttgtaccgtttaaatggtagcctgtttaacttaaaattaactgcaaaagaaataaacaaaaactgagtttttgtaaataatattaaattgagtaatttaacttaatcccacccattaggttaagcaatgatcccaggataaagagagagagagaatgatgagtaaaatgaaccctacactgcaatgtctccagatagctgtatgagtaaaagcttaccatctcagctcttgggtctttattttcttattttaaaaaaaggcgttaaggtccacattaaagtcaggtataattggtaaagtttaaaactgctagtctcttttatttcacgaacactgccaggccttggaaattattgataaaacttgattcactgtgagaaacagtcaaaaaataataaaaaaaatagcattttattttaaagttaaagaataataaaataaaaataaaaacttgcttgagatacttttctagaaatggaacattttacaatgaaaataggatccaaacatataagtatttacttttggatatttgatagataggcttgttataagattgtgactcagctgaagtggttgtagtttatacagatttttgagagaagaaagtacacctttttgctctatatgttttctctggaaacatctcattgtattgtaccaattttgtcttgattctctaagaatctttttagtcttttaggacaaaggaaataggtattgagagacatttctcttcaatccatggatctcttctgtttctgcacattcgctgagcagagtactgatagcttttgttgggggctatctttttcaaagaaatctgtttagcaaacagcctaggaagatagaaatagtgcttccattaggacagatggcacatttctttgctgtccaggataattaagataatccctctagggaaaaaggttgggcatatttgcttgtagctccttttaaagattggagtttcattaagctcaggttttcttgtcctgtaatgcaacccacagtatgtgcacttggttttcctttcattggcctttaggaattagagcttgaggaatcagtaaaaaatatggtactctgtctatgctattgttgtgagtagtaaactgttctttgtttctgatctaggagtgtcataacttctgccaggattatctgatgctagcttaccagctacactactaacacatcctattgataaaacaaagctgagttcattgcttattgtggtaagggagaacacctaaaaaaatctttggtagggtcttagagaggtcaaaatttgagaatttgaagtttgttttaagttggatctttcagtggtggcgatgaggcttgattaggattgggtaggtatcatgataaaacagtttaggtttggtggaaacagtaagattttgaaaactgccgaagagttgatgggtctttccagaaggtctgtaatgaacaatcacattatatttctgctgtctcctagaatagcagttatgctaattaagacagtggactggtaaagtcatgttaatgtacctagaaagctgtgtgtgtgtgtattagttttctagggctgctataacaaagcactgtaaactgggtggcttaatatagcagaaatttattctttcagttttggaggttagcagtctgaaatcaaggtgttggcagggccacactctctccgaaggctctaggtaagaatcctttccttcttcttttagcttatggtggatgccagaaatccttggtatttcttgacttttggtagcataactccaatctctacctcagtattcacatgacatcttccctctgtgtgtgtttgtgttcaaatgtccttcttataaggattccagtcatgtattagggtccatcctaatccagaatgacattatatcaacttgattatatctgcatagaccctatttctagccgttacacattttgggaggacacttatttaactcagtataggggacatgtagtttcagtcttcagtgcccaaactgtatgtaggtacagtgtttgctctcagtgtccatgaaactatggcagactgatgttagcttgcatgtagggtaaaatcttaggttcttcagagttcttgacaacagcatggtatagtagaaagaaaaccagtctggaagtcagagtaccttagttctgctctgttaataactagcttaagaaagttactgtcttctttagctattagtttgttactgatacaccaggagttcagtctaggtcctgctgcttgctgcatagaaagccaatcactgagacaatgagtattgccaaggaagaaggctttaatcaggggcggcagctgagaagatgggagcttggtctcaattccatctccctgactgactaaaaccagggtttatatagcagggaagacatagattttaacaatgtgtaagaaaacaggaacttgggaggaggggcgaggaagcaataatggtgaatgaggggtctggcatctggtagggtgatctggtttcagttctttgatactttttgtgccaaaagaacagtctgtgggactattgggtttgtttcaatttcctcatagataaaatttgaggcctgaggaagagaagagtaaaccaaatgatctttaagacatttctagttctcacattctgaagttttataatgttgagtggctgctacatactgtattaatattagtcttgttggagtcacaaaaagggaatagaaaatgctttaagtgctaatcagataggctctaacttgtgaatgtagcttgcgtaaattaatttgtttatttgggtgaagctaattaatgaagacattaggtaaacatgatgtttgccctgatctctctgacttaccattttgtttttcaacttgaatagtgtatttggaagaagagcattcttcaggtcacttaaagttagaaaaatgctgcactctcaggctgagttcacaaaatgaaataacctttcctgaagtgaatatgagaatgtggttccccttcccccttcattgcccacgtttgtctgtcatgtcattcttgtggtcaagagattttagaaaaattcttactagagaatggtaatagtactgtgaggtggagcatggtgttagaattctaggtgtaagtgaatcatgtgctattgaattttctttgcgttttaaataggtcactgtagtatcgtatttgaattctttgtttgaatcatgttgaaagtatgtaataattactgcacagagatattgtgggcactgaaaaattctttggtactaccaaaaccccctgtggtcatgtatgtgcttgttctttgaagttacaaatgaacaatgactacatattgatgataagtataaatacaggttgaaccaatgtttttagatctggacaaaagttactgaagtaggagaaaggacggatttttattaattccatatggaagaaattcaaaaccatataccagggggagataggattgtctcaccacttaacttaaggatcttcctgtatgtagcccttccatcacacacaaattgtactaagtgttttcatagtggatatttgggcaattcagagactctcactacatgttgtaacaatggtaatgtatttaattaattttagaagatacattagaatatagaattagcagtaacactccagcaatacctgaaataaaatgtgttaaaacagacagaatatagaaattaaatagacataattacaataataaaaagatatacctctatcatatttctattcacatttctattctagtcaattaaaagagtaggagaattttttatctttctttattaatttttttgagacagggcctcactctattgcccaggctggagtgcactggcgcagtcacggctcactgcagccttgacctccttggctcaggtgattctcccacatcagcctcctgagttgctgcgattgcaggtgcacaccaccatgcctggctaattttttgcattttttgtagagatggagttttgccatgttgcccaggctgatcttgaactcctgtgctcaagcagttccccacctcagcctcccaaagtgctgggattacaggagtcagccaccgtgcctggctaatatattttcttagtgttaaagaaaagaatgttaaggagttactcagaaagtaacttgaacttttggtgtgggctgttttgatgattgttgggaagattttctttttttcttcattcctggggccatggtggctgatcatccaagcttggattaaactctgttccttgtacttttccttctcattttaggttttggagtcagtatacttatattaccaagaaaataaggttcctccaacttgtaagaaatattttctagtttcagagaattatgaattggtaaagattgaaaaagatggtatggatgtgtttgaattattcacttttatggtgtatagtcttcactttccatgttgtgttttgttggactcaaagatgcttgagcagttagagagattctccctggctcccccagccacccctgcagccccactggggaaaaaaggaaacaaaggaggaaaaccgtgttgaacacatattttttcttaagcacctatactggattaatgtattactgtgaaagttgtttaattggagtttttttaaaatagatttttatttcttagggcagttttaggtttacagagaaattgtaatttcttacagagagttcccaaatatctcccccttttatcttacaatctgtagtaattgcttattatttccaggagtttgttggtcagtactttgggttttttttttttttttttttttacatagatgatcatgtcatctgcaaatagagagttttatttctttcttctcaatttgtgtaccttttatgtccttttcttgttttactgcattagctaggatgtccagtatgatgttgaataggagtggtaagaagggaagtccttgccttgttcctgatcctacggggaaaggatctggtttcttaccattaggtatggtgtttgctgtaagttttttgtaaattttatttatcaagtggaggaaatcctcctctatttctagtttgctgagaacatgtaattattaactgatgtagaattttatcaaatacttttattgcatctattgatatgatctgattgtatgattttttttttctgtttcctggattacattaattgacttttagatgttgaacctaccttgcatacttggaatatactctacttggtcgtggtgtataatgtgatttgctgagatttttgagaacatttgcctctgtgttcatgaaagatattgttctgtaattttcctttcttgtaaggctgttgcctgggcttatgatcggggtaatgttggcctctgagaatgagttagaagtgctcactctgcttctacagattgtagaatattggtatcatctgttccttaaatatttgatagaattcacgaatgaattatcttgagtgtggtgctttctgttttggaagattattaattatttattcaggttttaaaaattgatttaggcttattcagattatttgtttcttcttgtgtgaattttggtagattgtgtcttttaagggattggtccatttcacctaagttatcaaatttaagggcatagaaccagctttgagtcttgttgattttctttgttttcctgttttcaattttgctctgatttttgttgttttcttctgcttcctttggatttaatttgttcattttctggtttcctaaattaaaagcttagatgattaattttacctttcttcttttttaacatatacattcaatgctaaaaattaatctcttagtcctgctttgctgcatcccacatttatttacttacttacttacttatttatgaaatggggtctcattatgttgcccaggctggtctagagctcctagcctcaagtgatcctcctgccttagcctcccaaagtgctgggattacatgtatgagccactgtgcccggccataaattttggtgttttattttcatgtacacttagtttaaaatattttataatttctcaagactatttttttgatctacgagttatttgtaagtgagctgtttaaacatctccaaatattttgagattttccagctatgtttttgtttaactagtttaattccattgtggtgtgtctatttgtatggtgtctattctttaaaatttgttaaggtatattttgtagtctctctttgtgaaatgttccctgtggatttgagaagagtgtgtatactgctgttgctggatgaagtgttctataaatgtcagttagatctagttgattgatggtgtcatcagttctatgataccttcctgattttctgcttctgtcaattaccgatagagggttgttgaagctccaactataatattgaattcatgtgtttctccttgtagttctatcagtttttattataccttatgtattttgacactctgtagttaggtacatacatataaagatgattatgtcttcttggtgaataataacagattgaccatctgttattaggtaatgcccctctatcactgataatttttcttggccttaagcttgctctttctgaaatttttatagccattccaggtttcttttgattaggtttagcatagcctatctttctccatccctttacttttaatctgtcttcatctttatatttagagtgggatttttgtagacatcatatagtagggtcttgtcgtttgatttgctctcgacagcatgtgtcttttaactggtgtatttagaccacagatgtttaaagtaattattgatatagttggattaatgtctactgtatttataactgttttctactcattgtccttgttctttcttttttcgtctttcactttgtctctgccttcttcattgtaattcagcattttatataattccattttgtctcctgttttaaaatataaattatacttaatttaaaattatcttttaggctgaggatggtggctcatgcctgtaatcccagcactttgggaggccaaggcgggtggatcacctgaggtcaggagttcgagactagcctggccaacatggtgaaaccctgtctctactaaaaatacaaaagttagccaggtgtgctggcgcacgcctgtaatcccagctactcagggggctgaggcaggagaatttcttgaacccaggaggtggaggttgcagtgagccaagatcgcactactgcaccctagtctgggcgacagagcaagactgtctcaaaaaaaaaaagaataaaatgaaattattttttagttgttgccccacagtttgcaataattacacagttaaactgatccaagttcactttttaaataacactttaccacttcatgggtagtgcaaataccttacaacttagtattgtcagttcctttttcccattccttataacattacttttatttgttttacttttccataatttacagtcactaaatatattgttgctattattattttgaacaagttgttatctgttagatgaattaaggatcagaaaaacaaaagatttagttttacctttatttttttcctctacactcttcctttctttttgtaatccatatttctgatctatataattttccttctttctgaataacttctgttaacatttcttgcaagtcatgtttattgggtttcatttctcccagtttttatttcagaaagtctttatttcttcacttttggaggatacttttgctgggattctataggcattctagtttggtattttattttattttttttaacagcccagaggtcttattttattttatttttttgagatggagtctcattctgttactcaggctggagtgcagtggcacgatcttggctcactgcaaccactgcctcccgggttcaagcgattctcctgcctcagcctcctaagtagctgggactacaggtgcgcaccaccacacctggctaattttttgtatttcttttcttttttatttttgagacagagtctcacactgtcgcccgggctggagtgcagtggtgtgatcttggctcactgcaacctccacctcctgggttcaagcgatcctcctgcctcagcctcctgagtagctggaattagaggcgcccatcaccacgcccagctaattttttgtatttttagtagagagggtttcactatgttggccaggctggtctcgaactcctgacctcatggtctgcccgcctcagcctcccaaagtgctgggattacaggtgtgagccaccgtgcccagccagtctagaggtcttttattttttttaacacctgttatgctatgaattcacagggaataggttccagcagctcaggctccttcccactggttctcacaaagtgtgcttctctggatggagcaggctggtgcttcagtagaacccgggtacctttctctttggcttctttctttttccgatcattttcctttacgtgtttcaggaagctattttggctcttagagtgctgaatgtgctcaatacgcacattaattctcttggcaagaatcttgcccttaacttgtttgttgacaagttgtttacaataccaacagcatgctgagtaacgtgtttgtttacaacttgcttacagtgccaacagcatgttgggtaacactgcagactcttccagttttgccatgataacactcgcggagcattcctttttgaatagtacccattcccttgatgtctacaatatcacctttcttatagattcgcatacatgtggccaaaggaacaactccatgtttactaaaaggcctagagaacatatatcgggtgcctctcttctttccctttgtgttcgtccttttggcgaattactggaagatggtggttccggccgaaaggttggatttttttttttttttttttaacactaaatatttcacttcactctttttgcttgcatggtttctgaagagaaagtttgatctaattctttatttctctgtggataagatgttttctgtgtgtgttgatttttttctttacctcttgcttctttcgagatatcttattggtcttaaagttaataaggaaaaaactaaagttttgcttttgatttagttttctctttgtcttattttctgcagcttcactatcatttgcctatgtaaatattttggtatttatcttgcttggtgttctctgaacttccaggtttggtgtttcttactaaagacattctttcctgttacagtgttattgatttgtacactccccttcctcgcctcccctcttcactgttttttccttctctttactcttcctttctttccacaggatctcactctgtcaccctggctggagtgcagtagtggcgtgatcataactcgctgcagtcttgaactcctaggctcaagtgattctccctcctcagcttctcaagtagccaggactacaggtgtgtgccaccatgcctggcgattaaaaaaaaaatcgtagaaacagggtctccaatgttgcccaggccggtcttagaaaaaaggacttagctgggcatggtggtggcatgcacctgtagtcctacctgcttgggaagctgtggcaggaagattgtttgtgcctaggagttcaaggctacagtgcgctgtgaatcaccactgtactccagactgggtaacagtgagaccctgtctcaaaacatatatataaaaaaaaattcctggtgataatttgataattcctggtaaaaatttctgccacatccgagtctgtttccgaggcttgctttgtttcttcagattgtattttttgcctttatagtgcctcataattttttttcatagccagacagaatgtatcaggtaaaaggaactgaggtaaataggcctttagtgtgaggttttatgtttatctgtttagaagtcaggctgtgtttagtgtttgttctggctgtggtatcggaggcaaatgttacgggatctttaaggtgttgcttttctgtctagaaacctctgtggccagtggcgcctttgcccgagttcttgtcctgtgtccaggaagaattatgtatgcagacaagtggagggtgagcaagacaaagagaagctttactgagtgttagaacagctcagaggagagctgcagagggcagcccctctctgtaggcaggttgtctcatccagtgttcagctctcagcagagaggaggccctggagtgagtggctcctctctgcaggcaggtccccattgacttcccagctctcagcagagacgatagctcctctctgcagctagtcatctggctgtctctctggcctctgccctgctctggctgatctcggggcttttatggacctcagtggggaggaagtgtgtcaattggtacatcggtggccatgggtgggctggaaaaggcaccacaagcccccactgcagtctgcgggactggcagcccggtccccaaccttcaggccctccctggcctgaaggtggggtctatctggggacgtgcccccttccacccaggagcctgtctgcttcctgccactttccatggctcccaggctgcttgtgccaaggggcacctgcctgccagcatggagcagctctccacctcagcttcctcagagggggcctaggcggcagggcctgagcatgcgcatatcctgttgggctgtgatgatatccaggcttggctccaaccccactctgagaacctgccacattggagccggtgcgggaagtggcagcgggaacaggcatttccgagcctgcaaaggcaaggggggccttcctgagcccccaagagcacacggaggcctgggtccacaaccctgacttgggtagctgcagctgtatggggttgggggacagggctcctgcctgtttccagtccccaagagcacatggaggcctgggtctaccacccaggcttgggtggcttgggctgctgcctgctcctggctcccactggcactgtggagcatgcagccctggctccgccccctttcagcctgagacaggggctccagatccttgctggacctgggctgggatccggggcaggggtgacatcgccgggagctaccccagttgccctggcgcttcagtggcccaggcagagcagataactgtccggcctggctgttgggagtggcaggctcagcagtcgcctgatgtggggtggaccctggggatgtagccccgggcagccctgcacagagcctcctcctgaggcccaggaacctggcaccctcagtggggtgggcgcagtggctgtgtcactggctggtccctgaagtgggcaccgctcccacttcctgcctcaggcccctgaagctcagcctcagctctgcatcggtctgctctctgcttgactgtgctgcacagagggcggcgggctgttgagggagggggtctgtccgcctctccctgtgccgtccatgtaccagaaagccaccgccatcactattagaggctaaaatttcttctactgtccttgcttttatctgccctgttgtctttgggtttttgtaaagaatccttaaatggggtctgaggcttgcaggtttttaagttgtaatcctgtgttgtacaagagctgtactgatgtggtggtaagggtagagggatgagggggaaagttctatagtcctgtaattagatctcaggactatagaactttccccctcatccctctgccctctaccaactgtgagcctgagttgagtaactgtctctttttctcggtcaaaggatagatggggctggagttgggtatttcccttccctccggttggttaggcactgtaaaaccgtagtaggttaggcaatctaaaagccagttggttaggttctggtaaaatagtttccttttctggaataccttttaagagaaataaagttcctggcgtatttcaaaatggtttttcttcttcccctgctgcaagcaggaggggttttttttcagatctttaccatgagaacctggtagggctcctggaggtaaaactcaggaaagtatggggacccctgtaagactggtccccttacagtttttaactctcaagctagtccacaattactgtttcaagtgttcctactgatgctggcttcagttgagagcttgtattcctggacttctgcttcctgcacactgtgattctctatctgcctgtcttgtctctccaggttttagagcagcagtttgccctctgacctcaattctctgatggctctaagaagagttggattatcagtttttttttttttacccccagctttttttcttgtcgtgaggttgggagtgatgaattacaagctctttacaactgtacttaaggttattttttgaccatttttgatgcttttgtaactagtcaaaagacttattacagtatcctttatctcatttggcagtattgttcattaagaattttatttctttctgacatcaggtctgcacattttggggataatatattctaatttgcaagaaagattaaaaaacttctccagagggaagttgatcataggactgattcttattattgatgaattgactgccttgtcttgttttgtgttgctatgtaggaatacctgaggctaggtaatttataaagagtttgatttaccgcacagttctgcaggctgtacaagaagtatggcaccaggatcggcttgtagtgagggccttaggctacttccactgatagcagaaggcaaagaggtgccagcttgtgcacaaaatgagagaggagaaaagggtgggaggaggggccctggctctttttaacaaccagctcttgggggaacaaatagagtgagacctcaagcatgcctgaggaagagcattaatttattcttgagggttctgacccctccccaccatgcccaacaacatctcccattaggccccacccccaacattgagatcaaatttcaacaggagggacaatcatctaagtgatagcatagactcaggctatttactattctgttttcaagtatagattgagggcaacagcagcctttgttttctatgttgatggccaaaggtttatttttatattcttatactgtaaaaaaaaaaacaactttatttttatagcctttttgggtgtagggtcatgtcaggctttactaattgcacttctgataagtatactgatgatgctgaggatggttattaaagccctatgctgatactttggatttatggaaccaattaatttgatgactcatttacattgaatttcttaattagtagattgcccactaattatttttatgagcacagaataaggtaatgtttattcttattttttttgtgatatggtaaaaaacttagttcatataatgaatttagtgctcaaatatcttagtagaaattgaagtagaaaaagacattgttgtaaattaaatgtaagatataattttattttctttagaaaactttacattgaaaagatcacattatagataatttagacaacttatttataacttttatttattattattattgaatgtaaaagaattacatgcagtcccatgatcttaacataactgtggttaccatgttggtatatgtgccttttagtcctttttcatacacaattttttttacaaagttataataataatttcttttcaaatttgtgccttatttcagttaacagtgtaaatgtttcccatttctaacaatgttttctcattgagtgaggtactgttaggttggtcagactgatagtttattgtacgtattgctgtaatatctttgtacatttagcttttccatgtttgtaccatatctttgggttttcagaagtctgtctctctctctgtttctctttttgtctgtcttttctatctctcaccttcatttggggagcattttgtgttctctttcacaggactaattaagttttattggatcttgaaaaacgggattagaaattttttcttacttatataattagaaaacaatgcttttggacttacattgccacggcagtttacacagttttattcccaaaaattgtagttttgtgactaggtgataaaaatgatctcctatatgtgccaaacttggtattctagacactcatacttaggatgtaaattgactgtagtccaataatttaatatgttgtgtttaattcttgtaatattttactcacaaattgaacttttccttaccaatttaatgtttgtaggcttaatttggcatctttgtcaggattattagacttctctgcattcttctgacttctccctaaactaatgtttagaactgaattgggtccagcaatttaagtggaaaatcagtatgactagagacttctagaaacttctggtgtcactgagatggtgaatttgatgattctgaccctacttgctcatctgtaaaagctattagaggattgttttaagcatttctattctatacaggtatatgtacaccatgtaataccactcagccataaaaaagaatgaaataacatttttgcagcaatttgggtggagctgtaggccattattctaagtgaagtaactcaggaatacaaaactgaataccatatgttctcacaagcgggagctaagtcatgggtacgcaaaggcatacagaatagtaaaatagactttggagactgagacgcggggagaataggaagaagataagggataaaaaacgatatattgggtacaatgtatgctactttggtgatgggtgtagtaaaatctcagacttcaccactatacatttcatccatgtaacccaaaaccacttgtactccaaaagctattgaaataaaaaagatatttaaaaaaaaagaggccaggcaggttggttcacgcctgtaatcccagcactttgggaggctgaggcgggcggatcacttgaggtcaggagttcgggaccagcctgaccaacatggtgaaaacctgtctctactgaaaaaaaaaaaaaaaagccaggcgtgctggctcccacctgtaatcccagctactcatggggctgggcgaatcgcttgaacctgggaggcagaggttgcagtgagccgagattgtgccactgcactctaagagcaaaactctgtctcaaaaataaataaataaataaaaaattaaaaaagatcttctgttgtacctaatcttctagccttattatttcttagagattttataaatccatgtggcttttttactcttgtcatcttcaagttatttgccaagattgaaaaataaccatctttctcctaataccttggtgagcctgagagaagaaaatactacacagttcattttattgtaaaagtagtgaaatttctcaactgatattcatccttcatttttgtggatttgttcagggaagataagatttattgtttatttttattttgctgtattgccaggctggtctggaacttctgagctcaagcagtcctcctgcctcggccttccaaagtgttgggattataggtgtgagccaccgcacctggctggaagacaggatttttttgggaaagtaaatatcacttgagaatatctactagtatggaatctaaagttatgcatacaaggatgatctcatatttctttgtatcttgttcccagtctttcccccaatcttgtctcgctttttcctcaacaagcgtagttaacaactactatgaatttggaatacaaaatgataacgaccctgcctttaggaaactgacaatttagaaggtcaactagaaatataagttaataattacagtacaggaagtcccctgatttcctctataataacatgtctcccaaaatgtgattgaaaataaaaattccacatgtcataggcgtaggaggtatttgggtgtttgtatggagagtcatttcacagagctaaaatttattattataaaatactcaattctagttcctgggcatgttatctcctttggaattagaaatcttagttgctgcataacattaaaagtgtcaggatgatgcctgtaatcccagcacttttgaaggtagaggcagagcattgcttgaggccaggattttgagaccagcctgggcaacatagtgagaccctgtctctaccaaaaaatttaaaaaaattagccaagcatggtggtgtgtgcatgtagtcctaggtacttaggaggctgaggcagaggatcgcttgagctcaggtatttgaggctgcagtgaggctgcagtgaggctgagctctaccatatagagctcaggctctatatggtagagccactgcaatccagcctccgcaacagagtgagaccttgtcttggggggcaaaaagtgtaaggatgggatttctaggcatatttggggctgaggaaatcagtcttgggcccaacctccttgtagggggtgaggtggcaacctctggaatttgaggcctgctactgggattgtaggtataggaagttgagagggaaagggtctttctcaccctgctgtggtagtaagagcttggtgcttaatgggtgccttttacttgtttgatcacctaggatttctgcttagaacccagcaatacttgtaggcctgcacagtcccaagagagaaatcagagacttggtgataagtcaagggtaagagatgagataagagagcacctacactataggatattagaactacaactccaattactccttcactctcatctttttccctctcccagctgccaagtatatgtgactagtgctttgtccagagcaggactggaggatggggtaggaagaattattattttttcatcatagatcaggatagtgtcatgtccccctaaacttcagggaggcctggcttcatacctcttcttccaatttcctagcattgtgcaatgacaaagcttcatgcagtaactcaaaatcattgttaataaggtgatatctaaaagattgaatttgatgttctgaagttagtgtgaggatgtcagtctgttaatgtgtgaaatgttttgagctgtgtgaaactcaattttgcttagtgtgttaagtacaactgaagtaggtgtaaaagtcagtagtagcacacagaaaggagtaatgaattgtgtctagagggtcaggaaaggtctcacaaaggagaggatccttgaattctttgttcaagtggtagagttaaagaagtagatttttttttttttggcgacagggttttgctgtaggtctcccaggctggagtacagtggcgctatcatagctcactgcaatctctaaacttctgggctcaagcatagaaatagatctgatagtggaagtctctgcccagtaatactgagatcttggaaccttactcatttcagaaatggctctggtctgaatacattatatgggactaagctcttctaaatatctttatcccttaattctttatgcataaacttcagcaacttctaagctaccattaggaaattttcactgtaaattatatactggatgattgaatttttagaattagatttattccaaatgtaagtcaacctaaatgtaaagtttttctctacttaaatataagcttttttggcactcttgaagattctgagtatttctgtggacagttatggccatcagggtgtttgtttgaattctggaattgccctagagagcacataagctgtggagtaaagcaggtgtgtggtctgactcctgacttggtcacttaagatctgtgcaaccttgaatagtaacttcgatgctaattttccacatctgtaaaatatggataaaaaatgcagagtctttagcacagttcctggcatgaagtaatggctcaataaatgttaattattactattgttaactaaataagagttccctaggtctctgacttcaaacatatagttgttggagactatgaataccttggggccaccttgagctaagactagatgctcaggagcacctttttgattagtcatttattcattgagcatatatttttgcattgtttaaactttagcaaaatacctaagtcagtcaattctatttttatacagatatttctatatagaggagatttcctataggatgacctgttctgggtgtgtctatctgacctgcagctaatcaagtgactacagctttgctaattttttttttgaaaaaccctaatattgttaaacagtagtacagaggaaataagctgttggtcagcttctaaattctggcacgggttagatttgcctaagagcaaatcatatagcaagagttgatgagagaacttttctcatatcttctagcctgggtaagtttgtctcatttggtgtcaagtcagaggaatctgaactatagaaccaaattgtagggaaagatgactaagggtttgtgatgtctttttttttttttacccccctcaaaggagttctaggtgtaaaaagcatcatggtttaaacgttacgaggcatcagtgaaggcagcagaaaagtcagaaactaatatagccaagtctagattgtatctgttataaactctttaatcagaagattctagcttctagaaccaggtctgtaaaatgttgagagccctctaagtaaactccattatagtcatttaattgatttttctttgtctttcttcttggacatactcttctttaaagagagcgttcccccctctaccccagatagtatctatctttgaggttttgagaacaatagtattcttgttctttaggttctgagttgctgacttgagggaatttgatacacaggagtccccaaggccccccagtggatacctgaaaccatggatagtactgaaccctatatatacaggtcaggcatcccaaatctgaaatccaaaacgttccaaaatctgaaaccgacgtgacactctgaagaaatgctcactggagcattttggatttgtggatttgagatgctcaactggtaagtataacacaaatatccccaataggaaaaactccctattcccattagtttttacttgatattctgaattcttaagtgtgatttttttttctaatttggggatagctcctatttttgtgagagaaattaatgggaaattttgagatggtaactagaaattgtctttgcagtgttaaatttttagttgggaggctactaggctgggtggctctagctgtttaagttcctgtctaagcaaaccaaagcccaacttagaaagtaaaaggaaactagatattttgccaactagaaaccacctaagtaatctctaactagtgtctttccactctgaccaatgagatatgttttctttgtcttccgtgttcagcctataaagcttacagcccacactgctgtgaatgaagctcttcaaaccttttatggttcagagtgctgcctaattgatgaatcattctttgcacagataaactcttttgtctgtttttgctttaaacaacaaaggaacataaattctgttaattgattgtatgaatataacagtgaaaattccctgttaggctttggttatcagtattttaggaatactttttaaaacatcccctttagcttttaatgtgttttggttagacaagatgatgtatgtgtcagtataatgccaggctcacaaaagttgctaactaaatgttagttccttcaatacatacattcattccctgggacatggttccaaaagtagattatcataagaattctgtgagaagctttgaaaaaactacagatgtctatggcatatattaatacatggcgtctatatccatacatgtatgtaaatgtatgcaaacaatttaatctactttttccttaacattaactccttcagatagaatggttggcccaaatgatttaattatttttgaggttgttgattcatagaaacaaatcccctgcagaaaggttgtaccaatttacacggttacctttcttcacattttctctaacactgggtattcttgagcttttagtatttctcagttggtggaaaggatctcttagtttgttgggatctctttgattatgagtgagattcagcattttccataatttactgatgtctgcatttcttcctccctccttccctttcttctttcctttctccttctcctacttccactttctcccgtcctgtcctccctttcccctgctctccctctttcttccccttctatccccctcccctcctgtttttccttctttgcttgtttttgatctctgttcttccacatatgaagattctattttgaccagcaataagttgaattatggggctagaagataaggactaaaaacaagaattggtgtccagaaaggtggggtaattttgattactatgcctgttgcaaacatgagcaagatgttaaatgtatcatagatctgcaaggtttttttaattcatattttttatctattgtctcattaatgttatctttgagaaatggttcttttcagtttgagaatgggggaattggatttaaaattttcttacatgaagaaaccaaatattttgctgctatcctttggaaacttcttactatgattggttctgggtggcattggaatcagtttgaaatgatgccattaatgaccacatgtttggatttcttgactatgggtaaatgtgattagaacagaaatcccttaataatagggattctttatctttgtgtccctagtgcctcatagtatctggccctaattaggagctttagaagtgcttattgactgattgcttttttatctgaatcggccctttctatcccatcattatgataacatccatcttggtagtagtaaaactgttgcaaactgcagaaatgaactgtgattttttttttttttttttttttttttaaagacagggtctcactctgtcacccaggctggagtgcagtggcatgaacatcttaatagctcactgcagcctcaacctccccaggcttaggtgatcctcccacctcagccaccagagtagctggaactacaggtacactccatcatgcccagctaatttttgtattttttgtagagacaggtttcatcatgttgcccaggctggtttcaatctcctgggctcaagggatctgcctaccttggcctcccaaagtattgggattacaggtgtcagccacggtgcctggcacaaataactttttcagacaccacttttgattcttctgggtatgtatccagaagtggaatcactggtatcatactgtaattctattttttttttttaaatggagtctcactcactcaggctggagcgtagtggtactatctcggctcactgcaaccactgccttctgggttcaaatgattctcctacctcagccttccaagtagctgggactacaggcgtgtaccaccacactggctaatttttttttgtatttttagtagagatggggtttcaccatgttggctaggctggtctcgaactgctaacctcaagtgatctgcctgccttggcctcccaaagtgctagaattataggcatgaccatcgttttcagcctctttaattcttttttcaattttttgaggagacatcatactgttttccacagtggctacaccattttacatttccatcagcactgcacagggttctaatttcagcacattcttaccaacacttattttctgctggtttttttttataatcatcatcatcttaatgggtgtgaagtggtatctcattgtggttttgatttgcatttttgaaatgataagtgatgttgagcatcttttcttatgcttactgttcatttgcatattttctttggagaaatacctatttaagtcctttgcccactgttgagtcagattttttgttgttgagttttagggatactttttaaagatgctaatcacgtgaactcctttttaagtgatttataattccgtaacatatacttttttttttctgatcgatttccttatagtttgtattctagtgggttaatggagtgtgatttttttttaaaacagctttgctgaggtgtgattggcataaaaaatactgcacacatctgaaatgaacaatttgattagttttgacatatgtatacatctgtgaatccatactcattacctccacagatttcttcttgcccccttgtaatcttttcccccactactacccatccttccttgtctccaggaaaatcctgaattgcttttggtcactataaatttagtgccttttctaaagtttttttttaaaatggaacttctagtatatacttttgggcaggggctgtccattcctgtgtttatttatcctttgtatattttctttggtaaaatatctgttcaaatattttggccattatttaaattgggttgtttgttttcttattattgagttttgagagcggtttatattcttgatcaaagttgtttataagatacgtgcttcgcagatgtatttttcctggactgttgcttgtcttttctttctcttaatagtgtcttttgaagagcacacattttaaattatgatgaaatttgtttgttctcatatggattgtgtttatctatcagtttgttctcatatggattctatttttgtttatgtatctaagatatatttgcctaatccaagggcatagaagttctctcctggaagttttatggttttgtatttagacctatgatgcattttgagttaatttttttatatgggataaaaattggatagaaattcttttttggggggtagagacatgcagttatttcagcatcatttactgaagtggtttgtgtccttttgatttttgtcaaaaatcatttgactgtatacgcgtgggtttatttctgactcttattttgttccactgacctctttgtctttcttttttttttgtctctcataccagctcagttttaattttaaagtgacaaatgtacaggtggaataaaattttaagcaacaccctccaaattcctcttacatgacaagaagaagctgaatgtaattttgctctataaccaactaaacagtagctcaggatagacataaagccaacttttccaattaagcctttgtgaaaatcaatttctaaatggatcacaactccaggatattgtttctgtgctgtgatttctttgtctttcttgatgccactaccatgctgactattatggctttataagtcatgaaatcgggtcacgttaacccatacaactgcttgttccttttcagagcaattttggctattgtgctggttaccaatctgttgcctctcagctccaaatgcatcctttttgcctgctctgtgaaaatagatcaggccctttaaatatttttcttttgtcagctgacaatgttaagttttgccagtacagagtgctggagaaacactgcagagaagttttgcttgttcgtttctgtgtacttgcttagtggactgtagcaacacactcagcttctccagtgtcaacccacattggctttcccactctacagtttctgtaggatgcatgttttcaccattatcaggcttctgcagtgctcagagggcagcaatacccagcaaccagtgacccgaggccagcaacttcttttacttccccctcagttggatttgtaacagagtatctttggtgggacacttctgtgtgaagagattttactagcaccctaaagaatggatttctggcaagttccacaaggtagacttccagtaagttctgctggtgcagcactacagcaacttccgtgctattcagtgagaggactgtgttctctccaacaaggtctggatctcagccctgggatggtttagggtcggaggaagctcttgccttggtgttctgtgtcagcctagggagcattggctactcttaagagttctctttatttctcattagttaattagctgtttctccaaccccatgttaaatagttagtgatcctttttattaagctttcacttttcaaattactgtgtggcttttctctccggaatggctttacatttccatatgaatttaagaaacagtatgtaaatatttgattggaattgcatcgaatctatagatgaatttgagggacagttgacatcttaacgatatcaagtcttctgactcatgaataaaatgtctccatttatttggatgtttaatttctttcagcagtattttattgttttcaatgtactgatcttacccatattttattaggttgatctttaagtattttatattttttgatgcttttataaatatttaaataacatatcaattttttttttttgagacagagttattggccaagtgtggtcagtaactgtcacccaggctggagtgtggtggcatgatatcagctcactgcaaccttcaccttctggtttcaagtgattcttctgactcagcctcctgagtagctgagattgctcagctaccacacccagctaatttttgtatttttaatagggatgggatttcaccatcttggccaggctggtctcgaactcctgacctcaagtatctgccctcctcggcctcccaaagtgctgggattaaaggcgtgagccaccacacccggccaataacatacaatttttaattgttcattactaatgtataagaatgcaattgatttttgtatagtggcattgtatcctgaaaacctgctgtactcattctggtagctttttttgtagattacattggcttttctgcatagacaaagcatgtcttttgtgaataaagagagctttatttcttccattctaataaaaagacaatccttttatttctttttcttgcctgatttcactggctaaaacctctgatataatgttgaatagaaaaagagcagacatcttagtcttgtttctaatcttagggggaaagcatctattctctcacaattaagtatgatgttgtagatttttcaggatgcactttactgggctgaggaagtttttttccattcctagtttgggtaaagtgtaaaagaaaattaggaatggattttgaattttgtcagttttttttaatgtgttgaaatgatcccatgtttgttttttttaaagttttttattagccagacatggtggcacacacctgtagtcccagttactcgggaggctgaggtgcaaagattgcttgaacttgggtggtagaggcttcagggagccaagatcatgccactgcactccagcctgggtgacagggtgaggccctgtctcaaaaaaataaaaaaatttgttaatatggtggattacattgcttgatttttaaaggttaatccaactgtatgtttctgaaataagcccacttggttatgatgtatatttggcttcttgatgttgccccacagttcactgatgctctttatattctttttgtgttcttttctctttttgtgttgtatttttggatcgtctttattggtatttttccaagttcatggatttttttcttctacggtgtctaatctgttaattctatgtagttttttatgttagatattatagttttcatctttagagttttgatttagatcttttttatatcttccatgtctcttaatgttttggctatatgaaatgcatttagaataacttttagactaggcgtggtggctcatgcctgtaattccagcactttgggagtctgaggtgggagaattgcttgagcccaggtattcaggactaccctggccaacatagtaatacttcgtctctattaaaaaaaaaaataataatttttaatgtccttgtttgctaacatctgggttggtttcagtcaattgattgctttattcatgttttcatgcctctttgcatatctggtaatcttcagctgacagacattgtgaattttaccttttttgagtgttagatattcttttattattagaaatactgttgaattttgttccggatatgtagttatttagagataatttgaggcttgcttttatgatttttttaagaggcctggagcaatgctcaatccagggctagttattcctcactactgaggcaagaccttcttaagcactccactcaatgtcctctgtgaattaagagctttaccagtttggctggtagtaacaggcaatattcctaagtctgcatgattatccatcactattctctcaaattctttcagatgtttttttccccagcctccagtagttgtctcacactttgagctaatcagtactgtgctgaatatttgagaggccctgctgcagatttctgggttttgttctctgcgtagccaccctgctactttcccggggctagctacctttgtcttcatggactctaagctcttctgtttcatcaactcaagttagtttatccacgcacctagctccccttggatttctttctcttccctgggccttagcctgaaaagtctccaaaggttgtaagctgggacaattgaagggtattgcttgtttcctgtctctctagaatcgctgttctttgttgcttaatgtccagtttcttgaaaaatgttgttttctatattatgtccgtttttcttttaagtgagaggacaaacctggttgttactgcatcctgacctccatatatagcatatttttaaccccattattttccattttttaaaactttttttcccattattttctgtagtaaaaataattctggtttgaaaattacaatttctttatgttttagcactagctaatgcaagtatctattatatacaaattgtattggcaattttctttctaaaaaatccccccaattattctgcatatataataatacctacgttttaaaaggtatttttttccaatattattttcagttggttaaaataaactacagtacatactagtggagtctgattgaactgatgtgaagaatacagaaaaatacttagaaatgtttagagaacgcattgtgatgaaatctgttaggagtacaattgttttaactgtaaagcttggcattactggatgggagacagctatagaatacttaagccttattggtgaacatataggaagaggtggaaataagagatgaattacatgaagaagtctttaagtcatggaggcttactgaaatattgaaaaaagcaaataagtagacctaacaagatagagggggctcagaagaatgcatttgtttcttatagatggtagctggagctagggcagtgtagcttatggctttgcttgaatagaaagagttgatttgggataattggatttaaatcctctatttaccacttgctaactgggtaagttttttaaactaaatttctgattttgcatgtgtaaaatgaggataagcatatttatcccgagggttgtagtgagccttaaatagaatcaattacatagaagtatatagcagtatgtttgtgtgcttaataagtgtttgtctttattattttaaagaaatgaccagagaaagctttacttttctattgcatatttccctagtgattatatggacatagaagcagtgcttacagttaccttggaacccatcaaggaaaaatgaagcaaattcctgccctgttgcccttctggaacattacatagtttagatgaaaatcagccagagcacagttagactctattagcataagattatgttagaaaatagtgggcatgataaggccctgaaggagagttctaacttggagaaggatggtggaatttttttatagggctttgacagtaggggtcaggcaaagttcagtttgaggagtagttagtcaaggatagctctcagaggaggggagaattgatcatgtacattagcaattattgggcaatttgaattttattaagaatgttggggctgggcatggtggctcacgcctgtaatcccagcactttgggaggccaggcaggcagatcacttgagatcaggagttcgagatcagcctggccaacatggtgagaccccgtctctactaaaaatacaaaaattagccaggtgaggtggtgggtgcctgtaatccaagctactcgggaggctgaggcaggagaatcacttgaacccgggaggcagaggttgcagtgagcagagattgtgccactgcacactccagcatgagcagcagagtgagactccgtctcaaaaaaaaaaaaaaaaaaaaactcagtttttagtgtcttcacagtagatttttttgtcattggctcttgcggcctttcttcttgtctcccccagttccagccccccaaaatagaagggcccattatcttgctcatgattttagattcccagctcttgattttggaaggcgctgtctttgtgaaatttcagagatcaaggagttagtgttttgtggtgtgggaaatttctctcagtctttgctccttgcattctttgtgcagttttttctttgtttatttcagagacagggtcttgctctgttgcccaggctggagtacagtggtgtgatcataactcactgcagccttgaatttctgagctcaagtgatcttcctgtctaagcctcctgagtagctaggactacaagtgtgtgccaccacgtctggctaaaaattttttttagacatgggtcttgctgtgttgcccagactggtctgaaactcctggcctcaagcagtcctcccacctctgcctcccaaagtgctgagattaggggcgtgagctacctcacccagcctgcagtgtgtcttggatcctgttatgtaggtgctctgtagtagaggaaacagtaatatatgataatgaaaagcttcaaagtagacatatggctgaaagggagatttgaatagggttttgcagcagctattttagttgatgacacatcttcaacttaaattgcaattgccttttttcatttcgcttcatccttctgtgatgatcctagtagaagtcaaatgagatcatttttgatagttggtttgcaggcttcggtgtatgcacccaacctttcaaagactgcctgtgcttttcagggagctcagttttgtgactgaaaggatcagctattctcttctacctttttaatgcactactggtttctagcagctgctgcttaacgctgttcattcttgagtttggtgaattgttttctgtgctccatgtgatttctttgtctttatgaggtacattttgactacaggtgagccaatttcctgtgaatataatctatgctttgaaattaaattatctttatcctctttaaatatgtaaatcttcttagtatctgctagtttgcctcttgctttgtggctccttgtgttcctcttgtaatgcttgcttagcttttaatttaaataccagactgtgttggttagcatccatagaagacataggcctattcaggaaagtgtgaatatttggccaccatatttaggattattggggcatttctttccaatttttcagagtacagaaaaagaggtgagtttcctattccttcctaatcaagttcaccatcgaccttgtactttttgaaccaacttgaatagaaaaaaaacaacctgaagaataatatgtttactatttctacatggatatactgactataactatggaaaatatatttgattagttacatgaggctctcatggtaaatgtgtcagatatagtcaatattttagtattgtcatgtagtattaagtatttttccatcaatgattagaaagttatgattttttgttgttcagcaaattatcatgaaaaattcaataatgttgctttttctttttgatagccagaggaagttagagaacagatttatctaacactaaacggtcactggcaagaaccttttctttgtaacatgttactttgttccctaacctcattctcctccacctgtaacaatggtgaatatgaagcaagtgttcagtatcctagctttctctaattttctgggacgtatctcttttagtctccgtatattaaatcttagggaacctgaaaggcttctttattagccttttttatttctccctaaaagtattgatgtttttataggaatctctgctatccagggataaaacataacatgcaattaaaaaaatttcagccattgagaatgtttttataaatggacagatcagttacttaaaaagttctatagatttgtgattaaaaaaatagttccctatttgaataattgtccaggaaattagctgttgatcatatttaaaatataacataaaaatgagtcttaaaatatgtatagcttcatttgtgttgattgatgttgtaactttttttgagtaaaatgcatcattagaaaatgtatttggaattacattaaaaaggtttctatgttttgtttattggtatcacacacgtgtcatgtgggtcatagacttgtttcatagtaaaacagatggcatggcaagggagaagaaacttacatgcaagtttttgcacaaatatcaaagaaattcagtgtactttcttttcaaaaaaacattaaaaactccaaaacccaaggaagaaaaagcttcttgcatttatataacaattcttaatctattagttgcagggcaaaaataataaaatattaattatatagtcaaaaatagcttttaactatgaagaagtcttcctatcaaattcttctgttcattaaacctacttttggttattatttaaatgtaattgggcagttccaagaaaagcttcagaacagctgtaattacagctgcagatttagtcaaaataggggctgtaagaggctgtttactctccttttgcgtctctttcacccccaccccaaataacccaaatttagttgtaaaagtttttggtaagctcaggatttctgaaactggagtctatgtatttaactgcatgcagatgtgatgattacatgtgacttttaaggttcccataaccttttagttcttgtattgctctatgcacagttaagtgatttttgtcagctgtgtctgtattgaattttacagatacacgtatattttaaacacagtttagtgatttttatcaaggcccaggcatctgctcaaactactgagaagggtaatagttttcaatctaaatttgagctaatgttgacattattacaagttgactggaaacatttacaaaagcctgtatctgtgttaaaaaaatatatttcttcaaattttactctactaggaaattgcctttgacttcatctgaaaacaaatttggcaaatgtcttaatttttagagaaagacctactatgataaatcaaaaactaaatacacatctatgtcacatccctccctcctcccagagctttgatctggggagttgatggcattctaaggtctggtttttagttaatcagtcagagattatatataagggttatggaagactgtggcaaaaagcaaggtttagagcctttttccctttccgagttaattaccatttcttttgcagatggcagttatgctgaatattgatcataagatacaataacatatcttggattctcaccacagttttacagtgttacctactcagaatctggttcaaaattgtagtgacttgttgaattgcacatagggaaatttgaagagccttctgctaaagccaacaatttaacacttttagttagaagaccaagtgaaacttgcctgtatttgcattggaccatattaaaactggtaagggtataaaattatataggacatggttcttacctcaaagtacagtgggtagacaaggtgcaaatatatgcattaaaataatacatcaatgattagggtaaataaacttacttttaaatccccagactcaacaactctttaaatcttgaattctaaagatcgagaccaactttcttacagatgaggaaacatattcagagaagtgcagtgaattgtcattaatcaaagggggtttataggtcattctaaatatgagctcagtaatgacaataggtagcaagttaactttgctttttaaatcttgaatgtcagctaatgttgactgattgcttgtttcaagtatttttacagagaaacttctggtccttttctcatgtgagtccagtgggaatatcagcagcatggggacaataggttattttcagactggataaaattgaacagaagccatttcagagaatactggagaactgaaaagaataataaaacacattcattaaggcaaaataagggaactatatttataaaatcacataatttttaaagcacgaattgatttataggtatgaggaaaggtagcaggtaaaatgtgatatggaatataattttgatgattaagtataacttaataattatgtgaggaaaaaggaattaacagaaaatcttttaggaaggtaaatagaactttgagactttagtaagataggaaaagtgaaatgtgaaaaacaagttaattttatatagggaggctatagatttaactcattgttaaaaacttgtcatcatcacaatctttttgtgccttcttccttaccccactggttctctcttaagagaagctctggtgtcatgtgttgtgatgtaatatagtgctgtaaagttctgattttgtcacttacaaccagcctggtcttggaataaaattttgcttatgaagacattaaaaaaatgaataattttgaattagttacttggacttgtgagcttcagttacttagcaaaaaatgagattatgtcttcaatgtgcctaattatacaattgttgggacaatcaagtgaaatcacatgaaagtgttttaaaaaccaaaggtaagtaatatttttttcatattaaaactgtagattcaatccaacatgacagatatttataagcatgttaaatcaagtttagccgaaagctgccttcttacttcagtttagcctaaaggtttttgagctataacaagtggaggcatattgtgagctataacaagtggaggcagaaacagactgtagccacacttgtgccagtcactaagttttggccaatcaaatgtagtcaactgttcaaactgtgttcaaataaggcaaacaccaacctgtaaccagtccagctgtttttgtacgtcacttcctttttctgtatgtcacttcctttttctgtacatcactttcctttttctgtccttaaatcttccaccatgtggctgtgctggagtctcagcgcctactctggcttaggagcgtgcctgatttgcagattgttcattgttcagttaaactcctttaaatttaattctgctgaagtttttcttttatcaagtacctaatatgtcagacgcagtgttgtagactttagatttcaggagaaggaagagaaaggaaataaaacataatgtaaatgtctataatatatgacagaatatgaaaagggtaataagagattcagcttacctatattttggcttaggcaaagagttacccacctgaatctgctctaagtccatgaggcttgtttaccacaagtggcaaagtaggaattttgaccatttcgtgtctctgtctctccctccccacctgcttcccttctctcctcccctttatctccccactccctctctgtctccccatctctctccctgccataaggtgaaagtttaaacttgggctctccaatagttgcagataggagcttgttgatttttttgtgtacaagcgtgaatcagtggccaagtcaaagtgccataaggaatgtacaatttttagactttggtgagtattgccaatgatatagcgtctagattttaatatctgcattgtatacctttccagggcatagaggattaaagggggactttagaaacaactatttcagtcatctgtgaagatactttttacagaatcccagacttagcttgacggctttttatagtgaggaatctttctatcatgtaatgcagaccactttattatgggctccagtatttggagttcttagtcccaaatgaccaccttctccctctgttattctgtattcttttcattttgttagatatattttggcttgactgaagagagaacctgttgatggggaagctaggaatagaaagagaagggataggttcaggaagcttgacaaaaaaggaaataatggtagtaataatggttaataattcttagcactgaagtctcaggtactgtgctaaatgcttttcttatattataacctatagaattgatgttttaatattaaatattaattaaatgaaagattagtttgatagtaaataatagtatttaccctctgttacagaaaagaaactgagctacaataatttgcccagcaaaaggtagagttcttgctgggctattgattctagagaccaaacctttaacattgccatgtattgtctcttagggataaccttggaggcctctttgggaaaaattttctccttttttttttctaagtatgatagtgtttggaaataaaagattaacatttcaaggctggtaatttgggtggaagtggggaggaggtgaataaaatttattcaatattttaaggttagatgaagagataaggaaaggaaggaacctggaagcagatgagtgaatgtaatatgctttgttagtcagggagaaaggaaattttggtttagctgttgtaatgactacattttataatactatataaacatgcaagtttgatctttgtatagtttagtaaaagctatggtcattagtttatagtccagtgctgtccaatagaaatgtagagtgaaccacacatgtaattttttaactttttgttagctacatttaaaaagcaaaaagaagcagttaaaattggtttcagttatttaacgtaatgtattcaaaatatttcaacaactaatcaatataaaaatatcaattagagttttacattcttttattcatattaagtctttgaaatccatgtgtattttacacttatagcacatctcagttcaaactaaccacatttcatatggctacatttggctactgaataccttaccagacagtgcatttacatactattagaagagaaaaggtttattgtagttgctatgttcataaaaagtttctgattgaattacaagtagatggcttattctgcctctgtatgtaacaaacaaggagtgaagaggaatctggggctgcaaagcatcgctctccagttgtatccagagaatctactcaggaggggcaacgtatttttttattttttattttttaaattttactttaagttctgggatacatgtgcagaatgtgcaggttcgttgcataagtatacatgtgccatggtggtttgctgcacctatcaacccatcatctaggttttaagccccgcatgcattaggtatttgtctgaggaatgaaactataaacatattaaatcctataaaaagaaaaaaaagtaaggttctgaagggttccagaattcaggagacggaagagaaaggatattttttatacttaaggaagtggggaggaaggtttaccaaatgtttaggtttctgctgattgaggctttgttgtatagttagaaggacttccaagagactccagaatttctgctatcgtagttctgggctctggttttacctaaaaactcaatgctttttctctagatagagctctggaggagaggcacacagttcttacttagtgtgaaacatggtgtttgttggtttagggactttgtacctctttctggaacctttcagaacctttttttttctttttataggatttaatatgtttatagtttcattcctcaggcaggaattactgaagtttgcttttcccttaaaaaaaaaaaaaacccagtaaattaaataatcacatttaaaaaactatagcaaatcttttctaactatgaaagttaaaaaaagtcatgtattctttgtgaaaagttaggtaattgagatacctgtttttacatattaaatgaacaggtctcaagcagagttttcactttggctgctgcttcttgcactggggttccttgggcaggagcactctggtgaatcatcacctctggtttggatgtagtagtactggatattttgtttcttttaaggagagtgtgaacaaatgggagttatgtgttcctccggggtatggtccatttgtatattgctctttatctgtgtatcatattttatttggctaagagcctaattataatatatttaatttttaaaaatcttagctatttgtagggtttaaaaaactaaacaacagcaataggatttgtattgctaattgagagataccaggttaaaatacaagttttctatataatttagcagaataaaacacacttatcatttttccattttctgaatttgtaatatgctaatgttatcagtatataatattttttgctatgactaattgtgttatatttgttgtgaatgtagtcttggttcaagtaggggtaaggaggtattttggaaaccagtgcttaccattttggggataggtggtgggaatagacaagctagaaatacacttggaaggaagaaaaccatttagtaggaacttgagatgaggggagaaacagacatttttaggaaagtgtagtgttttaaaaaataaatttagacacaaaaaattaatcattaggaacataatcagattttagaaaaatttaagtagaaaaaaatcacgttaaatagataactttgaagtaaatactaattatgtttatattttgaggggaggaaataagtctcttagttggcccccttgaggctgcctagatgtggagaaccataagactgagtttgtaccatctttgagttaaaaagctaaccctgagtgattttggaatagattcctttaacatattttcagtcatattccttttagaattattattacatagatttcctaatttgtaattctcaagtgctgtgaaacattaaacatttttagcaacctcaacccatcatagtcctatgactgcccttctttcacttttagtcatataggaacatttataagagtatctgatatggttagactttgtctcctcacccaaatctcatcttgaattgtaatccccataatccccacgtgtcaagggagagacctggtgggaggtgactggatcatgggggtcgttcccccatgctgttctcatgttagtgagttctcatgagatctgatggttttatacgtgtctgacagttcctccttcacccactcgctctctcttgcctgccgccatgtaagacatgcctcttccccttctgccatgattgtaagtttcctgaggcctccccagccatgcagaactgtgagtcaattaaacctcttttctttataaattacccaattttgggcagttcttcatagcagtgtgagaatggactctggccatgattttcttggtatgactcaggaaaattcttctatggggtatggctgtggagtggttttgtgcttgctgttgttgccgtggtgcttcagaaagttagcctagattaaagagttcaggttttggagtcacatgggttgtcttgaattctgtctctgacccttaactacccctgtgacattgggcaagttactagacctcagtttcctcaactgcaaattggaaataatagcaaccacctcctagggttgtgatgaagtttaaggataaatgctgctctttttattgagcatttatttattccagccagacactgtgttacatacttcatatgcagtatataatttaatttgtatgtgtatattagagtatgtaaaagttcatttccaacggtaatatatgtccagtaaccggttgctattactttttctatatgttgattccttaatcagaagttgatgttcctaagatgaaagatgggaatgggcattttgatcagatctgaaggacttgtttggaagttgacagtggtttgaaggtgaaatatttactagagtgtggttcaaggataatctgcatggtaattaccttggaagcttgttaaaatgtagagttttgtgtttgtcatctgaaactctgagtctgaatcaggatctctggccgtggagcccagaccctgcagttttataagcttaatcataattcttattctctatgaagtttttgaatcatctttttaatttattcttcccgatgattaaaaaatgattctaatgatttttaaatatttttatttgatgtaatgagctttccattttattggtaatggaggtggtaaattttttccatttaaatgtttacatatatgtgatttttgtatgttataagagtttaatgggtggtgacattcattcagctaatgtttagtaaatattaaaatattaaaatttataaaatacaatttacttatttggagtattttaaaatgaatatatcattttattcagttattcaaacaaaatgattgttgagactatgagtaaaatagtctcaatttactataaaatatgtcatattttactcagtttatagtctccgaatagggtgggaaaggagagcagattgagaatgtgctgttatgaagctaggtggagaggggaagggagcgattttctgctgctaactagaagaaaagcataactacaaataatttatataactaataagatttcaaagcagatagaaattttcagggagttttggtcagagtcattttattagtcatattatttaatgaaagaataatcaggaatgctcagcctctgtgttttctactattgctttgctccctaagaacgctcttttagattttatctgtctattcttttgagttttatctttgccttcctgggaagtctcactcgactttttaggaaatcaagttgtatccccacagtgcttcacatgaccttattttttttagattcttcaagtaaaatcttactcaaaggaaccaataaattgcctcacgtcataattttaaacttaagtgtttggaagactaatttcagtgagtctttgcattggtatctttagcccacaaatctttttggctccagtatccactttaataattcttatgggttaagtaactgtatttttaatatctgtagttttgttcattatcagaaactaggtcaccagggtttgttgtgtcattgttaattaaaaaggtattgtatgctttttttttggaatgtgcttgtactgaatgaagccaaaatatgttagtaatgctctgctttaaatactcatagaatataattttgcatattttaaactcaatctatctgccagtacaacaatgttatttatctctgagaattttgactattctttcatgctatttagaattcaatgaattgttaaaacttctagtaggctttttactgacagtctctgtctgacttctcctttacaagttttcctcaatattttcagaagtaacatttgggtcttactgaaataggaatttttggttctatagtagcagatggaaacagtagacttttttagaggttggaagcagtgggatacagagaaggagaaaaatcagactaaatttatgtcatgcctctttcattgtgaaaaataattatagcctcatgtacattacttttctgagggttgtagtggtggtaatggttgtggaagtagtaatagttgtagggatgaattaaggaggcattgggtaagaacgtgtctcccaacataggatttcagttacttcccaaatataaataacagtggttattaccaaaaatttttcttcaagcgacagtgatctcactgtatgttgcccaggctggcctgaaactcctaggctcaagtgattctcctgcctcaacctcccaagttgctgggactacagacacacacacacaccaccatacctggctgaatttttttttaaccagagaagagcacactaattttttctttacccttatagcattttcattaccagttattatactttcattctgaatgatttcagaatgtttggggatggtgttgataaactagaattattttgtggttaagtagaggccctcaaacagagtacagctcaagtctcaggtttaccacttttttttttaagtagtacatggggcaaattatttaatatcttattttgccataactaattattaataaatatctactttataggtgtgttgatgattaaatcaatttgtaaagaataatgggctgggtgcagtggcttgtgcctgtaatcccaacactttgggaggccgaggtgggaggattacttgagcctaggagttcgagataattctgagcaacaagcgaggcctcatatgtataaaaaatgaaaaacttaggctggtgcggtggtgtgtgcctgtagtctcagctacatgggaggctgaggcaggaggattgcttgagtccatcgaggtctatccaggctgcagtgatctgtgattgtaccattgcactccagcctgagcaacacagcaagaccctgtctcaaaaaaaaaaaaaaaatgccagcaaatagtatgtgttgaatatttagttataagtattattcactctctaaaatagtcttcttagtaaactctaattgaccttagggtaaaaaaatttttatatttaaaagctcagaaaaattcagcttagttatttttaggctggtgtttggtctcacatacacacttaacgcccctttcaaactgttatggaacaatgtttttcaaactttaatgtgcatatgggattgtgtagggatcataataacatgtagattcttattcagtagttttggaataggatgagatgttacctttccaacaagctcctgttggtaatctggatgtagctcattcttataacacactttgagtagcacagttatgcagtgttccattaagtggttctcattcctgctttcagtatattataaacacttagatattttttgttctttatgccttggctctgtgtcataccagttaaattagagctttgcctttggggttctgggcatcatcgtcgtcatcattgtcgtcatcatcatcatcattttttctttcggtaaaaatatcctggatcattctcttgtgaaactagcattaagagccaccactttagttatctgaaggagagtcataagctaagaagctacattttaggtcttctcttactttgttgtcttccattttaagctcatttcctctgtagagatgatggtggacagctggttagaactcttaaactggaaggcagttaatatgttggcctgaagttttcttttcgctagactaaaaggtttgactgttgaacctttctttatggatcctatttcctatcccttttcatcatttgtatagtcttctttggactttccctaatttctcaatagtctccttaaagtgtaataacccaaactagatacaaaactgctgtaacaaaactgaacaatggcagaggcagaagaatatagatctaaaaatctgtggttttcattagcgttgaaaacttgtatttgcttcagactttttattggccttttctttatgtttttcagggttaaaatgtgttttatgccatgatatttgtttcaatatattcctttcttaggttatgcttcttctttcttcctcaactgtgcttcttgtatccatttcccatcttgcacctattttggaggagaggcagtaaatattttcttatggacttaccatgtttgggaagaccgttttccaaagcgatcaagatcatgttaaattttattccatctagccatgatggctcagttaggatcaggtcaggaaaacagtccacactaaatactcgaggcaggaggatttcttgagaccaggagtttgagaccagcctgggtaacatagtaagacctgtctctacagaattacaaacaaaaacaaaaaatttcagcccagaaaatttaatacagggaagggattatacaggtattggagggctgaaaaagcaaacagggaacactggggtaacacagagacaatatttgcaggaattagccactattcatatggttgagggggaaataagaacttggagttgggacctcatagaattggggttcaaaacctctggagggggtacttcctgacagctgttggtatgtctgaggggaatttctgagagtgccagaaaaagctggtggttatcactgctactgctggggtggaggatctatgctgggcaatgctgactggaaaaagcatgtactgcattctccctctagtgtccttattggcagtgtgaggaagctagctgcagaagagaaaagtagttttcagagttttattttcagtattacaaagatgagtattaaagggtagatttggatctgagagaaaatagctgaataaccagtatatatagccttctcttctggtcaaaggaggccataggcctttggtctcttggtctcttttcctagctacttggaccccagacccagatattcttaatgctgagggtttggaaggaaagttgttattattatttaaaaaattaatttgtttagttaatgtgatgggggagggggcatgagacgggtctacttttcttttctttcttttttttttttgagacagtgtcttgctctgatgcccaggctggaatatagtggtgtaatcttggctctctgtagtcccgagctcccaaactcaagcagtcctctcacctcagccacccaagtagctgggactacaggcacctgccaccacacccagctaatttttgtattttttgtagagacgaggttttgctatgttggccaggctggtctcgaactcctggcctcgagtgattcacccatgttggcctccaagtggtctgggattacaggtgtgagccaccatgcctggctgggtccacttatttattgttatttttttttttgagacagaatctcactctgtcactcaggctggggtgcagtggtgggatctcagctcactgcaatctccaccccccaggttcaagtgattctcctgcctcagcctcccgagtagctgggattataggcacccaccaccatgcctggctaatttttgtctttttagtagagacagggtttcaccatgttgcccaggctggtctcgaactccagacctcaagtgatctgtccgccttaggctcccatagtgctgggattacaggtgtgagccaccgtgcccggcccgggtccacttattctgagataattctgttacagctttttttggtaacttacatttaatcattagatactccttctttgcctcttgaggtatttctgttttttaaaagcccttatttaaaatgtaaaataaataatggtaaaagtaatgatgttacccataaacaaagttttaaaattggttgcttattagccaaacagtggtctgcagtggtaaccaacctctgaaaagattatgccttttttactcattcaaaaattccccctcctgcagagcttcttcaattttaatgtgtatatgaatcagttgaggatcttggtaaaatactgattctgattcaatatgtccctgggtaaggcctgagattgtgcatttctaacaagctcccaggggaggctggagctactggtccctagaccagacttttttaactcccttccctcccttgagaactactggtttggcttagatccagtgttggacttggatggttgagtggtgagtgatcataaagtaagagtttctattgtaagcctgcccgtctagaaatattttgagcaattttagtagagctatttatagctgtttctttccaggtaggatcagagaaatatatgcttctgaataggttaaattttcttccataatataatgctgccctgaatgcagaaatgtgcctatcacttgtaattttcctggaaggcgtgagactgcttggtaattgtgtacatatttaagggaaactgagtaatggaggacagaatagaacaattaacaaattcatgcatcagataacttgctttcattaaagccattgttactcttatttattgattgttcctgatgataggacatctgcagatttcaaaaagtgtgtttagtgtgaatttcatactgatggcatttctctgcttttgacagtttcatatacttaaacttgtcattaaaacacagcatcttgccttgagccaaatgaaactttgaatagagcccaaatttatgaaattgttaatttctctttacatctagattttactttcagtaatttctatctgctaacacaaatagaaaggtaatctttcatttggttgccatccttcaagagcctctctctgcccttccctccctcccttcctggatctttccttttgtctttacagacctagattttgaaaggttctaggttccttttgtctgttgatactatgtgaatgttatccttaagtttttaattcaggctacaactagacagataatgtgtctcacaattagctggggtgagagagttaaaatggaagttaaggattcaggggattcctacagatgggtgaagaaaaaagctcaatgttaggatccttaacaaagcattttgattggcatatggagacctttgcgtgaacacaaatgttcatatttgaatatttatagaagataatctgtcaaaattactgttattttaatttgccaagcttggctgattgccgcagttggatgttagttgaattcaagttgaagagttgtaaatatgttctggtgtgggacatgctttttgtccttgaagctgtttgaatttcttacttctcccacctacacccccttctttaaaactgcgaggcttttttgtattagttgaactttcatgttcttttttaggaaaaaatattaaagtaggatgttaactgtatggattaaaaattttttttaactaaatttgttgacatttggtgatcaggaattgtttaaataattttaactatttgtccaatctttgcttcaaaggacctgttcctggagactcaaatgtagggatatatatcttatttgaatggttttgtgtgggatatgtttcacattaacagcaaagaaaatgtagacttctagataattgatgtttcccctttcttttatctcacttgaacagctaataattttagtgacccagattcaagcaataatacctgtcttcataattgtcatgtggttttgtcagcttcttatattctaggggaaggaagataagacttttttaaatatattgaaataacttggttaataaatactttttttctctttttagaagccaggaacctgttctctttccatagtgtctcctcactcagaaaacgttgtgttctcctgcctcagcctcctgaatagctagggttacaggcgcccgccaccatgcccggctaatttttttttgtatatttagtagagacggggtttcaccttgttggccaggctggtctcaaactcctgacatcaggtgatctgcccgccttggcctcccacagtgctgggattataggtgtgagccactgtgcaggagaatggcttgaacccaggaggcagaggttgcagtgagctgagattgtgccattgcacgccgggctgggcaacaagagtgaaactccgtctcagaaaaagaaagaaagggaaaaaaaccccaacacactgtattaattattgatgcagtatcactattcttactgagactacattattttagctttagagatgatatagtggctttcttaaagttatatgacatttttttgggagcagggctgtattctgtgccccatgtactaagctatcttgtctcatttaactagccactgttatctgaatagttgagttttacatgtgtaaccacttgacctgattagtcttaatttttttcctgatgtttttatttctttatctcttagaaaatgacataattgaatcagttttgttggttattactttagctagaaactatgtcaagtactacatttcagttttttttttttttttttttttttgagacagagtctcgctctgtcacccaggctggagtgcagtggtgcaatctcggctcactgcaagctcctcctcccaggttcacgccattctcctgcctcagcctcccaagtagctgggactacaggtgcccgccaccatgcctggctaattttttgtatttttagtagagacggggtttcaccatgttagccaggatggtctcgatctcatgacctcatgatctgcccgccttagcctcccaaagtgctgggattacaggagtgagctaccgtgcccggcctacatctcagttttatttagactttgttttggagtttcaggaatttgaggtttcaggaatgtattttgtatttagaaaattaagagtggaacttttatagtattttctgtctttcacaatcatccatcttcattctcatttgacttttttttgctatattttttttctagaagattttatataatcttttcctgttactacttttgcccattctttttgtgaccatctccaagtcatttcccttgtatctcaccctcattccttattatcttcctaggaaaacttatttgtccaactctgtagctatcctctggctggataacaaaattattaataattccttaagatgttaccctagctactaattttgtaatagtccaccatgtgttcactgtgtaaagggttcagaggtgactgttgtacctaatgcaccacagatgtggaagtaataataaaatttacatatatgtaaggtgaaaatattgctaatacgttcccttgggtctggccattctgatatgcttgctaagtttggaggcttattttgtaatggttctttcggatttcttaaggtgaattagacattatgtttaccttgaattttaattggtatacttttggttaagtaggttaaaagtcaatggaataaaagttaagccagaaatataaaaagtaataagccatttttcagtgtgatttgaaaaacaatttagctgtatttcttgctataaaaaaagaagtaaagaacactatacagtggactaagattttctaagtaaactaattttgataaaggttaattccatggtgatagcagatgttggggattggcatccatatgtcagatttcacataaaaatttagctttctactgttttttatttccttaggaagaactataaaacttaaatttgtatagaaggtatgataatgctattttaataaacagaatttgttattttgaaaattgggtagtaaggacaaccagtgaattgtactacttattgatttttttaaaaaaatgtatttttaattttcgcgggtacatagtaggtatatgtatttatgggatacatgagatgttttgacacaggcgtgcaatgtgtaaaaatcacatcatggacaatgcagtatccctcccctcaagcatttatcctttgtgttacagacaatccaaatacactcttagttatttaaaaatgtacaattaaattattgattgcggcagcacccctcacacaggggcaccagctgccggggtctgcccatagaccctgacccggccacggatgaataaagtacactgacacacagatattctgttttgccagtccagctgagggtgtctcagctgtttacagactccctggagggttctgtaaacagttgtgaccatgacctcgatcagcaagtgagacttgcatttatgcggtaagattaattaacaaaggcttgagtcaacaccattagaggtaattgacattgtggactttccaagtaaaaagcccttaatcacccatggcacatcaaaggttagtcttaagattatatgagtaaacaagctagctaggtaaactactctgccttcctttattactagtttaatttgtttaaaggtaaagatcaggttgccttcaaccatgtctattactgaagttatgcaaactctcggccttccaagaagatttgtgtctgtctctataactatcttcaatatttttcccaccagcctgattgaaccccagtaattgattatagtcaccctgttgtgctgtcaaatactaggtcttattcattcatcctgtttttttgtacccattaaccatccccacctctccctcatcccaccactacctttcccagcctctagtaaccatccttctttttccatgggttcagttgttttgatttttagatcccacaaataagtgagaacatgagatgcttgtcattctttgcctggcttatttcacttaacgcagtgacctctggttccatccatgttgcacatgacaggatctcattctcttttatggctgaatagtactccactgtgtatatgtaccacattttctttgttcattcgtctgctaatggacacttagcttgctttcaaatcttggctattgtgaacagtgctacagtaaacatgggagtgcagatatctctttgatacactgatttccttttttggggctatatacctagcagtgggattgctagatcatatggtagctaaatttttagtttttttaaggaacgtccaaactcttcttcatagcagttgtactaatttacattcccaccaacagtgtatgagggttctcttttttccacatctttgccagcattgattattgcttgtctttcggataaaagccattttaactggagtaagatgatatctcattgtagttttgatttgcatttctctgatgatcagtgatgttaaacacttttttttttttttttttgagatggagtcttgctctgttggccaggctggagtgcagtagcatgatcttggctcactgcatcctccacttcctagattcaagcaattctcctgcctcagcctcccgagtagctgggactacaggcacacaccgctatgcctggctaattttttgtttttgtattttagtagagacagggtttcaccatgttgccgaggctggtctcaaactcctgagctcaatctgcctgcctcaacctcccaaagtgctaggattacaggcgtgagccactgtgcccggccgaacactttttcatacgtgtgtttgctagttgtatgtctgttttttttttgaaaatgtctgttcagaacttttgcctgtttttaaattggattattaattttttcctgtagagttgtttgagttttttttttttttttttttttttttgagatggagtttcgctcttgttgcctaggctggagtgcaatggcataatctcggctcactacaacctccacctcccgggttcaagcaattctgttgcctcagcctccgaagtagctgggattacaggtgcctgccaccacgcccagctaattttttgtatttttagtagagacggagtttcaccatgttggccaggctggtcttgaactcctgacctcaggtaatccacccgcttccgcctcccaaagtgctgggattacaggcctgagccaccgtgcttggcctagcttcttttatattctggttattaatcctttgtcagatgggtagtttgcaaatattttcttccattctgtgggttgtttgtttgttgcttgtttactttgctgtggagaagctttttaatttgatgtgatcccgtttgtccagttttgctttggttgcctgtgcttgtggggtattacttaagaaatcattgcccagaccgataccctggagagtttccccagtgttttattttagtcatttcatagtttgaggtcttagatttttgtctttaatcaatattttgatttgagttttgtatatggtgagagataggagtctagtttcattcttctgcatatatatatccagtttccaagcaccatttattgaagaaactgtcttttctgccatgtatgtttttggcacctttgtcaaaaatgagttcactgtaggcgtgtggatttttttctgggttctcggttctattgttctgtgtgcctgtttttatgccagtaccatgttgttttgtttattatagctctgtaatataatttgaagtcagttaatgtgattcttctagtttggttctttctgcttaggatggctttggttattctgagtcttttgtggttccctataaattttagggttttttttatatctctgttaagagtgtcattggtattttgatagggattgcattgaatctgtagattgctttgggtagtatggacgttttaacaatattgattcttccaacccataaacatggaatatctttccattttttggtatcctcttcaatttctttcatcaatatagtatagtttctgttacagagatctttcacttctttggttaattcctaggtatgtatttatttatttattttggtggctattgtaaatgggactgctttttaaatttctttttcaatttgttcacatttcacatatagaaatgctacttatttttgtatgttgattttgtatcttgcaactttactgaattagtcagttcttaatagtatcaattctaatagttttttggtggattttttatgtttttccaaatatatgatcatatcatctgcaaacaaggataagttgacttctcctttacaattcggatgccctttatatctttctcttgtctaattgctctagctaggactcccagtactataatgaataatagtggtgaaagtgggcatccttgttatgtttcagatcgtaaaagacaggctttcagtttttccccattcagtgtgatactagttgtgggtcttttttatatggcttttattatgttgatgtgtgtttcttctatactcatgtttttgagggtttttattagaagggatgttgaattttatcagtgttttttcagcattaattgaaatggtcatatggtttttgtccttcatttgttgatacgatatatggtgattgatttgtatatgttgaaccattctggtgtcccagggataaatctcacttggtcatgatgaatgatctttttaatgtgttgttgagttcaatttggtagtatttcgttatggatttttgtatgaatattcatcagggatattggtccttagttttcttcttttgatgtgtctttttatggttttggtactagggtaatactggccttgcaggatgagtttggaagtattccccctcctctatttttcggaatagtttcagtaggattggtattagttcttctttaaatgtttggtagaattcaacagtgtaaccattgggtcatggcttttctttactgtcagacttttaattatggcttcaatttcattatttattattggtctgtttgggttttggatttcttcatgtttcaatcttggtaggttgtatgtgtctaggaatttgtctatttcttctaagttttccaatttattggcatatatttgctagtagtagccactaatgattcttcggatttctgtgatatcggttgtactgtctcctttgttacctctgatttatttggatcttcttttttccttagtctggcttaaggtttgtccgttttaacttttccagcaaccaactttttgattcatcttttgtattttctttatttcaatttcctgtatttctgctctcatctttattatttattttcttctactacttttgagtttgttttcctcttgcttttttagtccttaaaatgcattgttagcttgtatatttaaagtttttcttcctttttttgatgtaggcacttgtagctataaaattccctcttagtacagcttttgctgtattccataggttttggtatattatgtttccattatcatttgtttcaaggaagttttcaattttcttcttaatttcttcattgacccacttgtcattcaggggcaaatcatttaatttacatatatttgtatagtttccaaaattccccttgctattgatttctagttttattttattgtggtcggagaagatgtttgacactatgtgggtttttttttctttaaatgttttaagacttgttttgtgacctaacatatggtctatccttgagaatgatccatatgctaaagaaaagaatgtatattctgtagctgttggaagaaatattctttaaatatctattagatccgtttggtctatttctttgttgattctctgcctggaagatctgttcagtgctgaaagtgggatgttgaaatctccagctattattgtattggagtctttctctctttagctctaataatatttgctttatatatctgggtgctccactgttgggtgcatatatattaaagtacttttttatatcctcttgctgaactgacctctttattattatatagtgaccttctttgtctcttcttacagtttttgtcttgaaatctattttgtctgatacaaatatagcttctcctactctgttttggtttccattggcatggaatatcttttccatttctttattttcaatctgtgtgtgtctttataggtgaagtgtgtttcttgtaggcaacagattaatgggtcttctttttttaaatccattcagctatcccgagtcttgtgattggtgagtttagtccatttacactcagtgttattattgacaaacaaggacttattcctgccattttgtaatttgttttctggatgttttgtggtcttcccttacgtctttctttccttcctgtcttcctggatgttacagcctactacccacctggggtatatggtatagcctattgcttctaggctacaagcctgtacagcatgttactgtactgaatattgtaggcaattgtaacacagtagtaaggatttgtgtacctaaacgtagaaaaggtacagtaaaattatggtatttataatctttatttttgtagacagagtcttgctcggttgcccagggtggagtgcggtggcgcgatctcggcttactgcaacctgcgcctcctggttcaagcaattctcgtgcctcagcctcccaggtagtagctgggattacagatgtgcaccaccatgcccagctaagttttgtaattttagtagagacgaggtttcaccatattgtccaggcaggtcttgaactcctagcctcaagagatcccctgccttggcctcccaaagtgctggaattataggcataagccttcgtgcctggctgggtatttatgatcttatgggaccactcatatatgcagttcgttgttgattaaaaccatcattatgtggtgcatgactttactttgtatgacaagttactgaacgttctaaaggagatatgaaagtaacttaggtttgatttttgtttgaaattgtgatatttttgccggctgtggtggctcatgcctgtaatcccagcactttgggaggccgaggcgggtggatcatgaggtcaagagttcaacaacagcctggccaagatggtgaaaccccgtctctattaaaaatacaaaaattagccgggcatggtggcgggcgcctgtaatcctagctactcaggaggctgaggaagagaattgcttgaacctgtgaggcggaggttgcagtgagccgacatcacgccactgcactccagcctgggcgacagagtgagactctgtctcaaaaaaaaaaaaaaaaaagaaaaagaaattgtgatgtttctttcccattccaagaccatccttttcttagtactctttctttcctttagagctaggctagtggggagcagaatcatgagcttaaattagtggaatatgtggacattgggtagcatggggagaagtgtttcagcttctttctctaaactttaatttccattctttggtgcttaaagtggtgttttaatcacttgcatctggttcaagagggtgtctgattctttgcaaagctattctatcgacaaaaagcattcacagtgttttcctagtggattaatattgggttgacatctatttgcatgttaagtgctgtattgttatcatttggcatttattaactagccttgatatactgtgcattagttggcatttatacatgttttagtccctgctctagagaaaatatcctaaaagggagctaattgtgggaaatagagccttttctcacatatccagctgcctgggagctttcctctaaagacctttaagcattggaaagtcattcctcaagtagttaagataggaaatgacagtcgtgtaaaatagggccttaaaaacaactaccaggtagactcatgatagtgaccctacagggaattaacaacatagatatgattttctcaaggagttgggaatcttcttattaaaattagagcagtgaaattgttcccttctctgtagaatataaaaacaaaatcaaaaacaaaacaaaataaaaaatcgatcaaacttctctccgtgtgttaacaaaacgaccatgagatctgtggaggaaggaaaaaggagaaaactttattttcagagtaacaatctgcagataagggaaagtaacctctggtggaactgtaagcacgtgcttcaccgaaggggagtgaacagtagtatttaagccttctagggtttgttttacatgcatatccatcatgtaatatgaattgtttgaggaatgtctatgaatatatatggggaagtctagtgcatgcacagtgagttaacatataagtaacatacatcccatcttcgcttcagggcacaattttagcattaaaatgaggtggaattcagctctttatgtcaacaggtgaactatagagcacaaagatattttgtatgcagtctctataagctggctaaaactggcttagggtctgtagcattttagcaggaaagaatgtttgtaggactggcctcctgtcctatcagtgctgttggtaggaccctcaaggcagggttgtcccagttgtctttatcaggcagtttaccaagatcggttgggcagtgtttctctagaacagatttctgcctaatagaagaggaaaacttcatggcagttaataagaaagaatgtttgtaagaatggcctcctgtcctatcagtgctgctggcaggaccctcaaggcagggttgtcccagttgtctttatcaggcagtctaccaagattggttgggcagtgtgtctctagaacagatttctgccgaatacaagaggaaaacttcatggcagttaacaaaccctttggtagttaacaatgtacgtatgtatgaccaaacccttgttcctgctatggccatttaattttctctcttgagggtcttatcttagctacagaaagtccatcttatctatcattgttgacctttggatcacagctagtagtggtttgaggacagaatgtatcaatgtatcaatagtttctgtcttgtcttcaccgctgagtaggtatacaaaacttagtcaagtcaaatcacttctttttttttttttaaatttatttttttattatactttaagttttagggtacatgtgcacatagtgcaggttagttacatatgtatacatgtgccaagctggtgcgctgcacccactaactggtcatcaaatcacttctttacctcagttttctcctcttcaaaatggagataatgcctaccttacaaattgatggtgagaattaaatgaggaaatgtgtgtaaaaatgtgttgtatgcctggtacctctttggcatgcaactttgtgttttcctccttcctttgacattagtaatatttggatttcactctttgaattcagtggttacttggttgtggaatcaaattattttgtctttccaaacctcatttttctctaacataaaatcagtaatacacactttatgaagtagtggttgaaattcagttcctagtgtagtctaggaagattttcttgaatctgaatgtcaaattgctaaaaacttgtataaatttgtgagttttgctgtgtagatcttttggacatgaaaatacaatatctttttaagaattaaacagtaggagaaatatactaagggaaagtaagtctctagaatgttttttgggggactctacaatagcttactgcattacagttactgtaattcatcaagataatagggaaattatgcatccaaaggatttatttacttgaaatagcacctctagaagggatattcatagagcagtaatataagaagtgagacacttgaacatacctttttctttgctttttttttttaatcttaggtaacttcagattttaataagatttcactatataatgttttgtgggcagatattgtaaaatctactgaaaatttcccagtttagtaattaccaaagaaataataaaccaatattaaagttcagttacaaaattaaagtcaggactcataaacaaatcatgttaaatgagttatgaattaaattagtgttattgttgagtttaactgtgtgtcaaatcaatataatttctttgacataatcacagaatagaaatcaatgtatgtgtggtacattgtattgaagggttacaaagtgatgaactagtgagtatgtatttttaaggatgttatagacctatgaatttcaattatatttgtttaaatgtgaatcacttttataagcagcagcaaaatatcattgcctttgtattttgtagcaggtgatttagcttttgtgtatattcagataaatataaattttaatttattttattttgactaaagtttaagagataatttagcatattgtttgctaatcacttttaagtaatctcagtttagctggttgtggtaatgtgtgcctgtagtcccaactactctggaggctgaggtgggaggatcccttgagcctaggaatttgaggatgttgtgtgctattgttgtgcttgtgaataaccacagcatggtactctagcctaggcaacatagcaagaccttgtctcttataaaaagaaaaggaaaaaaaaaaagaaatttcagttaataattttatttgacatgttacagctccttatttgaccctgaaaatgttgcagtgagaatagcctttgcatgcatagtccttaaccctgaagaaaaggataaaagaaaataaaatcaaaacttagttgaaaatcaggaagtgcggacaagcttctgtcgagaaaatggaggtgaatttatgtgtaaatgttaaagacatatggatatgttgattatagccatctttaagtgtttgtgttataggcagacggtttgcagagttagagtaaatggattaaagatattgctaaaattaaaataactttatttttcaagtttttttggtattatgtttgttttttcaggaaaccagatacttaaatataaaactcggtaattatttttgtaactattttattaataatttaatgttaactactagaagtctataattttacattgaatatacaaaatattatttgggcaaatgattattaaaataatatcatagtaatatacatcccccctttttattatggtaaaatgtacataacacaattcaccatttaatcatttttaagtatacagttcattgttatgcaaccatcatcactatctccagaacgctttcatcatcctgaaatgaaactgtgtgcccgttacataataattccccgttacttattatctcccctttaatcactattctactttctctctctctgattttgactattctaagtatctcgtatgagtggaaccacacaaaatatgtccttctaggactggctcattgtatttagcataatgtcttcaaggttcatccatattgtagcatgtatcagaatttcagttctatttcacgatgattaatattccgttatatgtgtataccacattttgcttatccatttatctatcagtggacatttacattgtttctacttttggctattgtgaataattctgccatgaactttggtatgcaagtatctgtttgagtgtgttaatatattttctatatattttaacagaaatttgttagtttacatatttttacttaaacgagctaaatatctgaattttcagtgttatcagtgaatatttattgaataccttgtatattgtaagtattgtgggggtataaagagttacaatatcatgaaactattgttttaaagaatttacagtctaataacagtaatagggtgtgtttataaagacacagaacctggtagcatatgctttttgaagctgaagagatatctgagctctgatgcaaaccagcatcgtttcttgccaaaatttttgtttgttatcctgagcagttaggaggcagatacatggccacagtcaacatatgcatattccattcaagcatagcatttaaccttcaaggatgaattttggggtgatcatatcaacatggaaattagatcatgacatatctttaaagtcttctccatggaccttatctttaggtgagttactttccttctaccaaactgccaccttaactctgacctcatctcctatcccctactcccaccttgcactgggtaattttttgttgtggatacatttcttatgtatgtaaactggcttaagtgtaaacaaggtaaaagtcataaggaggaactacatatatgtttcaaggttctttccagctttatgattctaatttaatccctgtggtacctgtgtgttgccagtgaaagaaaacagagttagcatgcttagaggtttcacagcagagctgctttgtggtgattttaaaggctaaaactttgaaataaaaacagtttggtatgtttcagtggtctctttttcttctctttcagagtacttttcctggaaaagcagaataagtcttttatgaatttagtcataactttgcagtttaattggacttttagggtttttctatgtgtgcaagctggaccttttgaagtttaacactggaatactagcatgagagtgttcctactcttaatttccactgagttagaccaaaggaaaacatatattttagattcatattttctttgaatgatgttttggagctcaagatgaactttaaaaaacacagctaagcagagcttctaaaaggtaatactgtagtagtatttttttcctccatgttaatctacttggctccccatagtgagcttgaactgtgagtggtaaagactcattactttgtagggtgtcctggccctaaaaataaaacttctttctcatagcctacagcctatgaatgtgattattctgtaagcctctgtaagtcactgtaagaacagtgactgtggcttcatttttatttattttatttttcttatttatttatgagacagtctcactctgtcgcccaggctagagtgtagtggcttgatcttggctcactgcaatctctcctcctgggttcaagtgaatctcgtgcctccaccacccaaatagctgggattacaggtgtgcgccaccatgccaggctaatttttgtattttttttgtagagatggtgtttcgccatgggcctgtctcaaactcctcctctcaagtgattcacctgctttggcctcccaaagttctgggattataggcatgaactactgtgccaggcttgtggtttcatttttgtaaaacgtttagtagagttggtgccttgcacataataaaatgtatcttctgaggttatgattccacataaaaaatgaaaactttaggagataattacagaagtgaagaaagatgaatgaacaaggatggccatctattcattcaacacataatgaggtctactatgtatcagacacaccactaagtactggaaatacagcaatgataaattagataaattagggaatttaggttgtctagaacagtgaatggcatgtaataggcgcttaaaaatatttgaatacatgaaggtctgttttgtagaaaatgatttatggtatggaacattttagtgaggaagtggaacgtgtcccatcgtattagggacacgttcattcattaaaaaaatggaaacaaactgtttattaatatggagactacttaagtcggttatggtaatacatagaatgtagtacagaaaagcccttaaaaaatgagatatttattggctgacacagaaagatgttctaatttacctaatgttgaattaaacaaagtaagctgttgaataggatgtatggaatgattcctttaatgtaaggttatttatatttctataaaatgtcacaaggtatggtggagaaatgataacaatgaatgattctaacaggaggtaagtttttcgctgatctttgctgtattctttatgcacttctgtgattgttttaccatgatcatgtgctactgtttaaaaataataaagctgcttaaaaatgtttctggataaatttttttaaacttaatattctatctataaatagtgttactggttgatggtccgttgtcctgtaaatgtaaaagtgttattaaagaattctgcattttctttctaaagaaatatagttaaccagagttcactttgatactcaacatttacctttaatgtttattatttattattcattttttaatatatttttttgagacagggtcttcctctttcactgaggctggagtgcagtggcatgatcttggctcactccagcctccattttctgggctcaagtgatcctcccacttcagccttccaagtagctggggctacaggagcgtgccactacacctggctaatttttgtaatttttgtagaggccgggttttgccgtgttgcccaggctggtctcagactcctgggctcaagcagtctggctgccttggcctcctaaagtgctggaattacaggcatgagccaccatgcccagcctacctttaacatttaacaacatttacctgtaacactcatagagtgtagttttaaaatgaataatagcatttacaaatgtgtagtagcaggaatatatttaataataattttaattttgttttggaggtactttgagggaggtatgtctacataattaaatggcaaagaacggaagtttttaagtttttttgtatacttataaatttaatttggatttagttattaataaatattaggttgaactgcacttttaatctaaagatttattttggcactcatttttgcttattatgacttctcattttcttaattagaggagagaagacatgttctttgggcgtcctggttatgtctagtcaatagtcttagttttcacaggatagtacggaatgttaaattattactacctattttcttaatttatttcaataacttgctgtttttatcaggaaaaattaatgaactaatcaaaatgttccattctatacatagtttgctcataacaaactcattttattagaaatgttatagcaaccttattttttttttatcctccacaagatcattttagtgtagttactggagtttcaaatcatacgtaattcagtttgaaaactatgtctatggttctgtttagtaacattttagatgatattatttaaaaaggttaacattgcttagttaaaagttatcattattcttttaaaacaagttttatttttcagaccacacagtcctttgaattctgatgcatcaagtttcaaacagttttttgtttttggggatacttacctatgagatctccagaaattgtatatttagctatgaaaatcttcagaaactgtgagcatattaagcacacatataagactgtaaaccttagaggatgattttagatttctttctcttttttactttttatttttgaaaaaaataagcccattccagtttaatgaatatgataatttgaaatccaggtagaataatgtatctcattttcgccctcatattttaaagtgagatagtttataaaatggagaataaatcatgttgttagatgttgactcttatagtataaaagtatgaatcttatatagtgatattctattttaaatgctttatatgtttaaataatttagaagaagggaattatagaaaaactgaaacaaaatgcttgaattaatactataaacatgatgttagcatttataattgatattttaaattgttacataaagatgtatgagtatggataaaaacatatatattagtctaaatgaaattaatggcttcttttatacactcacaatatttatacttttctttaagtatatcagatgttgataagtgttctagagaaaagtaagtacattagggatggtaataaggaatgttggaattgggaagatgccatttttatatagaatggtcagggaagatttcactaagaaggtgatagttgagtgatgctctgaatttggtgagggacatagctgtggggatattcggataagtgtgtttcagacaagatcaaaagccctgtgttgagtgcaggctctgcatatttagaaacataagaaatttaactgtgcatggcacaaggtggtcttatatgttaaaaaaatacatttttttggtttcatttttgctttcctggtacattctaagatatgctgaaattgagatttacttgtcttgcttattgtatcttgggcacccactacagtgccaaacacatggcaggcaatttgttgtggatgatgagaaagaattttggaggaatcttcttcttttttttttttttaaattcatactaccaaattatttcaagctacagaggtctttagagatcatttagataactcttttggatgttatgcatgagaagacatgtcattaaatagaatgacttccaaaagtcaccattaattagtagcaatcttgagttggcaaagatttttggtctcttagtctaactttagtccattgatggggtgatccttttgtttcagttgtctcatctatgcatgggaagatacttgctatggaaaacctccttgctgtggaagaactccttgcatctagaatcagattgcttggttgaaattcctgtttgacagtactagctttgtgattttctccctctcccgacttttccttttggtgccctggttttcttgtctgttagacagatattgttattctcattccagtattctttacaccataaacattttctcattaatcttctaatttaccaactcagagtgttatttcctttttttttaaagggatttatgatgaagagaataggagtttgaaattaggtgttcttgggttctataaaaatttaattcttaaggttatttgttagtatgtatcaaactcttatttaatgaatgaggaaaacatcagcaagacaaaagaactgctttcaagagtatttgagcatcaggagttcatgtattcatttaggaaaggaatgtcaaaataaaattttttaaaaattatactttaagttccagggtacatgtgcgcgacgtgcaggtttgttacatatgtatacatgtgccatgttggtgtgctgcacccattaactcgtcatttatattaggtgtatctcctaatgctatccctcccccctccccccaccccgcaacaggccccggtgtgtgatgttccccctcctgtgtccaagtgttcgcattgttcggtttccaccaatgagtgagaacatgtggtatttggtttactgtccttgcgatagtttgctcagaatgatggtttccagcttcatccacatccctacaaaggacatgaactcatccttttttatggctgcatagtattccatggtgtatatgtgccacattttctcaatccagtctatcattgatggacgtttgggttggttccaagtctttgctattgttaatagtgtcgcaataaacgtaacgtgtgcatgtgtctttatagcagcatgatttataatcctttgggtatatacccagtaatgggatggctgggtcaaatggtatttctagttctagatccttgaggaatcaccacgctgtcttccacaatggttgaactagtttacagtcccaccaacagtgtaaaagtgttcctgtttctccacatcctctccagcacctgttgtttcctgactttttaatgaccgccattctaactggtgtgagatggtatctcattgtggttttgatttgcatttctctgatggccagtgatgatgagcattttttcatgtgtctgttggctgcataaatgtcttcttatgagaagtgtctattcatatccttcgcccattttttgatgaggttgtttgtttttttcttgtaaatttgtttaagttctttgtagattctggatattagccctttgtcagatgggtagattgcaaaaattttctcccattctgtaggttgcctgttcactctgatggtagtttcttttgctgtgcagaagctctttagcttaattagatcccatttgtcaattttggcttttgttgccattgcttttggtgtttcagaatgaagtatttgcccatgcctatatcctaaatggtatcgcctaggttttcttctggagtttttatggttttaggtctaacatttaggtctttaatccatcttgaattaatttttgtataaggtgtaaggaagggatccagtttcagctttctccatatggctagccagttttcccagcaccatttattaaatagggaatcctttccccattgcttgtttttgtcaggtttgtcaagatcagatggttgtagatgtgtggtattatttctgagggctctgtcctgttccattgatctatatctctgttttggtaccagtaccatgctgttttggttactgtagccttgtagtatagtttgatgtcaggtagtgtgatgcctccagctttgttcttttggcttaggattgacttggcaatgcgggctcttttttggttccatatgaactttaaagtagttttttccaattctgtgaagaaagtcattcgtagtttgatggggatggcattgaatctataaattcccttgggcagtatggccattttcacgatattgattcttcctatccgtgagcatggaatgttcttccatttgtttatgtcctcttttatttcattgagcagtggtttgtagttcttcttgaagaggtctttcacatcccttgtaagttggattcctaggtattttattctctttgtagcaattgtgaatgggagttcacccatgatttggctctctgtttgtctgttattggtgtgtaagaatgcttgtgatttttgcacattgattttgtatcctgagactttgctgaagttgcttatcaggttaaggagattttgggctgagacaatggggttttctaaatatacaatcatgtcatctgcaaacagggacaatttgacttcctcttttctcaattgaatgccctttatttctttcacctgcccgattgccctggccagaacttccaacactatgttaaataggagtggtgagcgagggcatccctgtcttgtgccagttttcaaagggaatgcttcccgtttttgcccattcagtatgatgttggttgtgggtttgtcataaatagctcttagtattttgagataagtcccatcaatatctaatttattgagagtttttagcatgcagagttgttgaattttgtcaaaggccttttctgcatctattgagataatcatgtggtttttgtctttggttctgtttatatgctggattatgtttattgatttatgtatgttgaacgagccttgcatcccagggatgaagcccacttgatcatggtggataagctttttgatgtgctgctggattcggtttgccagtattttattgaggagttttgcatctatgttcatcagggatattctctttttttgttgtgtctctgccaggctttggtatcaggatgatgctggcctcataaaatgagttagggaggatttcctctttttctattgatgggaatagtttcagaaggaatggtactagctcctccttgtacctgtggtagaattcggttgtgaatccgtctggtcctggactttttttggttggtaggctattaatcattgcctcaatttcagagcctgtgattggtctattcagagattcaacttcttcctggtttagtcttgggagggtgtatgtgtctaggaatttatccatttcttctagattttctagtttatttgcatagaggtgtttatagtattctctgatggtagtttgtatttctgtgggattggtgatgatatcccctttatcattttttattgcgtccatttgattcttctctctttacttctttattagtcttgctagtggtctatcaattttgttgatgttttcaaaaaaccagctcctggattcattgattttttgaagggttttttgtgtctctatctctcagttctgctctgatcttagttatttcttgccttctgctagcttttgaatgtgtttgctcttgcttctctagttcttttaattctgatgttagggtgtcaatgttagatctttcctgctttctcttgtgggcatttagtgctataaatttccctctacagactgctttaaatgtgtcccagagattctggtatgttgtgtctttgttattactggtttcaaagaacatctttatttctgccttcatttcgttacgtacccagtagtcattcaggagcaggttgttcagtttccatgtagttgagcagttttgagtgagcttcttaatcctgagttctagtttgattgcactgtggtctgagagacagtttgttataatttctgttcttttacatttcctgaggtgtgctttacttccaattatgtggtcaattttggaataagtgcgatgtggtgttgagaagaatgtatattctgttgatttggggtggggagttctgtagatgtctattaggtctgcttggtgcagagctgagttcaattcctggatatccttgttaactttctgtctcattgatctgtctgatgttgacagtggggtgttaaagtctcccattattattgtgtgagagtctaagtctctttgtaggtctctaaggacttgctttatgaatctgggtgctcctgtattaggtgcaaatatatttagtatagttagctcttcttgttgaattggtacctttaccattatgtaatggccgtctttgtgtcttttgatctttgttggtttaaagtctgttttatcagagagtaggattgcaacccctgcctttttttgttttccatttgcttggtagatcttcctccatccctttattttgagcctacgtgtgtctcttcatgtgagacaggtctcctgaatacagcacactgatgggtcttgactctttatccaatttaccagtctgtgtcttttaattggagcatttagcccatttacatttaaggttaatattgttatgtgtgaatttgatcctgtcattatgatgttagctggttattttgcttgttagttgatgcagtttcttcctggtatcgatggtctttacaatttggcatgtttttgcagtggctggtactggttattcctttccatgtttagtgcttccttcaggagctcttgtagggcaggcctggtggtgacagaatctctcagcatttgcttgtctgtaaaggattttatttctccttcacttatgaagcttagtttggctggatatgaaattctgggttgaaaattcttttctttaagaattttgaatattggcccccactctcttctggcttgtagagtttctgctgagagatccactgttagtctgatgggcttcactttgtgggtaacccgacctttctctctggctgcccttaacattttttccttcatttcaactttggtgaatctgacaattatgtgtcttggagttgctcttctcaaggagtatctttgtggcgttctctgtatttcctgaatttgaatgttggcctgccttgctaggttggggaagttctcctggataatatcctgcagagtgttttccaacttggttccattctccctgtcactttcaggtatgccaatcagacgtagatttggtcttttcacatagtcccatgtttcttggaggctttgtttgtttctttttactctttttttgtctaaacttctcttctcacttcatttcattcatttgatcttcaatcactgataccctttcttccagttgattgaatcagctactgaagcttgtgcatgtgtcatgtagttctcatgccatggttttcagctccatcaggtcatttaaggacttctctacactggttattctagttaatccttcgtctaatcttttttcaaggtttttagcttctttgtgatgggtttgaacttcctcctttagcttggagaagtttgatcgtctgaagcctcttatctcaactcatcaaagtcattctccgtccagctttgttctgttgctggcctttggagggggagaggcgctctgatttttagaattttcaacttttctgctctgttttttccccatctttgtggttttatctacctttggtctttgatgatggtgacatacagatggggttctggagtggaagtcatttctgtttgttagttttctaactaacagtcaggaccctcagctgcaggtctgttggagtttgctggaggtccactgcagaccttgtttgcctgggtattagcagcagaggctgcagaacaatgcatattgctgaacagcagatgttgctgcctgattgttcctctggaagcttcatctcagaggggtacacggccatgtgaggtgtcagtctgcccctactggggggtgcctcccagttaggctactcgggggtcagtgacctacttgaggaggcagtgtgtccgttctcagatctccagctctgtgctgggagaaccactactctcttcaaagctgtcagatggggacatttaaatctgcagaagtttctgctgccttttgttcggctatgccctgtccacagaggtggagtctgcagaggcaggcaggcctccttgagctgcggtggactccacccagtttgagcttccaggcctctttatttacctacgcaagcctcagcaatggcaggtacccctcccccagcttcgctgccaccttgcagttcgatctcagactgctgtgctagcaatgagcaaggctccgtggacatgggaccctccgagccaggcgcgggatataatctcccggtgtgccatttgcttaagaccattggaaaagtgcagtatcagggtgggagtgacccgattttccagtgtcatctgtcacagcttcccttggctaggaaaggggatttcctgaccccttgagcttcccaggtgaagcgatgcctcaccctacttcagctcacgcttggtgggctgcacccactgtcctgcatccactgtctgacaatccccagtgagatgaacctggtacctcagttggaaatgcagaaatcacctgtcttctgcgtcgctcaggctgggagctatagactggagctgctcctatttggccatcttggaaccattgaggatcaaaataaaattgataagatacacagaagactggttaactttctgtatgacaatgaagccatataacttaagggaaactgaagttatatggcttcattggaaacttggatgtaaatctttgaatttaatttagatatcatcaagatctttatcatcatcttgagtatcataagatactggattttatcatctctaggaccaagtatattggttttattgattttagcagattctagaaacttgccatatgcctttagacttctagcttcatgtgcatggtattttaaaataacatcagatttgttatcctaatagtctcacagaccaaccagtataatgtctgaggtatttattcacttcttttttctcaattttcctctcatatgacataacctctttacaccatcaaagcacattgattctaatcatctgttttccttcattttgattacctactcttgtctatcccctttatataccaactctcctttttggggttcttatttttactcctgcctctatttttctttttctttttctttttttttgacacagagtttcactcttgttgcccaggctggagtgcagtggcacaattttggttcaccgcaacctctacctcatgggttcaagcgattctcctgcctcaccctctggaagagctgggattacaggtgcatgccaccacaccctgctaatagtttttatttttagtagagacggggtttcaccatgttagtcaggcttgtttcgaactgccgacatcaggtgatccatccatcttggccttccaaagtgctgggattacaggcgtgagccaccacgcccggcctcctgcatctgtttttacctcccttaccttactcttgggcatggcagcaatggcagccttacggtgtcctggactcctctctggtggttgtgttggctgtggtggctgctattttgaggggtgtgcatgaatatgtagtcccaggaggcttggtcacttagcgggggatgttttgcaaccaaggtctttagaggcatgctcagtggcagcaaatctttaacttcttttttcatcttttgttttttgtgctaacatttttaaggttttctagggcagtctagagtaacatttactcttgtgcattcttaccctcatttctaagatggacctctattgagtgactctctgttggatgtcccaaggattcattgaggactctgtcttgcctgtgagaacttaaatgattcctggccctttgtgagctctggaaattactcagcactaactacatcataatttttctttcctggaaattggttttgctctgtatcattggtttttaccctatgcacatgtagattagtattgatattcaggtaatttaaggatatcctttttttaaagaaaataggtctttctgtaactctctcacttcaggaactttcccccaaaattcttgttgtgttggcctttctgtattatgacctcttgtgttttttaactcagcaatggcactagattctattagggtttcacctcctacatactacagtcccaaaagtgctttcagagagaaatctcaggcaattatagggctcacctttttgtttgtttgtttcccttattacagaaatcagttttgagctgattttcaatgtcagatcatcagttgtgcaatgtcatatacattgtttgtccagttttctagttgtttacatttggagggtaattctcgatcctattactgctgcatgggtgaaggtagaggtctcctaatacttttaaaattgagaaaatccttagcaagtgatatgtctcacccatttcaaagtgagttcaaatgctattatatgtaaaatttcatttttaaatgttatttaaattaattttagtaacaacatttgtgttattctttcatacatagctgttaagtaaagcctgctttggctgcttttcatctaatattagttaccagtcaactgatgcgttaaattaaagttgatataactctaatgatttataagagttgaatctttttagtactttaatgccctactgaagatcactgcctgttttatggtgctcttgcgtgtatgctcttacgttctctctctcgctctttctctctctctctctctccctccctccccctctcttcctctctccatctctccccagaatttgatgtaacaacaccaaaaacctcatgactttaccatattttactgtatctcaacagatagaatataagaccaatttttttattggtaaaaagtatgggaactttttaccaataaaaaaattggtcttatattctatctgttgagatatagtaaaatatggtgtttaagtttactacttcttactctttcaaattccttcaagtagcttaaaagcattggaaattgtaagcagaatgctaatgtaaattggtgggaagtaattgggaatgtctcattaaatatgacattaaaaaaaggacgtttaaaaatttttttcgaaaggatatgaggtactcacgaaagatttaaattaatggctcttatgcttatgattgagtcatttggtgacattagcttcattctttattatttagtgcttacaatatttgagttcctgtactaggtgtgaagtgtaccatatctgattattatatgtttatgctattcttagaagaggaacttgaaaatcttaggggagtgtttgaagatgagccagttaattagcattgtgatttaggtgttgtgtgcccagggcatcagaattgtacattgtgagtcttaaaaaaaaatgaggaaatgtagagccataatttggatacctctgaagagatgagggtcagggttgtaattttaggtgagaaaactacaaatgcattaattctgacaaatggccacaaaatttgatttcattaccttttactatttttgaactattagtttaggttcagaggtatctgtacaggtttgttatatacgtaaacttgtgttatggggggtttgacatacagattatttcatcacccaggtactaagcctagtacccaatagttatgttttctgttcctctccctgcttccactctccaccctctggtaggctccattgtctattgttcctttcgttgtgtttatgtgttctcatcatttagctcccacttataagtgagaacatgtggtatttggttttctgttcctgcattagtttgctaaggataatggcctctacttctatccatgttactgcaaagtacatgatctcatttttttttatgactgcatagtgttctgttgtgtatatgtaccacattttctttatccagtctacccttgataggcatttaggttgatttcatgtctttgctattgcaaatagtgcttctgtgaacgtaggcatgcatgtgtctttatgatagaatgatttatgttcttttggttatatacccagtaatgggattcctggatcgaatggtagttcaatttttagctctttgagaaatggccacactgctttccacagtggttgaactaattttacactcccaccaacagtgtgtaagcattctctttcctctgcaaccttgccagcatctgattttttttactttttaataatagccattctgactaatgtgagatggtatatcattgtggttttgatttgcatttctttaatgattagtgatgttgagtgttgatcaatgttgggctttttttcatatacttgttggctgtatatatgtcttctttggaaaagtgatcacatcctttacccactttttaatgtgtttatttttttcttgtgaatttgcttaagttccttatagatgttggaaattagacctttgtcagattcatagacctttacagttgcaaaattttctgtcattctgtaggttgtttgttttctctgtcgatagtttcttttgctgtagagaagctctttagtttaatgagatcccatttgtcagtttttgcttttgttgcagttgctttttgtgtctttgtcatgaaatctttcccaggtcctatgttcagaatggtattgcctacgttgtattccaggctttttcatagttttgggttttaagtctttaatccgtcttgagttgatttttgtatgtagtctaagaatgtgtccagtttcaatcttctgcatacggctagccggttatcccagcatcattttattgaataggaaatcctttctccattgcttgtttttgtaggctttgttgaagatcagatggttgtagatatgcagtcttatttctgggctctttgttctgttccattggtctgtgtgtctgtgttttttgttttgttttgtttgtttaccagtaccatgctgttttggttactatagtcgcatgatatagttggaagttgggtagcatgatgcctcctgcattgttctttttgcttaggattaccttggctatttgggctgttttttggtttcatatgaattttaaaatagtttctctaattctgtaaaatgtcgttcgtagtttgataggaatagcattgaatttgtaaattgctctgggcagtatggcaattttaattttaatgacattgatttttcctgtccacgatcatggagtgttttcccatttgtgtcatctcttgatttctttgagcagtgttttgtaattctcattgtaaagatctttcacctctgtggttagcagtattcctaggtattttattctttttgtggcagttgcgaatgggactgttttcctaatttggctcttggcttggctgttgttgctgtataggaatggtagtgatttttgtacatttaatttgtattgtgaaactttgcttaagttgttcattagcttatggtgcttttgggctgagacattggggttttgtaggtatagaatcatgtcatctccaaacagtgatagtttgacttatgccctttatttttttttctcttgcctgattgctcttgaaaggacttccaatactatgttgaatagtaattggtgagagagggcatctttgtcttgtgccagtgttcagcttttgcccattcagtgtgatgttggctgtgggtttgtcataaatggcttttattattttgatgtatgttccttcaatacctagttcattgagagtttttaacatgaagggatggtgacttttgccgaaagtcttttctgtatgtattgagatgatcatgtggtttttgtctgtagttatagttgtgtgatgaatcatacttattgatttgcataagttgaaccaaccttgcatcccagggataagccctacttgatcatggtgaattagcttttcaatatgcttccggatttgtttcgctagtattttgttgaagatttttgcatcagtgttcatcaaggatattgacttgaagttttcttctcttttttttccttgagaaacaaaggtactttttttttgtctttgttttttgagccagggtctcactttgtcacccagcctggagtacagtgtgcaaacatgactcactgcagccttaacctcccagactcaagtgatcttcccacttcaacctcctgaatagctgagactataggcatgtgctaccatgcctggctaatttttattttattttattttttattttattttatttttagagatggagtttcaccatgtcgcccaggctggagttctctttctttgttgtatgtcttccaagttttagtatcatcatgatgctggccttatagaatcatttagggaggattcccttaccctcaatttttttgtaatagttttagtaggtatggtactagctcttctttgtacatctggtagaattaggctgttaatctgtctggttcagggctgtttttcttttttttttttttttggttggtaggctatttattactgattaaattttggagctcattattggtctgttcagggattcagtttcttcctggttcagtcatgggagggtgtatgtgttcaggaatttatccatttttttctagactttctagtttttgtgcctaaaggtgttcataattgtctggttatttgtatttctgtccaatctgtaataatatccccctttgttgtttttgattgtgtttatttggatcttctctttttttctttattagtctagctagtggtctatgaatcttgttaattttttcaaaaaacaaactcctgacttcattgatcttttggatgattttttgtgtgtgtgtttcagtctccttcagttcagctctgattttggttattctgctagctttgggattgatttgctcttgcatctctagttcttttagttgtgatattaggttgttaaattgagatctaatatatatgtatatatgttatatatacatatgtatataaatgctattttttaattttattttttattttttattttattttattttttttgagacagtctcgctctgttgcccaggctggaatgctatggcacgatcttggcccattgcagcctctgcctcccaggttcaagcgattctcatgcctcagcgtcatgagtagctaggattactgacgtacaccaccaagcccagccaattttttatatttttagtagagacggggtttcacaatgttggccagtctgatctcgaactcctggcctcaagtgatctgcctgccttggcctcccaaagtgctgggattacaggtgtgaggcactgtgcccagctctttctaactttttgatgagagtgtttagtgctatacatttctcccataacactgccttagctgtgtcccagagatgctgggtatgttgtatctttgttctcactaatgttaaagaacttctttggtttctgccttactcagaagtcattcagcagcaggttgttttatttccatgtaattatatggttgtgagtgattttcttagtcccaacttctatttttattatgctgtgttccgagagagtagttggtatgatttccgctcttttgcatttgctgagaattgttttttgtctgactgtgtggtcagttttagagtatgtgccatgtgcagatgagaagaatgtatattcttttgttttggggtagagttctatagatgtccatttggatctatttggcccagtgttgagttcagttcctaaatatctttgttaattttttatctcaatgatctgtctaatactgttggtgaggtgttgaagactcccactgttattgtgtgggagtctaagtctctttgaaggttcctaggaacttgatttatgaatctggatactcctgtgttgggtgcatatatatttaggatagttaggtcttcttgttgaattaaaccttttaccattatgtcatgcccttttttgtctgttttgatctttgttggcttaaaatctgtttttttctgctttccatttgcttggtagatttttctccatctctttattttttagcctacgggtgtcattgcacgtgagatgtgtctcttgaagacagcataccattgagttgtgcttctttatttagcttgccattctgtgccttttaattgggggcatttagaccatttacattcaaggctagtatggatatgtgtggatttgatcttgttattgtgttgttagctttttattatacctacttgtttgtgtggttgctttatagtgtcacttggtctgtgtacttcagtgtgtttttgtagtggttgctaatggtctttcctttccatatttagtgcttctttaaggggctcttgtaaggcaagtctggtggtaatgaattccctcagcatttgcttgtctgaaaaggatcttatttctccttcacttatgaagtttagtttggccagttatgaagttcttggttggaatatcatttcttcaagatattgaatatagacccccaatctcttctgacttatgaggtttcttctgagaggtctgttgttagtctgttgggcttccttttgtaggtggcctgttctatctctctagctgcctttaacatgttttctttcatttcagcctcatagaatctgatgattatgtatcttgggcataatcttcttgaaaagtattttgcaggggttctctgcatttcctgtgaatgttggcctctctctataggttcagaaagttctcatgatggtatcctgaaaagtgttttccaggttgcttccagtctccccatttctttcaaggatgccgatgagttgtagatttggtctctttacataatcccatatttcctggaggttttgctattcccttttgttcttcatcttcttcttcttttttttttttttttgctgactgtcttatttcagaaagccagtcttcaagttctatgatttttttcctcagcttggtctgttttgctgttaatacttgagattcttatagaggttttttcagctctatcagatcaattatgttttttctgtactggctattttgtctttcagctcttgtatcattttattgtgcttcttagcttgcttagattggcttttagtgttctcctgaatcttgatgctcttttttcttatccatattctgaattttatttgttgtttcagccatgtcagcccagttaagaacccttgctggagaactagtgtagtcattgggaggaaagaagacactctggttttttgagttgttggagtttttattattattactattattactatgattattattattattacttacatattttttttgacggaatcttgctctgttgcccaggatggagtgcagtggcgtgatctcagctcactgtaagctccgcctcccaggttcacgcctttctcctgtctcagcctcctgagtagctgggactacaggcacctgccaccacgcccggctaattttttgtatttttagtagagactgggtttcaccatgttagccaggatggtctcgatctcctgaccttgtgatccacccaccttggcctcccaaactgctggaattacaggcatgagccactgcacctggccgagttgttggagttcttgtgctggttctttctcatctttgtgggctaatgtttcttcagtctttgaagttgctgtcataagaatgggtgttttttcttttattctgtttgacgaccttggggctttgattgtggtataacatgggttctgtgaactgttgtgctggagtggccgaggtgccctcggactgctagtcacaacactttgataggtggtgccagccaaagcacttcatagggtgatggcaacgggatctatccttgttcgcatgtgccagcggcagtggcaatgtggcggggtgcatgttcattggctgtagcagggtgttagtgggtgctggcctccctgcaggcattcggagcagtgagttcaggtctgactctttagtcccctagggccaaagtctcctatgggagcaagtcgagcctagtgggttaggtgtccctggctgtgctccactacagatgctcccacaccaaaccctctgggctctatccttaccacttctcgaagcagctttccctgccaactcaagtgtccatggtgtttgaggggtctcctcctgctgggattccagaggcctgtggccagagtgggtcgctccttgcctgttcaactcaccctctccgctggagttgttggggaccaataatgagccttagtgtgtggtagctcctgaagggtttccagcttcctctctcttcacatcagcccctgttctttcagtgccttccctctgaagatctgctagaagtgtatcagtctccctgatgtcctggtccctcagttagagaggttcctcctggctgcatctggtcgaccatctatggctcctggagctgaggacatgaagcagtgaatacaggaccccaagctctggctggagtgagacaaagaccccaccatatccctggaagtcgctactgatatctttaaaaattgctgcttctaggccgggaatggtggctcacgcctgtaatcccagtagtttgggtggccgaggtaggtggattgcctgaggtcaggagttcgagaccagcctggccaacatgatgaaaccctgtctctactaaaaatacaaaagttaagtgggtgtggtggcatgcgcctgtaatcccagctactcaggaggctgaggcaggagaattgcttgaaccctggaggtggaggttggcagtgagccaagatcgcgccattgcactccagcttgggtgacagagcaagactctgtctcaaaaaacaaaacaaaacaaaacaaacacaaaaaaaacgctgcttctagataaatccattgagtttggtgtagcaaaaaattgttcccctttaattttctgctggccgatataaaatgaagacatttaattattcaagatcttttagatattagttgttattcatttgtgagaaaactcacatcgatacatggtagtcactacatacacttgccaaaactgcttttgtttttgttctattatggctaaaagagatgggtctacctgtagtgttacctaggcaatatggatgtacactgtatttcatcgtcctaaattgcttaccattgaaattcatatattatgtttgttactttggtagtgtgttcccttgtaactctgcccgtgaagagtaataatcccttggtcagccataccgtgtttctttgattcatttgaagttgagagcaagggcttcatcattaaataaatctttgctcttcctggttttgtgatcttaggcaaattaattaaccttttgtgttttacctgatattagcatagttcagtagttgagtggactctagagctagcttgtagggatttgaatcctggctctactacttaaaagtatgtacgactctgggcaagttactaaattttttgcttcttctttcttatctgtaaattaaggataatatgggtacttatttatgtactaatagagataatagagaatgtttattgagtgtttactatgtgccagatttaaacctgggtaaaaataacataatagggttgttgtgaggcctgaatgaataaaataagtaaaacactttgtacaggttcctagtacattttcagccaattatgtataaaatggggttgtgataattataatgaagcatatatgtctgtggaataagtatggatccaatatttgtggcagaaaaagaccacactgtgtaactccattgattggctaattggtggagacacacagaatgagtcccaacattcttttaggtaacttgtataaaacatattaacttttctctcccagatcatgtgcaagatatggtagatccaagaatcctatccaatgatacttcaaaattgtaaccttagtatacctgttgtgttaaaagtattgtttagaattggccacactcgacagatggccagggaagtaaaagcacttattggggatagctttgacaccagctgtattatattaaagatatgatataaaacttttctcaacatcagtagtgattctgaagctgtcagaaatagatagggagtcatgatgcccctaaagttcatttcccctttcctctatagtaatagaaccctgatttttgtttgtttgttttaactgggtacatggatgactagaagaaaagactatttcccagccatgtgattaaattctggcaaaaaagagatgaaagcagaagtattatgtgtgtacttctaaaagacagtggctcagctgggaaggcatacctttttaccattcagttttcttccactttattgaaagtgtaataactggagcattaacaatcattttgtaccatgaggcagtcttgaagatggaagccaggcatctagagtggtggaagagaaagctagaagcttgggtccctgaggactttgtgcaaccatcatctctacttcacctatctccagacttcttttacaaaagaaaaaaccaaatctcaatattgcttaagctattgctatgttgagatactctgtaatgttcagaattgtatccctataccaagaggaagaagtgtaaataatgaaacactgttgagatggaatggtttatgtacacaggagcatgtgttgtgtatggagagctggagagtagcataaataactaacgaagtgagaagattgtagatctactttaatcatgctagtgaaactggaatattgtattaaaggaaaatgtgaaactttggaaaaaaggaaatatgtaataattcaatgacatttgtacaactagttatcaggtcacattttgatggatattggggatggttaagaaagctaggcggcacagatcactctggtctttggaatatagattaatggtttttcatatgattctttgttatgccattgttaaatgaagtgtttataaccttatttttttctggtaaatcatattttattaatgagacttcaagtgtcttatctcaaaatgttggattggtaaatttgaaaaaaatgttagaaaacattagctatttcctgagggagaggttgagcctttacaacaaatgttgatattcttttacttgttaatataaagatgcgtaattgtcagggttgtctagagaaacagtaccaatagggtataaataaatagatacataagaggagatttatcatgggattatagtcattcaagatgtcccaccatatgccatctgcaggctggagaacaggaaagccagtggtgtgaattagtccaagctcaaaggccagaaaaccaggggaacccaaggtctaagtctcagttcaaggtggaaggccttcggaggggattgctgctgctggataagtcttggagtctgaaggcccaacaattagtagctctggtatttgagagcaggaggtgaaagtaccagctcaagaagagagtgagaattcacccatcctcaacctttttgtttaattcaggtggtcctcaaaggactgaatgatgcctgctcacattggtgagggcacatgttctttattcagtctactaattcaaatgctaatctcttctgggaacaccctcactgacacacccagaaatgatgttttaccagtgatctgggtatcccttaacccagtcacgttgacataaaaaattaaccattataagatattttggttttcattcacaaatcataaaaaatatttgtggttttcactcacgaatataaaaataattgtggggttgcctgtccttgtgttaaaagtatacatagaggagattttctagttttctcttgcaattcttaaagccagcatgttcttaataatagaaaaaagctgccattgattctggttctgctacttactggctttatgaccttggggaagttatttaaattcagcgtaccttaattttcttcactgtaaaatggggataataatacctacctacgtcgtaagggtattgagaggattaaatattatgatatctgtgaagcaattagtaaagggccttgcattcaggaaacactatataaatgtaatcgttattattatacttaatgagagaccagcgtaataggaattatgacggtcattttaaagacaaagtaatgcaggttcggatatgtcctgcttgattctttactgtcccatttctatattagcggtgccaggatttagaccttgttctgtctaaccttagagcctgtactttccaagatcttataccatcatccaacattatcagatccctctgtgtcctaactgttcacctaacatattatgtgtatttgtctttagcatatcaaactgagccatagtatcccacaatggttgtaccataatttatttgtttcccttattttgtgagatatatactctatgccactaatctggcctatgtgttagtgaattgaataccagccagtgataccattatgatattcttcatacatgcagtagtaaagattagcctttaaagggctttcatgtctcttgtatgaagagtgcatgtttactgcacttttgaatccctactattctgtagaaacagttttgaatgtgtttgaatttgcacctttgaatctattgttctttagaaactgttccctggaaagattgttaatgtttattcattatttgtgttgtatatgactaggaattttttatttttttttgagacggagttttgctcttgttgcccaggctggagtgcaatggcgcgatattggctcactgcaacctccgcttcctgggttcaagcgattatccagcctcagcctcctgagtagctggggttacaggcatgcgccaccatgcctggctaattttgtatttttagtagagatggggtttcaccatgttggtcaggctggtctcaaacccctgacctcaggtgatctgcccgcctcgacctcccaaagtgctgggattacaggcgtgagccaccgcgcctggccatgactaggaattttttttgcaatccatttatctctccttataactattaaatgttgtgtttaaggaccctgcagcttatcaagagttgatttgaatgcaagttatttcttcgaaattacatttggacctatttctgaacatctgcttttgacattttatgcacgtaaatataaatgagtaaacatatgaaaatgactttgaatcttagttctaattcttataaggcctgatttaatttttattttgcttgggattttgaatataggtattaaataaatataaatttggataatatgtatgggcttattcaacaaatactaataaagagcttgctctgttttaggtgctatgtatacttttagctcttgctctactgatacataccttttagtataggaaatagataaataagccaatttgtgttataatagagaataatggaagagggtgagtgtttttttaaaaaaaacatagagtgttgtatgtagcattcttgtagggtattgtagtcattcttttgttctttcttgtttttagggtcccagttttgttttggagcctaccctcagggataaattctgattagtctaagctggtaatgggaatctattccatttgtcagtgattgagtttacaagggacagatgactcaatcttggctaggaagatgtgcaggtcttcaggggagatgactgtcagtggtttcctctctcttaaaattaagagacagattcccagttgttcttttgcacataattgcatatggctggaattgaggcagctaacttgctaccaggaagaaagttagctagaggacaaaaacagatatgctaaggtagaatagaaagatgaaaagggatttttcacagtttcattgaaccccattgaattagcttttttgctgttgagaaactaaaattttcttatttttaaagtcaccttgagttgcaatttctcttgtatcctaatgtgtcgtaattgatactagttgtcaggggctgttttttggaaaagaagtataatataagtagagatctgaattataagaatgagccaaaggtggaaggaatagcaagaacaaaggctgcatgttgggtaagaacttggcatattccagaaactggcagaaggctgatctacttggtttctaagcaagggaaagataataactaatatttatagattgttttactgtgtacaaatcacttttatgcatattatcataatcttcacaattatgtgagtttctacgattatgactcctactttatagcagggtaaactgtccatatgtgattgatttgaaatggttgctctttctaatattaacacatcatggtgccaatcaagtatatattatttatgtgcacacacacacacaatcggagaaaatggtgatatatatacacatttcatttgaatttactagtattaccatttttcagcagtattaatttatttagggctgaaggtacagatggcaagtccagatttctagacccatttgagtagttaattgtatcagtaaacacagcctggtgtgttattgtgtgtaattgttaaggtgagtgagatattcttgataagaaccttataaatgtgattatgtgtttgtactttataactaggaagattaatttctaagatattggctgatttcagtgaattagtattttgtattcatgtatttatgatgctggcattttaaattcatatgtatatactatgacactactgataagaaatatgaagtatgatagatgagtataagtaatgaatgaaaatcaaattttataatcttggtaggatttatatgaaaattttcttttctctgtcctgctctgccctcttttcctccctgtcttaccctcttcttctctcttttcatcctctcctcttccttcccctcctctcctctttcttcccctccctttcccccacctctctttttcgttgtcttcatttcagtttagttggttttaccaaatgcttttacataaagtaaaagtttatttcagctagcattaaaggacccttttaatttataatactatttttacttgttcctttctacttctttcttacattaataaacacattatttgtaaattacccttttcccgtatagggagcaaagcaataaaaaagattttaataaattctgtaacaatatttagttaaaaaatgaattgcgatcaaaggagaagatatttaaaaaatagagtcttgggcacatattaatcctgaataggattggattatgtatgtactatatatggctcttaaaatgtttgtacattataattgataattagcttttctttaaaagttttatttataattctctttatcaacttgaaaaatttttgttttctagtagattgttaatgaagaaaatgagtgtgaaatatgtcatgctcaatctgttaccttgtaacagtcattcgttaaatttgctaaataaatgacttcacttttctgttaaatttttcagtttattctattatgttgaattacttcaagaaacactttgtaataatgattttggtttttactcttttcagttgttaaaaaagtaaattgataactcttataactgcagtgtatattttaatttaggaaatcactattatttgaataatttatgatgattccttttattctgagaaaaggttaggttagtaagaatgttcagtacaatttctctggtttgttaattatattactagttatttaagttgattcttattgtctgaaatttgtgaaaaatatagttttcactttaacatttggaaagtttattacatctatataataaatgctgttgaaatttttttcattaaaagtaagaatgtactaggtgatgatttgctgaaaaaatctgtctcattgaaacttaaatgcaaggacataatttaggcatttaatgaaataacaactttcaattattgacattttcaattatagtcacaaaataggggtaatttaaactttctcttaaaatttttgtcaaccttattggaacataatttacatcagtgaacccatattaagtatacagttagatgatatttcttaaatctatatcctcatgtaactgtcatttcctttcttaatcagtcatcttcgtacttgctggcaagtactagtctgatttccatcactatctgttagtttctttgttgtagaacttcataattttatgaatttaagtttttaagtcattaggctattcaagtaatctattctttattgagcttcagtagtttgtttcttttagggaatctgtccatttcaggtatgacttcatatttattggccgaaaatagagtcatacagtgtgtattttttttgtccctggcattttttgtcaggcatgtttttgagatttaaccatattgtgtatactggtagttgttgtttttttaaactgatgaacagttttccattgtatgaatgtgccataatttgtttatccattcacctgcttgaagatgcctggattgttccaaatctttggctgttgtaaataaataaagttactatgaatactcatgtactagtctttgtatggacatacatcttaagttcctttgtaaatacctgaatagaattgttgaggtatacggtaagtatatatttgcaagaaattgacaagctgtttatttttctttttccattttctagaactctttgtgtagaattgttgttatatctaccatgttatgtaaatggtagaattcgcacataaagcaatatgggcctagagttttcttcatgggaagatttacaaatacgcattcaacttccttaagctttaagtttttaagtcattaggctattcaagtaatctattctttattgagcttcagtagtttgtttcttttaggaaatctgtccatttcaggtatgacttcgtatttattgaccgaaaattatttgtaatattttcttattactcttttgtagtatctctagtaatactacagatagtgcctcttacattcctaatattagcagcttatgttcttttttttttcagcttgtgtccttatgcccttgattagtccaactggaagatttttaattttattgatcacttcagggaacccattttttgttttcattgatttttctttgttgtttatcggttttatattacattcatagagcttacactgtgaaccttttacgtatttcaccaaactttcaaatacttttatacctcttgaggtataatatagggactttaaaacagtgtccttccttttttctgcttgctatgttttgtgtaagtattgtcatatattttactattgtgtgtgttgtaaaccccataatactttgttattattttagctttgagtcaaatttattttgaaagaaattagaaatgaggagggggcagggtggaaaaaagagaaattagaaatgagaaaaaattttatttgtatttacccatatatttaacatgtctgtttaaatccatcatttacattcaagtttctatccacaatcatttctttcagcctgaaaagtatccttttaaatatatcttgtagtatgtatcagctggcaacaagttctttccatttttttgttttccaaaaatatacttattttgcatttattttttaaaagctttttgtttcagaataattttagaattatagaaaattagcaaagagagtacagtcactgtatactctttgcccatgttcccctaatgttaacatcttacgtagccatggtacattcatctaaactaataaattaacagtagtgaaatactctaaactacagactacatttggatttcagcagtttttccatggtgtccctgccctgttccaagattcaattcaggataccacagtatatttagtcattatgtctccttagacttctctaatctatggcaatttctcagttgtttgtttttatgactttaatagttcaatacttttgaagagtactggttaggtattttgttgaatgtccccagatgaggatttgtctgatattttcttttattattagactggattcatggttttagaggatgagtactacagaattgatgggtccttttttagtatcatttagaatagtttcatcatataagttactcttgaagggactttataatcatcccctccttgtactttcaactcttgggaaccactgaactatttttcaacctatagtttttccctttctgtaatgtcatgtaaatgaagcacacaatatgtagtctttggttttgtcttccttcacttagcaacatacatttaagattcattttgttgagtaaatcaatggcttatttctttttattactaactagtattcctttgttttctatgtatcatgtttgttaatctgttcacctgttgaaggccatcttgattttttttttgcagttttttgtctgttatgaataaagctgctgcaaacatttgagattaattttttgtggaaaaatatgctttcatttttcttgggtggattaactttgaaacctcaaactaaaacttcttaaagaacccataggagaaaatatatgggactttgggtttagcattgaatttatagacatagtaccaaaaccacagtctataaaagaaaagaagtcagtatattgtattatatttaaaaaatttaaaaattttgctgtgtgcaagatactgttaaaagaataaaaagataagccacagactgggagaaaatatttgaaaatcatatatttgataaaagacttatgttcagaatatataaagaactcaagtctcagcagtaagaaaacaagcaatctaaaaaatgggcgaaagatctcaaaagatactttaccagagaagatatacggatacaaaataagcacatgaaaagatggccagatgttcagtgtcatttgttactagaaaagtacacattgcaaccacactttgataccactacacagctaccagaattgcctttaaacaaactgacaataccaaatgctagggagattgtggatcaacaggagttcttattcattgcttctgacaactcagaatggtgcagccactttggaatagagtttggcattttcttgtaaacatacatttttcatgtgacccagcaatcctactcctagctatttgacccaagttagctgaaagttcacattcacagaaaccttttatttttgaatatatttttactgaataacaaagtgtagttttgtcattttttttttttagcattttaaaaagatgttgtcccattgtcttactagattgtatttttttctgattagaagccccctgcatttctttgttaccatgtatggtttaccccccaatcttgtggctgttttaccctctaaattatggttttatttgtatttaaaaatagattggaaattctatatatacccatggttaaacatattttcaatgtacattacttcaaatttgatgataaattttgttctgagaagtccttttctgaagccaaactcaaaaatggggaagtgcttacagatttccaactggccccaaaacggatattgtaaatggctttttgcctaactaatgatgatggatgagtttcatttgccttttatcatttgaacggttttttgttcacaataatagttactgtaaggtgatgcagctgtggtgaagctgtaaaacactgtagtatctgacaataagtcctatcaacagtggctacctgtattagtctgtttttcattgctctgaaggaattcctgagactgggtactttataaagaaaagaggtttacacagtgaaaacctgtctctactaaaaacacaaaaaatcagttgggcatggtggcgcgtgcctgtagtcccagctacttgggaggctgaggcaggagaatcgcttgaacccaggagttggaggttgcagtgagccgagatctcgccactgcactccagcctgggtgacagagcgagactctgtctaaaaacaaaacaaaacaaaacaaaaaagtttacttggttcccagctttgcagtctgtaggagaagcataatgccagcatctgcttctgggtgagagcctcaggaaacttcctctcatggtagaaggcaaagggggagccagcgtatcacatggtgagaaggggtgcaagagagagaagggaggagataccaggctctttttaacaagatcattgtgtgttctgatgaacccatcataagttgaaagtatcatgagtcgcaatatgtttaatacacctaatctgaacatcatagcttagcctaccttaaatgtgcccagaacacttatattagcctacagttggacaaaatcatttaacacaaaactattttgtaatgaagtgttgaatattttgtaatttattgaatactttactgaaagtgaagaacaaaatggttgtagggttactcagagtggtttctactgaatatatattgcttttataccatcataaagttgaaaaattgttaagttgagccattgttaatttgaggaccatctatatgatattttttgttctacaagttatacatttttattgtagttttcttttttcaacattttcattttttcttttaaatcctagcacatatttcgatacttgtttcagcgctcttgtctgctgtcatcattgtcatttctgttttctggatctgtttaaatggactaattttctcctggttatgggttacattttccttcttgttggcatcatagtataaaatacatatttttggcaaagtaattaatactttattcaactgtacttctgttgatgggcaattacgttgtttttccagtttagtgctgttgcagacaatgatgtaaagagtatgtgaatgcattttgtttacatattaaaatgcatcttagcataaatttttgcatgtggaatttcttgtcaaagggcatgtgtatgtaaatatttgatatataatgccgtattaccctttgcatagggtacacatatttttattatttaaataagtgctgaattatttttgagtttaaaaggcaaccctcctttgacatggctcatagcacaacaggccaggcttttatcttcagcagattgtcgcatactcatcttctggcctcagcatcaaagtcaagctgcttgaatatgattcttggaaacatccttttcacacagtcatatgccaaatgtggccattgttcattttcttgttagacttaagaagtgtcagtttgatcgtattataaatggtactgcattttttgttatgtctaatggaataattgagctatatctatctttaggaaatgtaggagggggaaatgaggaattattagtcaaagggtacagagttttggttataaagataagtctcagaaatcttttgtacagcgtggtgcctatagttaacaatactgtattgtatggttaaaaatttcctaagaggatagatcttacgtaaagtattcttactacaaacacacaaattagtgatagtaaataagagagtgggagaaaactgttgcagatgatgaataggtttatggcatagattgtggtgatgagttcacaggtgtctactttgcaaactcatcaagttgtatatattatgtatagctttttgtatgtaaaacatgtttaaaagaatgttgaattttaaaaaagaaaaagacaacacatcctagcctgcttatatttttggggagttatgatgatggtaatggtcacaacaatgacaacacagttatcgtaatcattgtaaatttaatagagacttcgttctacttctgaaaatttttttcagtatggttggatcttacaaaggtgctaaatgtttgtgataaaatagcttagtttcagctctgcggtaaaatcttgacataatgatcatctgtttatatatataattttaaacattgtgtaatacataaggattttgaagattgcaacaataaattaccatgttttattctgacactgtacatatattttgattttcaaattatagtattataactgtggtatgcaggtggcagtgttcaattttatgcttaaaaataaaatgatagcaaaaaatgcaattatttgtggaatagtttatattcagtttctgttgagtcactcagaatgttagttgctgtaagaagaggctttttttcttttttggttgtttgttttagtggcattacttcactttgcaattagaacccactgtaatattacctattgaaggcagggatttgtgtctgtcttgttcactgctgcatcctcaatgcctgggatatgtaatgtattttatgtaatagaaattgaatgattagtttttgaacatatgagtgaatggatcatagtgttgtatagatttaggtagatttcttccagttgctttccattataaatgttgataagaaccatgctgcatatttaaaaaataaaatttacataacatgaatgactgcactaaatgaagtatattatttaggaggtcagttacttactgctgacatagtagaggatgcttccgaagtgatcatcctgaagaatggagactgcagctcattgtcatttcttttattaatacttcaaatgtgctcccttctctactgcagctgtgaaactttttctggtcttctcaagaactttctcttctctgttttttctctaatgaattatactttcattttttaattccattttatcttcaccactggctttttctttgctatacctttttattttatttaataaaaactacttgttgctctgggggaatgccatctgatgttggaaatgctctgtatctacaccattcgtaatggtaaccactagacacaggtagctattgagcaatcaaaatgtggcctactgtgcctgaggaaatacgttctttttttcccccagacagggtcttgctctgtcacccatcctggagtagaatggtgtgatcacggctctctgcagcctcaacctccagggctcaagtgatcctcccacctcagcctcccaaggagctgggactataggcgtgcaccaccagttttaatttatttatagagacagggtctcactatgttgctcaggctggggaaataaatttttaattttaattctaatttaaatagttgcatgtagctattaaagcagtgtagctctggatctttatatatatgtatatgtatatataaaattattagtctactttcaaataatatagcagttcatgtgtagtgagacaacttgacttttgtgcacttccatttcctccgtctcatcttttaaatattctgtcatatgttttacatctacatatattataaacccagtgatacattattgccatttttgagtttaacagctttttatcttttaatgtggttaaattaagggaaaatagctctgattttttagatttcatcatttctggtgctatttttgtgtgtgcagatctgcatttttatctggtatcatactcctccttgaaaaatttcatttaacattttttatagtacaattttgccggcacagaatattttttaactttttttttctggaagagttttgattttgcctttatttgcctttgttttgccttcattttatccagtgaaaggtattatctagaatgctcagttgccgtttttccccccttggtattttaaagatgatgctccattgttttttgactggccttctttattacatgtagtgtgttctcatttttttttctctgtatgtaatatttcttttttcctagttacctgaaagatttttctctttcagtttgttttttagcagctttttgtctacattttaattttgccctactagcaattctctgcatttctttgacctgtggtgttttatcatttttttactttggaaaattcccagctaacatctctttaaatgtattttcttctctgttcttgttttcttcacattattaaactccagttacacctgcactagatcattggatattatactacagctttaaaattcctattctgttttttaaaaatttcaatctgtttcttctctttgcgtttcattttgaataatatctatttacctctcttcaagctcactgagtttttagctttgtctaatcttctgataattctgttgaagattttctgatatagtccatttagcatttcttctttgccgaatcccttatctgtttttgtattttgttcatatttaccatgagatcctttaatatatcaattacaattattctcttttctgtctgatagttcaaatatctgattcatttagaagtctggttttggtgtttgctttgtcttttgactatggtttgggttttttttttaactatatatctatatatatattatatatatatatatttatatctatagatctatatctcatgggttttttgttgcatgccagacattttaggtaaaaggcaacaaagattgaggtgaatagtatttatgcccagaaacgggtacccttcttctttgatgatgttggtgtatatgtggattgggatggggcagagattgagtcagtccaacagtggtttgagttggatttgtttttttgttgtgattgtaatagttaaattcactgaatcagaaacttgaaattcctgcagtagtggactgcttgctgcttcttcattcttggtttggagcctcggtgctggagtctttcctctgtgttccagctccatccttagcttttagcaggtctttggatgcctgcatcacagcatgacctctgttcatattctttgtaacttttgataaaatgcaccttctagttttgattgtctgtattttcttatctttctttgaagattgttgagttttattttgacaggcagataatttacttttggattacactgatccttttgtagcttgtttttaagctttgttagggctcttgttggcatagcttttattctataactggagtcagtagactttggtttatgagccaaatctggtccacagcccatttttgtatagctcatgagctaagaatggatttttcatttttaaagggttataaagaaacaaaaataaaaattaagaagtatatgtgacagtgactatatatgcctcacatagcctaagatatttatcttgccctttacagaaaacattttctgatcctgcttgcttaattttaatttctaaggtgttttatttcttggatttttaccgaatgctgcaggttttctctgtggtatttttattgtacctggttggaactcacaggtctgtcaactttgcctaatctttgagatgtgttcagcttttagctacccagtatttaatttttctatttctgataattgtcctttgcaagcctcatgagttcttactataacttagtttcctgccaaagacttaaaggatctcctatgcaaattttggagctttctgagtatctacctcctctttagtataatgacctgcaaattccacctaccttaaattccctgaactttggtctttgtcttctcacctgaggaagatggctgtgttttgtttgggttcttcctttctgtgctggtgttcagcaaatgcttctaggcagaaggctaaagtgatcatagggcttacttttattgttaattttctctcagacattacagtcttctttgacctttgcccaatatctgaaaacagtttttctaaatatgttttttaaagttttctagtttatatgtgaggctaatctagtagttattctttcatggttggagatggaactctgtttagcagctattaataaatgtgcttttttacctctggtattagtataaaaccaataattgtaattgtatctgttaaatctcttatttgctgtaaattgagttttgttttatggtatgtataagaggtattagcagaatacataaggaaatgtgattaagactcagttctgtcctgcaacttgaatgcctattctgtgcccagggctttctataacttgctagagacagaaaataacacatgaagtgaagatcaggcttttaacctactagaggaggtagacatatgtattaattatttattgctatgtaacacattacctttagactaagtggtttaaagcaacaatttattatctgttggtcagaatttagggatggtttagctggatcctctggctaagctccatctcctaggtgagggtctttaaaaagcctgcattcaagatgtggaccaaagctacagctgtcttgaggcttgactggtgatggtgcatttctaagcttgctcacgttcactggtcattggcgggattcaacaaccttgtgaggtgcttgtggtcttaggactgagcactttatatcttcgttggctgttgtctgaaggctgccctcagctcctttccacatgggcctctcagcatgatggctgacagtatggtagcttgtatcatcagaataagcaagcagggacaatgtgagcaagacacagaagctccagtcttttgtaaccttatcttggaaatgaaattctgtcacttttactgtattctatttaagaaacaagtcactaggtgcagccaacactcaagaggaggagatgatacaagggcatgaatagtggacgcagagatagttggcaaccattttagaagctgcctacaacagcatgtggcatattaattatataaagaattgtaaatgggtctataaaataatgtaacaacgtcaatatataccacataataatttgctgcatggtatgctgaggtgcctcaccactgatgattattttatttaagccttttccagtattctctgggagaggtggtatttattatctccagtttacagattgatgttcagtgaggttacctagctatgatgtagcagaactgagactccagtctagacactgctgattctagcacccatacttttaatttctatgtcttgtcagcattaaaataaaattactttttttggagcacttcttctgtgccaagcattatgataagtggtttatatatgttaaccttatttaaggctcgtggcaactctattaagtctccttatcttactgatattacactcgagcttccagattcagaaaaagtactttgaaaaatcaaatatatttattgttccagagacattaaacaaatattacccaaagaatctctgtaaataccgaaagaaatgaatcatttaaataccttagtaccttaaaaaggtgatatcaatctagcctaggcaacatgccgagattttgtctctctctccccttttttttttttttgagacagagccttgctctgtcgcccaggctggagtgtggtgttgtgatctcggctcactgcaacctccaccttccaggttcaagcaattctctgcctcagcctcctaagtagctgggattataggcacccaccaccatgcctggctcatttttgtatttttagtagaggcgggggtttcaccatcttggccaggctggtcttgaactcctgaccttgtgatccacccgcctcagcctcccaaagtgctgggattacaggtgtgagtcactgtgcccagccaattttgtctcttaaaaaaaaaaaagtgatatcactaattaaataaatttgcagaaagaatcctggcacatttcagtacatttagtatatttagtattttgcagaagggtactttgtgagtcttaagtagtaataaatttataaattcttgaaagcccactctgagaagaaatctcaacaaacactgctatataaattttagtcagaaattagctgatatatgtaatttttaaatatttttacgaatttgaactatttttactaatactttcacaaataagttgagtggttgtcatatcaaaggctgaacatactttcttcagttatatcgttgtctttgcaaagtgaatcttctaaatgaagaaaataagatacattattttttcatggttaaaaggtaaaccataagactctcttggctgggtgtggtggctcacatctgtaatccctacactttgggaggctgaggcaggtggatcacttgaggtcaggagttcaagaccagcctggccaacatggtgaaatcccatctctactaaaaatataaaaaatgagccgggcgccacagcagacacctgtagtctcagctactcgggaggctgagacaagagaatctcttgaaccctggaggtggaagttgtagtgagccgagattgtgccactgcactccagcctgggcaacagagcgagactcaaaaaaaaaaaaaaaagactctcttggtcttttaggccaattaaatttaatcaatcaaggaatgtctttataagatatatgttgacaataataaatatgaaagtttattaatgactttatttttgaaccatttccttataatagcattctctcactttctgcattaccatttgctgtcttaagtagggcataaatgcagtttaagctgtatttattagtgccaactaagtgccaaataccgttctgagtgcctgggatacatcagtgaacacaatgaacaaaaattatggcgtttgtattttagcaagcatggttcaggcaataaacagtaaccataagtaagtaagcaagcattcattgtagttagtagatagggaaaaaattctgtacttgttcttttaaaccttgcagaggaaaattgcatagaaaactatttgtttttcagcttaacttggttttcttgaccccaaaactggggatttaaaaaatactggcaaagacaaaaaaaatcatgggaaacattctctccaaaaacatagttcaaatgatgctattaattagaaaatgaccatgttttgctcttataaaaatgtattgctttttaaaactcaagtattatcaatattgatatataatatagtaatttaatctcttagatatttttggtaatggtttataaaaaatggaaagtattttttgttgtacaaattttgttattcaaaatgtatgtttctgtaaacttttgttactattcaagttatgctggctttaaatattacgatttttatggtaatcccaaggaaaatgtttcagcatgtctttttattatttaaattactcttttaaagaaagctacctttgctttggttgtttatctcagttgtctgttttctgcgttacttttgcagtgaagggaaagaaaaaaattgtaatatctgatatatagtttaccctctgtagctgtagttttagtattcttgattcagccaactacagatcaaaatatttgccaaaaaatacccccaaaattgactatctacatagcatttacgttgtattaggtgttataagtaatctagagatgatttaaagtatttgggaggatgtgtgtaggttatatgtaaatactatgccattttatgtaagaaacccgaacatctgtggattttggtgtccgtggagggtactgagagacaactgtatatcttaatagcttagaattaactaggatatagtacagtttcagcatataagtatagtaacattttacagtgttgcatatgttgtctcaaaattactgttaattgaaatattaatacttatattttttggctgacgtaccgaattgaatcaatttcttatgccatcagaatgaattcacttcttatttggttttaaagtcacagagccctggatttctgtattttttttacataagatgaaaagtaggggatacctgagtttagaggagtggggattgagaaagagttttaagaaagggacaggataaacaatggagtcagtaaaaagagtgttcttgatagatttaagaatagttattaaaacaacagacaactttttacttggattattcctttttaatttggttttcaaacagttctcagcaagtacaattcttttcattctatgttttagccagtgtaaatcagtaacattaaggtaaatgttgtaggagtaaatgggaaggaagtagagtgtttctaggacagccctttgattttcttctctttgaatattggtgttttaaaaacaattgagatttaaggtgcaaacatagaaaaatagtggccctgtgctctgatttttgaagcctcttctccatcttttctgctcatctttttaccactgtttgatttgtggtcaagtgcccctcacattcagtctcgtatacagaaactatttcttgttttttctctcttctcttgtatatggaactctgtctagacatatgatttctcttctatagctttaaaattatcaaaacatttttaaaattaaagaaaaaaaaatttttatagagatggggtttcaccatcttgccagattggtctcaaactctgggttcaagcaattctcccgccttgtctccttctaaagtgcagggattacagatgtgagtcactgtggctggcctgtcaaaaggttttaaattatatttttgcctacaaattctctcctggggagaaaatagttttgtttccaagggaattctaagcctaatgatggagaaatgacaaatgatacttgtaaccaagcctggaaaagaatgtgcatttgtagtttaagatgcacagtaactaagatgtaactggtgctagacgtttgttgcaattgttggtatttttataaatttgaggaagcagtagtctagcctgatccatttgaacctttgcttctgatatttggaatgactgccagctggttaatggctatgataacctttacttggctaatatgcatgtcagttttagaatttatcctaaaagtgacaatttgcctgtcacctgcagagttaagtggtataatggcagctgaacaatgagggaggagagtggagttgagaactggtagaaatgaaatcactcatacagggaacatgttttttcttgagataatgaacatatagcccaaaatatgtggttgagtacattttgtttttgattgattgttcaaagatataatttttaagtcttcatatataagttaatgtataattatgcaagaaggaaaagaaagtgatgatggcactttgaggactttcaggcttagagctaattagtctgttatctggtagagcactaatgtacatggctgatttaatatacagattaacagatttaaagcttttaccctttacttgttattaggcagttaggttatcttccaacttgttggccagtcaacaccaatgtgtttcctccaagaatctcagtatatgctattttatataccttaaataatttaaatacatttcttactctttccacagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacagcagaatgaagacttgaggcgaatggccgaatctctccggtaggtcctaaaatactgaacgaagaatgatgaaatattgtactttgtttttaggtgtagggcttcattccgctaggaaaaatagttaattatttttataacctgctgtctttgccacaacttagcatgacagttttctatctctgtgtatttaatacagaacaagcttgtccaacccacagcccatgggccacaggtgacccagaacagctttgaatggggcccagcacaaatttgtaaactttcttaaaacattctgagatttttttatttttttttaagctcatcagctatcattagtgttagtgtactttatatgtgccccaagacaatttttcttccagtgtggcccagggaaaccccgatataatttctccatagtggcatcattattttgcatatgcattttaatgtagaaaaactatgccatttcatttatatacttacatttcatttacagttatgtatttaaaaaaattgatatattaaatccaaactatgttttaaactcatgtatattaaaaattttatatgaactgtaacaaagattataataactgggaggctgagttagtctaactagaacttattaaaatgcagaaacaaaagtttatcattaaacaactggatctggaatgcggagaatgattatcattgctatttctagtctgtaaaaaatgtgacatatatctattagaaggcatcaactgtttgaaaaccaaagtctcctatatattttcagggagcaagtaaacataatattacataggcgatctctgtatttttttccaaagttattgaggtaaaacattacctagtatcttatatgcgaagatgatcatgtagtactcactctctcaaactagagaagctagaaatgaagatttgagaatccttactccagaggtggtaattgaccctaagggaagtggtatagagaaaaagagctgaaagttcatttctctttgagaaacacataaattaaggagtagaaagtggaaacatccaattgtacagaaagcctttagaatagttggggaagaatagtgggacagagctgttacggaaactgaggaacattctgtgaaggaagaatgtagttggcagtgttaaattacccttgatgctatagagaggatgcccatggtgctctcattttctactctcactgcccttcactctttgtttagaactcggatttttccctttgtctagtttcataactttttcttcataatattatttgggtccttttatgtcctttgaaagacaatgctacgtgttaagacaaaaatgaatgaaacattattcttgtcatttgtaccattcaagaagatagcaagcagtcagggattagaaagtggacagaacttcttgaatttgtctattattttctttcctacttggggtactcagggaacatcatggaggaaggtgatctttcagtagagtcttattcattcattctaaagattgataatttaggggttagtaataatagctgtcatttattacatgccaggtactgtgccaaggactttgcatggatcatctcactgaatttcacactatctttatgagatgttagtaccatttttgtaaccattttacagattaacaattatagagatgttaagtaatttaatttgctgaaggtcacacttttcacaagtggtagagcctactttgaatcccagtagtatgactccacaacctaaactctgaataactgtattgccttcctgagcagaaaacagagaaatcagtgacctaaacatcttaggtatgagatcaccaagaatagctactattctagttgattttggagtttgctttgattgtaatcaaatctccttctatatcatgggaattttgctcctaaaaagatttttccccttaacaatttagacttataaataattgctcactttccttatggttccatcttcaatactgatatttcaatttgtttatttctgactgccaaatgtcttgtttttgttgcatgaagggaaagcttgctttagtatgggtttttctttctgcaaaataatctttaggtctattaagtcactttctttatattcttatatgttgaaattaatttctcaactacatttaaatgtagagactactttcaagagctgaatcacctaagtcatgtggtaataccatgtaattacagtctgaaaacagactaagcaaataggcccatgtttatataagggaatataatttcaggaaaatagtttatagttattttccctcaacctcattgggccctttcattgactttactgctggggccatttgtatttcttccaaagggatgtcgttttagagccctctggcatgaaaggaagagcaatggaggtgctactagcattgggatttttttccccttatagtaattaagttaatattttgtactcaatttgctatgtctttttcatataagaaaatgtgttcacaagtcagactacaaaagattaattcagatgtttataactaggtcgtttctttgagataaggcatatggattggagttggaaagcaacacaaaagcttgaaactacaattttttagattttctagattcaagtcaataatctgaaaagccattaacaaatctttcggctagaattttctgattttgttgatagttttagaaatttaggaaaataatttaaatatcgtatcttggagggatgcaaatgtagaagcacaatatataggaggttgcagtgtatttgtgtaaatctgatctattgatgagtaatgtctgtacataaaattcacttcctttatcgtagatgtctgtgagttttggcaaatacagtcacgtaaccatcacaaaaactatagatgaattctacctccctctagaattctgttgttccctcttatggtcaaattctgtcccgacctcctgtccctggcacttaactgatctgatttctgtcacacttttttcctgtttcagaatgtcatataaattgaattacatagtatgtagccttttgagtctgtcttttttcacttactataatgtttttgagtttcatcaatactattgtctgtattagtagttcattcttttttattgctgagtagtatttttattctttttaaatgttgagtagtattccgttatattgatgtgtcttagcccatttagcattgctatcacagaatacctgacactggatagtttatagagaaagaagttatttggctcatgattctggtggccagaaagtccaagattgaacagctgcatctggtgagggcctgaggctgcttcaattcatggtgggaagtggaaggagagtaagcgtgtataaagagatcacatgataagagaggaagcaagacagaaaccgaggaagccagacttttttaaacaacctgctcttttggtaactattccattcccatgagaaggagaactcagtcatctctgaaggaggagcattaatttattcatgagggatctagctccataacccaaatacctcccactaggtcccacctgccaatactgccatgttggggatcaaatttcaacgtgagttttgatgaggacaaaccacatccaaatcatagcaagatatatcacttttttttttttaatccattcaccaattgaagaatgtgaggttatttccattttggggcagttgtgaacaaagtcactattaacctttgtttcataaacttttgtatgaccatagtttttatttctcttgggcaaatacctaggagtggaactgctgggtcatatgttaactgcatatttaactttataagaagcaacccagttctttttctagagtacctgtaccgttttgaaattcctaccagaaattcttgagagttctacttgctctcctcctacccagcatttgctattgtcagttatctttattttagtcattgtaacagatatataatactatctcattgaggtttcaatttatatttctgtaatgaatgatattggccatttttttaatgtgttgatttgccattcatatgtcatctttggtgaagtgtttattcacttcaccaaagaatctgttgtctattttaaaaaatcaaactgttttcttttaataagttctttgaaaaaattatttttaaaaaacatataaacacaaaattatatttattagtaatataaaatatggtataatataataaaaaacaaaaacatggtggcataaaacaatcatttatttgctcttgatttttccaatttgggttaacttcagctaggctttttttctaattataaatagggtcactcatgtggctgcagtcatctggtggcttggttatggttgggcagtccaagatgacctcacttacatatttggcaattaggtcgaccattaactggctcacttccatatttcttttctggaaggatagcccagatttcttacatgatagtgttccaagaggaaaatagcaggaattgcatggcctcttgagactgagcatcagaagtaacacagtgtcaattctgccacattctgttcattgcaagtcaagaggcctacccatattcaaaaatggaagaaatagatactgcatcttggttgatggaactacaaagaatgtgtaaccgcatttaacctaccgttctcaccacagaagggaagttgaatagattggattaggtcaaatcatggtgggcttatatagccagagttatgtatagacccgattgatagataatagagaacaatagttggttttcagcagaggaatgacacagtgaaaatggttgaggaagatttagattttcaggtggatttggtgcatgtgccagattggagttaagatatttcttgggaaactcttaaagtattaatctagataagaggtaatgcaacttacactgaaattaatgattgaatcagttgactttgatgcttaggttttcaacatgcctgtatttagagtttcccagacatctctttctttcttgttcattggtatcatgttagaacacatgtagtgggcctttaaaaaatttagaaattatcactttctcagtccttttatgcttcatgttcgttttgtttcaagtttaataatgtgaaatagctatttgctcacagaatttttgctccttgggacttgaaccagccatgttgcttcctagagttgaaatttaccagaaaacacccagaaaattgttggtttgtgcagaaatccccttgagcagtgaacctcaacctggttggatgtcaatctcatggagttgtaaaatctaaaaagtgcttaattgacaactttccttttaacctaatccttgttattctagggacatttatttttgagaacagaacttaaaaaaattcaaatgtggcttttggccttttggccgattaatagtttttttgtttatttgtttggtctaggaaaggagaagagatttcttctagaatttagatgctagctgtaaaactgtaaatttaaaaaccacaaagaatgtatgattaatttccgattacctgtttttctgagctgtgtgtcatctgccaatacgggttacagacaaagcacaaatcttctggtggaaaaatttgtcccaggcaacagaagtatactgagttgggtagaaaggaaactgaagtggttcttcacaggtcatgttttactgttgtttgagaagattgtgttaaaaagtgggttgcctttgttctagttggttggttggaagattttgctctagaccgtcttctctataactcctagtctctcatataagaagtgtacatatattcttaaagccagtgagatagattggaatgtgtacagcacctgccatctaattataacctttcatgatatctgccttttgctttttcaatcttgtatccattattcctcatgttatcaagaatatcttatttttaagatataatgaaagatactccttccctgagaacattacagtgggaacaacattcctatcctgataggcctgattaagcagatattctctccctggaatttcttgtaactttttaacattttactggattaaatttgctaacattttgttttggattttttctatataaatgagatgtttatttatgatttttccttcttgtgatgtctttcaggttatcaaggtttatgcaggccaattctgttctctggaaaagtttatgtaaagttgatattcattttcttttaaatattataattctaccagtgaagttatctgggcctggagtctttttgtggggaagggtggtggcgaggaaggagaacatatgggaagattttagattctggatttcatctctttaatataaattggactgttcagctctttttttttctcatgtcaattttggtgagacgtgtttttcaaagcatgtgttcattttatcagcatgttcaaatgttctagcttaaaattgttcttagtgccattttattttcttctccatacttgtatatctatagtaatgtctcctttttcattcttaatattggttgtgttttctccttttatcttgctaacagtttatcaatttaatttgctttttcaaagaaccaacctctgtgctttttttttctttattgtatatctgttttctattttattttcttttatgtcctggaaagccttaaatttctctctaagcacagctttcagttgtattccataagttttgatattctatttttgtcattaatttaaaatactttaaaatttgtattgtgattttttttttctatgacccataggttatttagtagttgttacttaatttccaaattgggctattctgtttatctttcagattttgatttctagtttgttcttcaaccagatagaattatattctatatttcagttctttgaaatttatttaatggcttagcaaatgacttatgttgttgaatgcttaagaaacgtgtattctgttgctgagtctgatctagtatatatgtcatttaagttaggttggttaattaagttattcagatttattaatttttataaacactcatattcttttataattggccacatattttttctttctagtgttctttactccttcctgttattcagttctttcatgttgaatcatgttcttcagccttaataatatcctatagtatttatagtgcaggtttgatagcaataaattcagattctcttttttaaaaactttatctttcattttgttagatatttctattgagtgtagaatttactttagcagtaatttttaaaagcatttaaaacatgtcatttcattgattcctgcctttcatagtctctgagaagtctgcaattttaagaagcgtatctttctctttggctgagtttacttttttttttgtctttggtgttaagcacttgactatgagtgcctagatatggctttatttgtttttattcagcttgaagttcactgagctgcttaaatctgggagttgatgtattttatcaattttggaaaaccctcagctactatttcttcaaatactgcttctgaagccattattttttatttttttccttatggaattccaattatatgtattattaaacttatttttatggtatctcacatggctttatgtgtctttcatgatctaatttctctttgcactttattttgtattattttctattgaactggcttccaacttatttcacctgtcttctgttttgttcattgtgccgttaatcacacacagttagtaattttttatattttttgattctagaatactcacttgattctttttgataatttcaaatttctttggaaattctccatttttcatctgtcttgtccatgtttcttttaatttcttaaatagttattctaatataactattatattttctcctaatttctatttcatggatcaccttttggttgatttcttttgatatttattttgattgttagtcaaattttctgcctctttgcatgtctagtgattttaaatttaatatattgtgtataaaggcactgtggaggctacagaggcttttctctgttggagattgggcttaatatttcaatccagtacaatcagtgattgaacatggctgtgttttagttttagtaaaacctagcccactttgtttcttccttgttcctcaggtataattcttctaggctttttattgacaatttggtagatttctcttcagatttgaagtataggacatttcttctgcccttcagaggttttgagctttgctctttggtctcttgctccaggtagcatctaaatttgacatacattgaagagaaaactagctgtgagtttaaggtagacctcaagcaggacttcatcctgtaaatttcgtaagactatgagaaatttcattctgtcttaaaattactgtctagccttggagccatagaatccagcaaatcaatcatggagaaaactggctatgtgtttactgctcttgcagtttccaaattttcacaccactcttctgtgtgatccctacccagaatcagcaaatgcttcccaagtaagaacatagctagttcagcctgctctggaattttagttaatttaatccctcacttccacagctctctaatgcctttaaaaggattatatttgcaagtttttttttttctgggagtggtggggagtgcttattgtcattattacagtgagaatgagaatagggtttgccatgttatactgtattctacttataactacatatactcctacatatactctacctgtattaaaagtggagttcatttatcccagtgttgctgacatacacgatttccattagttcctgtgcctagatctctggagacttcttggttcttgctcttttaatgacctggttcttcaggctttcctttgattcccttttaaccttctattgtataccttaattgtgtggtaaaggaaaggaagagtttaagtggattcaaagtttgtcgtgttaaagtgaattaaatatggtctgagaaggactttgtactctatatttgagtcctagtggacgaactgtaacctaacttaataggtagacaagatcgaaaacctgacttaggagtatgcgcctgtaacaatagctgagtcttgcccaatcccagcagccatatttcaaccattcacacactgctgagcattcagactgtgttcaaataaggcaaatgctgagctgtaaccaatctagttgtttctgtacctcacttctgatttctgtatatcactcccccttttttgtctataaatcttcttccaccatgtggctgcactggagtctttctgaatctgctgtgattctgggtgctgctggattcgtgaatcgttcattgctcaattaaactcctttaaatttaatttggctgaagtttttattttaacagtaactgtcagtaatctttttcaatgactgatataatgaacctgttaggagaaagaccaggatgggatttaggtaggttgaacttgatgtgcttgctgaacctatccaaaagaaagttggaaagtgagtctagaactcaggaaaaaagcccaggtgagagagaaatatgactttgggaatcatgcacatagcagtgattgccagaaaatgtgtggcacaaagtaaaaatttctccatgcacttcagatgatccatagtttccctaaacactgtggacttgcagagaaggaagtgtgggaacagcatcaacatactcttacatacagggcctgcaagaatctcacgtggtaggaaaattcatttttcaaccactacacctgttctatgaatacagcaattggttatgtgtagagaagcatagcatcatatgtatttttacatactattgccattactaggttttattagggacagaaccttggtagaataaaagcacatttagaatataatgctactttcatcatcatttgttatattgtcttaatattcttcacacccaagacttgaatatatatatatatttacatggaagtaaagtttacatggaacaatgccaaggaaggggttttcaggcaacaaaagtattatatcagttgttctatttagaacactgtgttatagcattgttacctgttttttcttgtgtactgaaaagtataaccccacttaaactcaatatatgaaaatctaggtttacacagaagataaaaggtaaaatagtctttataaaatagcagactcttagtgaatttggattcaagatttaacaatccactttgcccatagtcttacaagttttttgtaaatctaggcctaccagtgtataggcacagtgaatggcttataatcctattcataggagagttgcagctcataatcataattttatgacacttttctcaaggtctcatgtggcaccctatcaactagatgttggattgcagtgggaaacaatgcaagaagagctgttagcttgtgcttttactcttagcatctcgattgtcctaacagtaacattagcagcaagcaggaacagcaagacaacaaaaacaacagctgttaatatgtgttactatgtatcaggtcacattctaagctttgtgtatgtatgaactcatttaatccctatagcagccctgtgagtaagtactcacattatccccattttgtagatgtagacagagaagtacagttaaatagcttgctgaaatgtatacaactgtgagtgatgaatgtggagttcatcttgcttcatattccacattcttaatcacgttggtatggtggctctaaaagtcactgctttttccacagaaaatgtgcaacaatccttttttgcctaacaccctttgcgtgttttgtatatgggtccagtagactagaccatagactataatgtacattctctttctaccagattcctttcttccccatttatcattaagcagacttagcaaggaaaattatcagcgataaagatgggtcattctgtagtgataaaggagtaatgaggacataacagtccttaacatgtatgcacataacaacaaagtgtgaaatacctgaggcaaaatatgtgagacaggagaaatagataaattcactattatagctagagacttcagcacctctcttacagtaattgaaagattaagcaggcagaaaatcagtaaagatatagctgatgtgaatagcattttcttcaatcagcttgacctaattgacatttacagaatactgttttcaacaatagcagaatacacatttaccattgaaaacctgtctgtcctgatggactctgatatttggattggggagtttcttgtaaaaggctgtcttgtcataatgaatagggaagtctgtgtatttggagttggctcagtggggagggatagagctgtagaaatttattcttatttatagtatcagctagaagtctatcatgtagagaaacatttcttttcccgttcatttcaagctttgcctgctccccacccacaacaaagatggttcagatggttcagtagaaactggttatgtggaatgtaaggtaagatcatgctttctcattaggagtcataatcactttcctcattcatattaatatattcatatataataccaaaatcaccaccaagaaaagaaaattagagtaaggtaactttcaatatttggaaaataatacatgtgcaagacttctggtgatagctatatgattttgaagagaaagtaaaattttttataaatcaaaaagtataaaccattaatattacaaataggagggaaattgcaaagcttagcgaaaggcactggatagattgtggcatacaaaagggggtccacgttggatgcagtggcacaagcctgtagtcctagctgctaggaaagctgaggcaagaggatcacttgagtccaggagttccaggctattgtacccaatgatcgtgcctgtgaatagccactgtactccagcctgggcaacacagtgagacccccatgtctaaaaaaaaaaaaaaaatagggcgtcaggtttagtgattcattcatttattcttttaattatttattttaggttcattagaactattagagaataaaatgcatctgattgtttatatcttgtctgttaaatggtatttagttatcttttgctgttcaacaaattaccaacctagtggtgtaaaacaacacaaacttactatcacacagtttctgtggattaggagttcttgcacagtttaggtggtgtctctgctttggggtccctcacaaaggtacaaaaggtgttgactgggtctgcagtttatttcaaggctcaattaaagaaggatacagttctaaaatcatgtggttgttggcagaattcacttccttgatattgtttggactaagggcctcagtttcttgctgtctgccagaggctgccctcagttcctttccaagtggacctctccagagggcagctcacaccatagcttgcttcatcaaaaccagcaaggaagagaatctgctagcaagataaagtttcagtctttttaaacacagtcatggaagatacattccatcatctttgcaatattctattgattagagcaaatcacaggtcccatttacacttggggaggcgattttccaaggtcttgaccaccagaagataaaaatcagtgggggcatcctacagtcaaccaccacagcagggatcatgtgtttttaacatgttttattgtgctcgataataacatcaaagttttcattgtgtaccaacactttacataaattatcttattcagaagttaagtgatttgcctcacaccacatagtaagtgctaaaaccagcaagagctcaaagagtctgactctaggtattatagaataatatatttttaattaaacatgaaaagctttaaatggtgcttcttgtctgttttaaaatgttctagaattgaggtgggtagcatttttacagcaataagaatgctaatctggttattaattgttaccacatgatttcagactaaacatttcaatcacagtgaacttcattgtttgtggcgcaatgtcttgcttcccttggttcctagtacaaagattaaaggggcaaataatgagcagattctgtgaaacatatcctctgaggaggaaccataagcatggcttgaaggcagggttgctgaacagatacttcatttattttgttgatgttgcaggattaatattgtatactctttttgtggatgatggctttggttactggattccaaaggccagtattcttttctatgaaatgttttctaattcgtataaagcgaattctttttcctcttcattcctgtattttattttattttattattttatttattaatttattttattttatttcttataatagtctaggagtgcctctggacggctgtgtccaagggtataaatttgcaagtagtaaagaaatttaccattacttaaaaatcatttaccttcgttgtgaagttcctttcctctctctccctcctttcttccttccttttctttctctcttcttccaatttagagtgattacatatggcaagactttaaattattgtactcagggattattttgaacttgcctttaatttcatttatgtgtgactttttcctgtaattatatgtatacagtacatatgtaatctttcatacatgggcattaatttcatagctgtgagtacagaaaatcccattttgataggatatccaaataggatactttttggatagtctgaccttttgctcatttaatgacaagttggttacctctgttcacttagaaccaacctcccttcctccctccctctttccttccttccttccttccttccttccttccttccttccttccttccttccttcctctttttttttttcccccacactcttgctctgtcccccagactggagtgcagcggcacattctctgcttactgcaacctccacctcccgggttcaagcaaatctcccacctcggcctcccgagtagctggaattacaggtgcgcgttgctgtggcctggctaatttttgtatttttagtaaagacgggtttttgccatgttggccaggctgatctcgaactcctggcttcaattgatctgcccgccttggcctccccaagtgctaagattacaagtgtgagccagaagcagatatttttgatgaatactttataattcagttttcaaaatatagataaaaatacaaatggaattagtcaacagttggccgcaagtaagtatagcttttatataaataatcacaactattcaaatgtaaattaaatttgactttctcctcactacaaatccttataatagctcacttgctgtgaatagttgtctgctttttttggtttgcttagctttaacaggggttgacaaactatggccgtgggacaagtctacctttctctgttttttgtttgtttgtttgtttctttttcaatggcttccaggctaagaatggttttacatttttaaatggttggatcaaaaacaaattcaaagcagaacatgtaagaggccatttgtagccacaaaacctacatagtttactctctgaccctttatagaaaaagttgactaacaaggtttgtgtgaaccaggatggtttcattattttcattattaagtcttgtcttttgtagtctctgaattgttaggcatgttacatgttgatatagacatgctctgaaataaaggtccaaatagtaatattattcttaggctcttgttttactgtacatcttttgtacttgtttccgtttttgtttttttttcccaagacagggtcttgctctgtctccaaggctggagtgtagtggtgcaatcatggctcactgcagcttcgatctgctgggctcaagcgatcctcctacttcagcctcccaagtagctgggaacacaggtgtgtgccatgatgcccagcttgctttttttttttttgagacagagtctagcttttgtcgccaggatggagtgtaatggcgcgatctcagctcactgcaacctccacctcccaggttcaagcgattctccttcctctgcctcctgagtagctgggattataggcacgcgtcgccatgcccagctaatttttgtacttttcatagagatggggtttttaccgtgttatctcctgacctcgtgatctgcccacctaggcctcccaaagtgctgggattacaggcatgagccaccacgcctggcctatgcccagctaattaaattttttttttgtagagatggggtctccctatgttgcccagggtggtctcgaactcctgggctctagcagtcctcctgcctcagccttccaaagtgctgggattacagatatgagccattgcgcctggtcttactataaatctttataagcttacattttacctcttatttcttcttgcttttattatatgttcagttattctaatgtgtttgtgtctctgcctcctaagaggcaccttgtatttagtgctgaagtggctcttaggtggaggagatctgatcggttatgcttagaaaggaacaatctagtgaaatgaaaggcctgggcttctcagatttggatttggatcccaagtcgaccacttactaacttagtgatcttaaaaaagtcatgtaagggggctttttgatcttcagtttcttcactttaaaaatggcaataatatctattttgcaataagtttaaaatgagattaaaaaaatagaagatttttgtgtattagtaggtcctcaataaacagatttttagctgctaatggtagctgataatccaaaatgcatgattttacatagttttatagaactcagaatatgttttcattttttctaatgtaaaataattaacacaatggatgagataatttggaaaacttgcacattcttcagaatgattgctcaccctgagataaatcacttaacctctttgggtctaggatctacaattgtaggaaaagtagattggggtaggtgatcacattcaataaatgtatttattgaaacagaatagttaaatatatactaggttaaatagaagcatagaatgggctttatttctcataattcttctctcataactggacaatatgatttttaaaactgatgcttctaaatatgggaattataattgcccaccctgagctttatttagaatatagaaattttaattattcattatcactacccagacctctagggaagaacacaccattcttggagaaaggtgtcacatgaaaaaacatcttaaataactaaattgtaaaaatttaaactttgtatttgaatttttttctcccgtatataaatgctacataggcaaagtaaattttcattaaatattttatttaatataatgtatgaatagttgagctgagggacttgattaaacattctttatattttattcttttacccgactatactgagctgatgatgacttcaataacttcttgataattgaagataaataatagcaggaaatacagtcattgtggcatattgatttcagtatcacttgatttatagatgacacatctgctacaaagtctttagaaaaaaataccctgggctatttcttacgtttctttcaggcaaatttgtatttcagtatgaagatttattttgtttttgaaattgttatattgacgtcttttaattcatttagctcaagcttgtccaactcgcatgtggcccaggacagctttgaatgcagcccaacacaaattcgtaaactttcttaaaacgttatgagattttgttgcgatttgttttttaagcttatcagctattgttagtgtattttatgtgtggcccaagacaattcttcttcttctaatgtggcccagggaagccaaaagattggacacccctgatttagataacataatgaaataaaatggttgtttagtttggagatcagtattctaggcaaagctgtctgaaggagaacaaatataaatagatttcaatatatgtattagagctagcctgtgaattacaatggctacaaggaaatataatgtaaaatagcacactatgcttttcttgttattgttgcttgttcaaatagaatgaatttgattttaacatagtctttctgttcttttttaaaaaaatgtatgcaaaagctgttgcttggcgggggtattttacatcagaaatgcttaagagattgtaataaggttggtgaaaaactgaggtacatttaatgaatatggaatgctatatctgcaaataaagacaaaagggactttcaaaagtgtaatttaatgttaattctcagttttacttaatagcacttcagaaatattatctattttaccatttgttatgtgcagaagctaagagacttatttttctgcaggtcagtggcagaagaagaaataaaaatcttccaaagaattatgaagttgtatctgattttcagtgtactgccaacactgtcctcttttatacttttaagtttcccttccttttagaattaattcaggacagtatggtttattagcctatagataatgacagaatatccaattttatattacagttacttttggcatttgttttgtgtgatcagagatccccatgtaacagtattgaaaatggccacttgaatcattacatctttgttatatggatatatctgtataagcatatagagaccttgtttaatatttattgagattaaccataatgataggttagtgtcttataaataagtagaaatgccacattaaacacaagtttgctagattaggtaattgctgtatttcatgtgggtcatgggtctctgggaagaaaccacatactgtaagttaaaattaagtccccagtttatttgatcagtaatacaaaagcttattggacatggtaatgccatatggagtagaaatagatatagtatatctaaaaatagcttcctgtggtcctttagagtccccagtggggtcataaactgcctgtgcagttgtccacacaaggtaacatcttgccagatctaagctgatttcttgctatgccgtaatccttttatacctggagctgatgtcacctttctacaagaatatgcacaatttatgcacttccatttaaaggaatgtgtacaagcttctaggatctattagttcttaaaccaaacctgtgtcagtaataccctattctgatccttgagaagaaagcaaaagtcatttcaaggtatctcaataataaatacacctttggcttccctgcactatgggaagtgcatctcttcaaaatactgatagtgctatattttatatatatatatatatatagtcatgcattgcttaagggcgggattacattctgagaaatacgtcattaggtgatttttgtggctgtatgaacatcatagagtatacttacatcatagagtgtagtaggctagtgtgtactacatacctagggtatatgatataggctattgctcctaggctacaaacttgtacagcatgttgctgtactgaatactgtaggcagttgtaacacgatggttaagtatttgtgtaaacatatctaaacatagaaaaggtacagtaaaaatataatcttgtgggcctactgttatatatgcggtccattgttatgtggtgcatgactaaatatatatatatgtgtatataatactgtatataatacatatatatgtattttctatcttgtagaaaatacatgttatgtgtgcgtgtatataacacactatgtatacacagacacgcacatacaaacacacatggaagtttgttgaaaaccagcaagttggttgatcactcattattatttgattgtttttgataggtattggtagcttccaataactagaggtcagtgaaaaatataggcttcctcccccataattctgctaacatttaatatgttacagtgaagacaagactcaaaatggggaagttcatactctgtctttttaggtgttcctgcaatatcttatatgaaagattatcttgagaaagttgtgaccttattccaacaacaggatttgatcatccttctgttcaggcatcagataataatctgaatcagcccctagacacagtgtggattggaatctaagcctagagcatcattccaaagagtattggctactggatttactaaatacttacatattgttctcaaagttggtagtgcttctgtaatatttctaggtatttcacataagttaattttacccagcaaaatactatttctagagtccatttagcttacaataaacttgctggtttttataggaaataaagcttactgaacagcttgatattgctgctgcctttgggatgtaggtgtttgatgatgtaatagttaattaatcctgaagtgttaattcccagacctactgagtcataaactctggtgatgaggctcagtagtctgtattttaacaagctctcaatgtgcatctgatgcacactaaaatttgagaaccactgtcctaaagtacaataacattttgatatttaaattaccgacagagaaaattcataacagaataagaagactaacaatgagtcatctttgggattttattataaccagttagtctcaggtacctggtatttacccgtgaagtaaacatttattatatcttgtgtcctgttaagtatagcacataatgcattatgatgggactgaggttcagttcaaaaactattcagcaccttctatttattcattttaggatactgctgcttttgtaagacttaactcatttatacagccagagcttttagtcacagcaagagccttgaaagaagaatgtaaatagaatattgctatgcatgtttgtgtcaaaggatataaactgacacatgtaaattttaaatataatttactttatccattccagtcgtgtccagttaaaacctactggaatctttttttttcatagtttatccatgtatgatacgtgagtttgtatattttattattaatggatgtcaaccatttttaccttttttgttctacccataattttcttcctcgaatgatgccactattgccaaattagcaagaagatatttatgacttttctgttttctaagaggacttttgcatattcacatataaattgtggtttaagaaagatacacattgacattttgacagattttaattttcttaggcttggcaggatacaactactttgtctgttacatctggatgagaccattagaatcttgttgctataactgtaagtcatggtgttgaatttgcctttgcggtatagaaaatagagcagtgtacttgaatatactctgcagcatagagacatagcgtgaaaggagcataagtgtcacatgatgagttgagctagcatttttttcttccatccaattaaaataatatataaggtcatgaatatccagttatggttgtatatccatattctatttgtgatgaacacatgatttcttccattttaaatttatatattttttttcctggaagtgttatactattctgaaatattttgatataagaatatatttacttcattatttttagacaaatttataatgttggcgtttcgtgatctctgttcacctcattaatgtttactcttaatactttctaatttgcatcctaaacttaagcctttatgctgaacaacccactatgcttcatgtctgtgcctttacacattttactattttactgattcagccccatccccagctgtcctaagtatttttagtaagtgttggtggttctttaaaattcaacctaagcgtgtcttcttctgagaatcctttcttgacctcattcatctgaattaggtgccctttctatatgttcacccagcagccatggcctgctcctgtcattgtactctccacagtttgataacttttagtgcatttgtcttttagctgaatcttaagtgagtattttgatggaatggattatatcttattcatccttgtatcatagtgtttagaatctggcgtctttaataaagtgaattaaatgctcattgaatgaatgaatgaatgaatgagcccagttgatttggggaacattgtacctgattaaaaaatcattctttgtattctcaggagataacggtcatcttagacatgctgatctatgcctgttatatctttgatcccacttattacttagtccagtacctctggcatagtgaatgctgcatgaatggattggaattaagggctgtattttatataaatcataaacattttcttctgtagatttaattattttataattaaaacttaacatctttagatgccatctttttttagaaaaagattttattgatctgccttttaccactttgatcaaagtacaccttttgggtttcatggttttatttctttttcttttgtttttttctttttagacaagatctcactctgttacccaggctgagtgcagtggtgtaatcactagcatgctcactgcagcctcaaccacctgggctcaagtgatcctcttggttcagcctcccaagccagctgagaccacaggcacatgccatcaggcctggcaaatttttgggtttcattacatttgactttttgttgttgttgtccagccatagaattcttgtcaatattatatagtagtttcctctgaaattttgcattttcatgtcattgtgaaaggtattagagataatattttttgtaggtcaggccacaatcacagttatcactgtgataaaataaaaaaatgtacactgccattcataaccaacaggaagatctggtaaaactctgataagtaccttatgggctctaggcaacataagcgacatttaatttatttagattgctgaaaataataagcaaaaaaaaaaaagaatgctgagtcaaatgcaattaatttagcatctatagtaacttggttttagtgattttaatgattaattagaaagtgcatagaagctgtgaagctgtttgctcttcccaaccctatattttgatattaaggatctcatctttgttgtgtagaataggcaaatatttaggaagacagcaatttatttccattaaaatatccgaattagccagctaagagtctttgtttactttttttgtgagatggagtctcgctcattcacccaggctgaagtgcatgggtataatctcagctcactgcgagctctgcctctccggttcacaccattctcctgcctcagcttcccgagtagctgggactacaggcgcgtgctaccacgcctggctaattttttgtatttttagtagagatggggtttcaacagctaggaaggtctcaatctcctgaccttgtgatccgcccgcctctacctccacctcccaaagtgctgagattacaggtgggagccaccacgcccagcctttttttttttttttgagacagagtttcactcttgtcgcccaagctggagtgcagtggtgcgatcttggctcactgcaaactccgcctcccagattcaagcgattctcctgcctcagtcccctgagtagctgggattataggcggccaccaccacacctagctaattttttgtatttttagtagagacggggtttcgccatgttggccaggctggtctcgaactcctgacctcaggtcatctgcccgcctcggcctcccaaagggctgggattacaagcatgagcctccgcgcccagtctgtttacttcttaacatcaaactttgaaactccttatttaaaagattaaagaaagtgaattactgtctatcactgttgctgtttgcttattagggatataaaaaatgggataaagatagaaatataatagatcaggtggtaacagaaggaagtagagaaattcaagagattgaagacatgtagattcagagtcaagttctaatattttaatgcatcttctgtgttaggatctaagtactttcacatatattacttgtaatttaatatcaagtgaaaattagtttgttttgccttaggttcttctttgtcatctttcagtacttaactccttagtttgtgtatgtttgtatttggcatccagtttgtaagacttcatccattcacgtagtccttcattcaggctttgtagtcagacagatctaatttatattctatattggctgtgacaatttcttaaaataagacaatagtacgtattgcattttggaaatatatataacctataattattttaacagatattcctaattgtttatacatttcttgattaaactaatttatttacaaacagatctgtttcatttgcctcccaactcaactgttaggatgtttgctcctgcacgctttcatgggtttgcatttgccccctccccattttataattctctaacctacagaatgattgatttctatattatttatttattttaatttttaaattaagttttctttaaaggcagggtttcactctgctgtccaggctggaatgcagtggcatggacatggctcactgcagcctcctgggctcaagtgctcctcccacctcagcctcccaagcagctggaggacaggcattgagccaccatggctggctaatttttaaattttttgtacaggcaggatcttgccatgttgctcaggctggtctcaaagtgctagtctcaagcagtcctcccaacgtggcctcccagagttttgggattacaggtgtgagtcactgcacccagctggaatgattgatttgaaatgatagccagtgtaaagttctgtctatataaataatatgaaatgacaggaagtaacataaacatgtacttctaaaagtatggatattttaagctgtttgttcttttgatgcaactatgattacttgtgttttaaaatatacttttagacaaggaataaaaaaagtaaatataaatgctttttcataaattgttaaacaacagtgaagattggaaattggtgggcatgtctaattagcatagtttccttcggaaatattggcgtttgatttcctcaaagctgacacaactcagcatgtggaagtcaggctgccttgccccagaaggaaacttgctgcatggtgccttgtaacataattactgaaacagtaagcaaagtagtagaaatagcaagggatggaaacagttcctaaaaattaaatattgagactgaagaaagacttgacataatcagagagaatatggacaagcaagagattaaaacatagagaatgaaatagatatggataaccagtaaagatctagcattaaaataattgcatagagaatagaaaatatggaagagaaaaattattcaaaataataaagacactttccctgaaaaggagaaacacatcctcaggtcaaaatgatattttgggtcctgtgaattttgattgcttgacatatctaggttaaatgataaaaccgatatttctccaggtatccagaaagaagaatatatcatttcaaagagggggaaatcaggctcttgctaaatttcttcctaggaacagtcagtgctggagatgaatgtagcaatctttttacatttctgaaataaagaaaatgtgatctaggaatgcagttcttagctaagacaccagccaagtatagattcaataggcaggcattcccaaataccctcagtctctcttgaaaaatatatcatttaattaggatattgagccatttaaaagataaattgataaaattggcagtaacatcatttaatatgaaatgctagacatttatgtaagttatgattttggaatctaatgtatttgatataaagtttaaccgtgaagaatagcatgccaacaaaatttggagttggaagtattttcatgtttctgttaataacatctaaaatttaaaatataaagacattagtccagtatattaatgtttttgacagttttttaaccttagatctttttaaaaatatccatttgaaattgaggaactcatgcattttcactgaatttgtgcttctatcaaataaaagtaaaattaaatgtactatattttaaaaggacaaataatttcctctaattttgtaaaagctttttaacctattttgacatatttgaggggttttcccccctacacgttttcatctctgtaattcttttaaagagtatgtgctgggcgctgtggctcacgcctgtaatcccagcactttgggaggccgaggcgggtggatcacgaggtcaggagatcgagaccatcctggctaacacggtgaaaccccatctctattaaaaatacaaaaaagtcagccgggcatggtggcagatgcctgtagtcccagctactcgggatgctgaggcaggggaatggtgtgaacccgggaggcggagcttgcaatgagctgaaatcgtgccactgcactccagcctgggcgacagagcgagactctgtctcaaaaaaaaaaaaaacaaaaaaaactaatttttacaaaaataggaaatatttgtatatttaggaaaacgttattcactgcaaaagaatttttatgtattcaggaaatagttatgatcctcacagatgagaaaaagtgaagttcagaaatgatatgacttaagtcaaatatttagttaattttataagcaggccaatagtccaagtcttttgaatctttggtaactgatctgttactgcgttacacaagtgataatatttaggaattaatatatttctagagcagtgccatatgtagccacagtgtgtcacaaagagaacaaatagtatgtgtgtgtataggctgaaaaattttaccaagacaaacgtctgtatagtacctgtgctattaatattttatgaataaaattatattgtctaggtaacttttaggcataaagatggcaacacagtggatctgtgagattcaggacactgaatctaaaagtccacttggactattaaaatattgctaaatatgaatatttctggggcttagagttgcacaattactttgaatgtatgcatgcctgattttataaaggcaaatgcatccatgtattagttgtgtggttggtagtcagtctgaattaatgacaaatgtgaattctgtaacatttgatgataaatacagctttattgctttcaggttcatgtaaaccaaagtaaatctttactgtttccaagttgacagcccactgaatctgatataattaatagatgatggtaattggtaaatagtgccatccatttttactgataattaatgtattcacttgtgttctgaagaaatttgtttttaaaacactgccaccaacctttaccccagcaaatatttacagaatttacttttaaaacaaacattattttagagtttaagaaaactgacactacctactgttctagcttaattttccactactcctccttccaccttaacctcccttttcatcttcatttcctgttctcccctgtaccctatgctctagccatataaaataagttcatttttactgaatgtggcatgctctttcacacttcttttcctttgcacatgctcttccttctgtttgaaatgtcttttccttcatcccccaacagacttttccttgacatggttcactatggctatccttttaaagttcttaattataccaggcattatttatctcttcttgctatggtctaaactctcataccaaattatcgctgttattacatgtgctgcaatttgtaatttgtgtctgacttttccacaaattatgaatctgacatttccagattgtaaaatatttgaggatagtggctgtgtttgtttcatgtttgtgtgcttaagtacttggcatgtaacaagtacttggcaattttttaaaaatgagttgtgactcttagtcctgcagagatcatattactgtggtcccctttatccatggttttgctttctgcagtttcagtatacacagtcaactgtggtctgaaaataagattttgagagagagagaatgcaagagaaagaccacattcacctaacatttattacattatcttgttataattgttctattttattattattcttgttaatctcttagctgtgcctaatttataaagtaaacgttataataagtatatatgtctaggagaaaacagtgtatataggatttagtactatctgcaattcaggcatccactaggggtcttggaacagtatccccacaaataagagggaactactatgtcacattttccttttctttctcagcccctttatttcgctcctttttcttgtcgctctcaatctcttttactttcctcctctttcccctactccctccttttcaactttgttcttttcttcagtgttacacaaaagacagacatttttagaagtgtttgccaggaaaagagtgttataaaatccaccaatgggtactgcttctttgtttttacatgtaatctaggtagatttatttatgatgaaatatttagaaaaggaatactgatttcagtagaaacttctcttttaaatgtcaaaatctacaatagcattatttaatgaaactcacatagaagaaataaaggatcatgggcctatgtaaacttgaaaataagaacttggcatagagacttagaattctatagagaacaccatggcacttcccagacctttgctttgatattcaccctttgcttgtcaagggccttgccttaaatcttttttttttttttttttttttgagatggaatctcgctctgtcgcccaggctggagtgcagtggcgcaatttcagctaactgcaagctctgcctcccgggttcacaccattctcctgcctcagcctcccgagtagctgggactacaggcgcccgccaccacgcctggctaacttttttgtatttttagtagagacggggtttcaccgtgttagccaggatggtctcgatctcctgacctcgtgatctgcccgcctcggcctcccaaagtgctgggattacaggcctgagccaccgtgcccagcttgtcttaaatgttttgactcagactggttcaacttcactcactcagtttaaagacctctcttctcatttctttctcttcacagtaataaacttactttaattaaatttttgacacaacaagagattttcattttttaaaagatgatgcatagacatggtaaaccatccaaagagtacaaaaggggtatacattggcatgatatttctgccacaaacccaacccctcagtttctctttctagaggtaacatcttctattagtttcttctgcttcctttcaaagatatcctccctatcttaggggaaagaaacagaaagatacgacataccaatgggtaacaccatctgttggagtaatttcctagcattttttttgttgagagctctgattacttgattttgtccttataagttaacattttttttcttcataaccttgcacaaaataagaatcatttgatgaccatgagttcatggcagaaaattgagtattttaataaccgtttgaaacaggaaaagcattgattggttctcagtctttggaattagaaactttgcaatgagtatgttttcacccagcatatccagttcatttatcacatggtataaaaagaaactcacatggaaggggatgagtttatgctgaaatccaaacatcttgacttaacctgcagaattgtttttatgtctttgcatcatggagtcaaagaataggtaccattggaaaaatcccttaagatgtctctctgtttctcctcttgaccaaactgggggggaataataataatgaaaaaggtttaattgcctagatgggagcctggtagaacccaatgtgtcattcatctgttacctaaatgtggattagtatctggaatacattaggtaagaatcacaatatagggtaattctcacctccatagaaaataaagggttctaaaacactaccacataacttaagggttcagtaactcagagaaatcctgcataaacgattgtttttctagtctcctggtatttgttggaaataggtttcatacttcaaggtgatacatgtctaagggcaaaggatagtagtattctttcaccttctggcactccatctccctggataaaattctccatggggaaaataggtggtggtatttctgtactttgggaattttagacatttgtcatttcattgttggggaaaaacaacatttctggttttgacttggcaaaatgttatggccttcagtttgtgttcttttacctatagtttatttgaaaaatacacatacacacataaaacatacatttttctacagtaatggaagaaaacagaaactactttgtcgacattttggaaacaaagcctagaagtatttgtgcaaaaggttaattcctccttcacacaaagaatagtgtgaatacatttaagttatttaaatgaatgtgaagttagtttaaaatttttccattttaatatggagaaactcggatttacttttggagttggtattaatggtctatatgggtttctcttggcctatcacttgtcattgttttcaataaaaggcaaaaagcagttgttcaggtttagactgaagtatttaagaacatgaaaggggcatgagattctacttctgaaagcttatgatacattatatctttgaaattcaactcccttgttctgacaagtatgttacacatcagccaggcagcaagataatatacaagaaaaatccaagtctttctttgaaaggattaaccttcagttggtaacttacctccctggggttttgtgtagcttaattagcattggcaaagcagcttgatactgttggatgaaaggcaggtaagttattagaggtaagatagagttatgattgtgattttgcaaacagataatcatttttttcattggtgacatgaggggaagctgaggaggatctttatcttgggtcttaatctcaggtagtatagtttgaagctagaatgctttatgaaggagctccatgtttaatatctcagctgaaaattagttgttgcctttctcttaaagtattgtggcatgtaaaccaagagaaatgtgcactattgaagcattgaagcaggctttttttttttttttggtgtatgtcatatataatctagtaacagcatactttacttatgtgattaacaccacaggcaagtcacatactgtaacaatttgcatgagatggttgtaactaaaaaacatgtaaactctattgcaagatacttaaaaaaaactgggaataaacaaaaggacattgcttctagatctcacctagttcttcagaaagtttcttattaactgagggattaattatgaagatttttctgcgactttgcatatgcagctgtatatacaattgtttttttgtcagcttcatttttaaaacaggcactaaatccctttggatatatatgagagctttcactttggttttgtgttataattgttcctctggtgtaaagtagttcatgaaaaaatggttgagtgcgacttgaaataaagtatatttaaattctagacaaaagaatgactagatttgagtggtgggggagaactgacctattatctattttttttccttcattcaagcataagtggcttcctatagaggaattaattgtgttctctcagagaatacctaagtggtgaggtctgcttgctagctagctagctacctacgtacctacctaccttcctatctatctgtattagatagatagatatattaaaggagctgttcaaacttcagcctttggtggaaggcaaaagaagactctaccagaggacctgatactaagcttacatttaagggattttattcttttgagtaaatagcctagttctgtctaatgatactaaaagatatttcattctgagtaggacagtttatcttctagaacatccttagaagttttcatgcatattcaatctccttttcccctttaaataatccctattgatctgcagtctgttgagttattgaaactttatttgaacctgaatgtgttgtcagcattgggaacaatgcatctcatgtatttctgtcttttgtggaagatactcctctcttctacttgttgggaaactagtatcttgagtcattctttaatgcatctttcattcaatagacatttcttggacactcactatatgtcagcatctgggctggaccaaggcatgttctatacatggtattggtatggttttggtaatctggtaatttcttttgcattttcttcacatcctctgagatcatgtaatgtatccagtttaatttctttctataatactagtctttaggcaattggtcagtccttctaggctctaatgatgtttataatccccaacataattctataggatttccagtgtaatcctagattattgattttaccttattttctgaattatttccttgaatcactgtaaaacataatcacttgcacctcactccttttttgaatctttatgtgtcaatacttgtatgccttttacttaaagtgataaagagtagtttaatagttgtaataaagaataatataacttaaatgaatattaaagttaagaggggaatctactgcattcattttgaaataggaaaaattgcaatagcaatcaaaccagattttcttttgttcttgaaatgttcaaaatttgtcatgaacattatagattctgtgtttcatagtgtatagatacagattaatattgtctgtagaatacccatgtaagggaatgtgatattaatacagaaattaaaatagccgtaaaatgatgagcttctctaaggtgcgctcttcttttttcttttcttttcttttttttttttgagacagagttttgttctttttgcccaggctggagtgcaatggcactatctcggctcaccacaacctctgcctcctgggttcaagagattctcctgcctcagccttcccgagtagctgggattacaggcatgcgcctccacacccagctaattttgtatttttaatagagatggggtttctccatgttggtcaagctggtcttgaactcccaacctcaggtgatccacctgccttggcctcccaaagtgctgggattacaggcatgcaccaccacacctggctaattttgtatttttagtagagatgggattttgccctgttggtcaggctggtctcaaactcctgacctcaggtgatctgcccaccttggcctcccaaagtgctgggattacaggaatgagccactgctcccggcctaagatgtgctttctaacaaatttcacagtgccagatttgacttttagtaaatctgcattaaaactagtcagaaaataattagtgaaaaactgatgcaggatattttcttgacccctttgtggggtgtatgacaggggtgcctcgtttactcagcctgccccgcttaaccccttgtgggagggagagagtgtgcaaacgagtacaggaacccaactgcaggaactggccaggggcccggcagtttacttgggtaaacttactatttactttggtctgcctggctccacccctcgcaggagggagcatgcaagtgagtgagtgcagggactgccagctgcttcagcgatgacaggagtaaactcccttcaggccctgtggcagcatccaggtaggggtttctacgaccccaaggccccagggggtatgttgcaatgctgtcttagctccattgtctgcagacatcagtgtgttatcagctcagtgtgtcctttgcctcattgcattgggtggctgccctctgccagtgagggcagagggccagtatgacagactttttgggtaccggcatgtggtacatcccaaattcttgtctggtgcccaagagaaatgaggtcatgcagatgaactgaaggatggtgaatatagagaattttattgagtcgtgaaagcagttctcagtggagaggggagcgagaaagggagcgggaagggcaggttgctctcccctgaagtcaagccacctctctgcctctctcttctgaagtcaagttgcctcatccagccggtgtctctgaagttaagtcctctctctttgatatccagccacttctcccctctgccggctgagtctggggtctttataggcacagaatgggggttgggacgggccataggtagttttggaaaaggcagcattcgattggtaaaaagatattattgagaaacaaccaattgggagagagcgggcacacagggatggaagttttcactttgggccaccgatttcagacttttccactcgaagttgggattttgccagtgacttgcccctgtctgcctagagtgtctctgcctcctctgcctcctgttgctgtcaaaaccactttcaaatgtgtattcttaaagtttcatcttatgcattagaatatttaatctttgataatggcatttatctggcaccttatatttactgtatttattaattattgattcctgagtctcctgaaagtgtctggatatggttaatatgagaggatgtaataatcagaatgccgttaactagcataatttcaaaaatattttcttgaaccctgttgtgtctatttgactattttaatatgaactaaaaatgttagcatttcttatttgaggtgaaattataaagaaaatttgtttccagggttcacttcatcctccttaaaagtaaagtattttgtttcctcactctcatgttatatacctcagtctggattagaactaaaaccacttacttgattttgagaagaaagttcacttcgaattaagtagaattgacatatattccttatattctttatcaaataacttgacgatttatcttctacaccattctcttttttttttttttttttttttttgagacggagtctctctctgtcacccaggctggagtgcagtggtgggatctcggctcactgcaagctccgcctcccgggttcatgctgttctcctgcctcagcctccagagtagctggtattacaggcacccgccaccacccctggctaatttttttgtatttttagtagagacggggtttcaccgtgttagccaggatggtctcaatctcctgaccttgtgatctgcccacctcagcttcccaaagtgctgggattacaggcgtgagccaccacgcgcggcccacaccatcctcttatattatttctagcctaaaacattctgctgtggctgataaacagttactatgactacctttgtttttgaaagtatcaggataaatagtatcacctgggctaggaaatataaatttatctaataacagtagaaatgaagtttgtagaatgacctgacaaactggtaatctggattctaaaacctttggcagtagaattgaagattaatttttgtcctcttcaggctctgtggggtttttttacccttttggaatgattattttaactgggttagagaaagtatacacagagatgaacacatgcacatacatatgcaaaatgaaaagttgtaattttgatgtgttttgattttaaatatagatttgctataataaaaactacatctttttatttggatgtgagtgtgtatagtttgaagattaaacatacttattaatcattgctttgacagcagcaatattcacttagaactcttgatattatcatataattttatagtattctttccaaaattgttaattcatttatagcagttatccaaaccattgttctgtaggaggactgtcttcctttcttacatgatcagctattttaatgttactgaagtttttaagagccatctttctttcattcttcaggtttttgaaggagatgatggtatggatttgcagaatagttaggggagttacttattttttagataattttcaaccaatacctttagggtagcataagaagaaaccaaatatacaaatatccaacctcaagaatatcaactacagaattctttgatgatataacacttttttttttaaatgaaatcatagtttaaaatgcatggttgttttctctcataggacttgctatattctagtcttttgagttttccaagcatggtctatctaaacacttactgtgatatgtagaattttcttaaattttgtctagactgtagacatcctagttagctcagcagcataattcgtaagaggaagctgttatcatattccttataatccttttaaaatttgagggctataccataaaattgtttaccagtaatctgtgctgttccacaatagaacacaataaataattttgataggtaacatttattgagcccctactgttttggaacatttagtcctcaaaataagtctttatggtactattgttattttcatagtacagataaggaaacagagcttagaaaggttaaataacttgcccagagtcacacagctaggaaaagttaagagtcacacagtaagactcttactaaagtctgtcttcctgtaaaaactatagtttaaatctctatattatttttctggataatgcagctaaccagcattttaaaaggcgctgatttgaatgagcttttcagtgatggtggtggattaatctgatttatccacactatcaggccgggtgcgatggctcacgcctgtaatcccagcactttgggaggccgaggcgggtggatcacgaggtcaggagatcgagaccatcctggctagtgaaaccccgtctctactaaaaatacaaaaaattagccgggcatggtggtgggcacctgtagtcctagctactcgggaggctgaggcaggagaatggtgtgaacccgggaggcggagtttgcagtgagccgagatcgcaccactgcactccagcctgggcgatagagcgagactctgtctaaaaaaaaaaaaacataaataaaagaagaagaatggtgcatatcacagaatggcttgtcttggagtaaagtccatgatagtgtaacagaattttttttttggaggcttggaaactctaaacatctgttatacaacattgaggacagtagctctagtagcactgactaatatggacaactaaatcagtttaacattgagccaggtatttgtgactcaggccatctcacagtgaatttgttcttaatatgttttaatttaagctgttggccaggcgtggtggctcatgcctgtaatcccagcactttgggaggctgaggcgagaggattgcttgagcgcaggagttggaaaccagtctgggctacatagtgagaccttgtctctacagaaaataaaaaatacaattagctgggcatggtggcgtacacatgtagttcccagctactctggaagctgaggtaagaggacagcttgagcccaggaagtcaaggctacacagtaagctgtatttgcaccagcgtgggcaacggaaagagaccctgtctcaaaaattttattattctattatgtaacagtcatacagtttggctgtatttactaaaaaaaaattttttttttccgagacgggagtcttgctctgttgcccgggctggagtgtagtggcgtgatctcagctcactgcaacctctgccacccaggttcaagtgattctcctgcctcagcctcccaagtagctgggattacagatgcacgccaccacccccagctaagttttgtgtttttaatagagacggggtttcgccatattggccaggctggtctcgaactcctgaccttgtgatccacccgcctcggcctcccaaagtgctaggattgcaggcgtgagccactgcgcctggccacagtttttttattctgttaaataatagtgatgtggtttggctctatttactatgtatacatctatttactaatttagctttgagtgttttttgatagagatctttttctcatttctccagttcaacttcattttaattactgaattatggaggaaaataatgtgttttcatagtagtataattactattccaaaggctgaaatattattggaagatatattttatttagaagttaagtaaaaatttacaaatactttgatggttcttggaacatattttttttcccctgaggtcgagtctctgtctgttgccaggctggagtgcagtggcacaatcttggctcagtgcaacctctgtctctggggttcaagcgattcccctgcctcaccctcctcagtagctgggactacaggcatgcaccaccacgcctggctaattttttgtattttagtaaagatggggtttcaccacgtcagccaggatggtctcgatctcctgacctcgtgatctgcccaccttggcctcccaaagtgctgggattacaggtgtgagtcaccacgcctggcccagaacattttttaataagtctctgaacataaaatttaatttctgcctgagccttgtttcctaccttataaatgagaaataagcaaacacagactcagtcatcagctttaaagtaaacaaaaaaaatattttcagaatatggtatcagtatcaggcatataaataagataatcatttttctgaaaagaaagaggagaaaactaaaactcattgagcattaccatgtttccccccatctccctatacttctaacagtggttcacctcttcttcatctttattgtaaagcatttcttaaaaattgaagaagtgcttgaaaggaggcaaaagttcctttttgaaaattgatttatttcttggtttggttatgagtatttttagaaatattttaaattcttactcatgctagggaatggctggtacaggatgataggcaagctgctttagtttggacctatgtcatataaaggccttacagctctgtttcaggaagcccatacttagattccaggatacattcctgggccagacatctagagatactctttggtatgcaaggtttacaagtctgttttcaacattttgtcctaagtgttctgcttcacttcataaactagtaattgcagtgttattatcatttaccctacctttgaaccttatatttaaaagacttacagtagtgtgaattggcacataaccaaggtctttccatttcttaataaagccattaactactttctttatttggaaaaagagatttacaataatcgttaattttattaggtctgcttaatacatatgctctaacaaaaattcagtaatctgctgtaaatccagtgccataagatattttcaccaaagattcttgctcttttgagtacatgaagaaaattaaatgttactgttgagagaaatgtcattgtagtctagaaaattttttcagaaaaccgatagattttaatagtagagtaacttgataaacaggattagtattgtacactttagccaagtaaacgtagaataatgtgtctaaattccccacaacaatccatttctttctttaaagatactcatctcttaatgcaaaacctgtttgtaaaagatgtgtcaattggattttccatttacttgtatttcagtttacaaatgctctattttcacttcactgattactttagctggttatatgacagagctttgttattttgtcctgcctttaccacttcatacttctttttcctcctagctctaagtagtcagtgatttgtttgtgttacttcatgtatgcaaaaaatattaatgaagcaactactatgtgtcgtgagaatgtgtcatgtgctaggtatagaatagtgccctcacagatttgaatgtagcgggatagagtgacaaataagcgcttacattaaataagtggttatagaaacaacttacatttaaatatcagtaggggatgggttaagagatgatgatgtctccatgggatgaatattttgcagctgttaaaatatataaaacatttgtaaaaaatatgcataagacgatatttgtagtaacatgggtttcatggggactagacttgttattatgtataatcttgtaccttaaaaaatttattcacatattttcagctaaactctaataagatttaaagaaaatttgcagcatatggaatgagcaaataagtaagcaattacatttccatttaaaaaatctggagataaaacattgaattattaatcactcattgccctgatttgtacattttctccaaattgccttcttttaacacatttgaagtgagcacagacaactattcgttctacattgttctgttgttggctgctggatgatgcaacagtagtctagtatacacttgtcaaagtaaatatggacacggatttccttggagaattgagccagaaacctttttaatgttgatatcatagtatcttagagctgaatttagatacagattatcatatgtgattattctgttaaaactgagattgtcgcttgtcccttttaccccttcttggtttgtgtgtgagtctgaaagttatagtaaattttgaaaattataaataaataaattcacacttttgcacattaggtaaaatggatatgtatagtcattagaagctgtttatttgaataaagtgatattttctttcaatagtggaactggcttctccatgtatcgaatttgacaaactcttataaagcttgacatttgaataaatacaattatttgttgtgcttttgctgggaatatttcagtcctatgggtgaccacttaaaattccaaccaaaacaaacaaaactgcatatctataatttactgagtataactctacctttcagccatattagtttatatttagaagtggtccgaattatgttaatcttagtagtttgttgatataatgccactattacagattttctttatagattgtttaaaaaattttttcttattatcatgtgaaacaaaatgatgttattttagcagctgaactactatgtaaccatgactaaaaatttagtaggtgataggcaacggtgttggttaatttcttctgaataaaagacatgctatataatatttttacagtaatattctaatagtgtattactatatgatgccagaagatcagaatcaaatatcattaatgatgagcaactacttattttttatctaattttattaacgcgtttctgctgttaaagagtacttcaaatatatatgtaaagctcagaaaataatataaccccatgtatttcactcagattgaacaagtattgatattttgccatatttgcttcagattgctagaataaaatacagatgtaaccttttttttatcttttgaagttttgatggtttttaaaaaaattttttttatatccgtaagtttttggaggacaggtggtattccgttatataagttcttcagtggtgatttgtgagattttgatacactcatcacccgagcagtatacgctgaacccaatttgtagtgttttatccctcacctccttcccaccatttcccccgagtccccaaagtccgtcgtatccttcctatgcctttgtatcctcatagcttagctcccacttatgagtgagaacataggatgtttggttttccatttctgagttacttcacttaggataatagtctccagttccatctaggatgctgcaaatgccattaaattcattcattttcatggccgagtagcgttccatctctcacacacacacacacacacacacacacacacacacacacacacacacacacacacacacagtttctttatccactcattgattgatgggcatttggttccacatttttgcaattgcgaattgtgctgctataaacatgcatgtgcaagtatctttttcgtataatgacttcttttcctctgagtaaataaccagtagtgggattgctggatcaaatggtagttctatttttagttctttaaggaatctccacactgttttccatagtggctgtactagtttacattcccaccagcattgtagaagtgttccttgatcaccacatccacgccaacatctattattttttgagtttttgacaatggccattcttgtgggagtaaggtggtatcacattgtggttttgatttgcatatccctgattattagtgatgttgaccatttcttcatatgtcttttggacatttgtgtatcttcttttgagaattgtcttattcatgtccttagcccactttttgatgcgattgttttttccttgctgtggattctgtatattagtcctttgtcagattcatagtttgcagagatttttttcccactctgtgggttgtgtttattctgctgactgttccttttgctgtgcaaaagctctttagtttaattaagtcccacctgtttgtttttgttacgtttgcttttgaagtcttcgcctaagccaatgtctagaaggattttttccgatgttattttctagatttttttatagtttcaggtcttagatttaagtccttgatccatcttgagttgatttttgtgtaaggtgagagatgaggttttattctgctacatgtggcttgccagttatcctggcatcatttgttgcataggatgtcctttccccactttatgtttttgtttgctttgtcgaagatcagttggctgtaagtatttgggtttttttctgggttctctattctgttcagttggtctttgtggctatttttataccactaccacactgtttcggtgacttacggccgtatagtatggtttgaaatcaggtagtgtgatgcctccagatttgttctttttgctcagtcttggctttggctttgtgggctcttttttggttccatgtgaattttagaattgtttttttctaattctgtaaagaatgatggcggtattttgatggggattgcattgaatttgtagatttggcggtatggcaattttcacaatgaccataagctcattttctaattgagcttctttggatcttctctcttcttttcttggttaatcttgctaatgctctatcaattttatttatcttttcaaaagaacaaaaatacactaaaaaaaaatccaaggtatacaggcaacagataggacgatgaatggaatagtacctcacatcttaatgttaatattgaatgtaagtggtctaagtgctccacttaaaaggtacagaattgcagaatggattcgaattcacaaaccaagcatctgctgccttcacctaaaacataaggattgacataaacttaaggtacaggggtggaaaaagacatttcatgcaaatggacacccaaagcgagcaggagtagctattcttacatcagacaaaacaaaaaacaacagcaactaaaaaagacaaaaggccttgtccaacaaggccttttacaatcctaaacatatacaaggccttgtaacaatcctaaacatatacacacctaacactagcgctcccaaatttataaaacaattactaccaaacctaagtaatgagatagacagcaacaaaataagtaataataataactccactgacagcactagacaggtcatcaagacagaaagtcaacaaagaaacaatggatttaaactctaccctggaacaaatgaacttaacagatatttatagaacattctacccagcaaccacagagtatacattctattcatcagcgcatggaactttctccaaggtagaccatttgataggccacaaaacaagtctcaataaatttaagaaaactgaaattatatcaagtactctcttagaccacagtgggataaaactggaaatcaactccaaaggaacctttaaaaccatgcaaatatatggaaattaaataacctgctcctgaatgatcattgggtcaacaatgaaatcaaacggaaactaaaaaattcctcaaactgaacaataatagtgatacagcctatcaaaacctctgggatacagcaaaggcagtgcaaagaggaaagttcttagccttaaatgcctacatcaaaaagtctgaaagagcacaagtagacaatctaaggtcacacctcaaggaactagagaaacaagaacaagaacaaaccagacccaaacccaacagaagaaaggaaatgaccaagattagagcagaactaaatgaaattgaaacaaaaacaatacaaaagataaatgaagtatatataacttcttaatcccactttccttcctcactttccagaggaatttttattctgagtgttgtgcatacctcctgtccacatttttattcttatattatgtaaataagtgtgcatgaaagcatgtttttatatctttttaaaatttgtaagaatgtatcatcctacatatatgtatgttttgcaacttttttcactcaacagtgtgaaattcatgtaagattattcatgattgatacttgtaggtatactttgttcattttaactgtagattaaattaccatatatgaataaccacaatttactatttattctctattaatggacatctagtgtctccttgtggacatgtgctaaaatttctttagggtaatcttagaaggatacattctcagtcttattatatgtgcattttcaactttggagcaattcagcaatattttctaaacaaattattctaatattacgttcctacctttaatgtatatgggctacctttaatgtatgttatgggcttaattgcttcccccacccatccagattcatatgttgaagccctaaaccccagtccctcagatgtgattgtatttggagatagtccctttaaagagatgattaagttaaaaccaggtcattaaggtggaccctaatccaatgtgatggtgtccttataagaaggggtaatttgggcaaacaaaagaggggaggcttgcagacagaggaaagacatgttgaggatacagttgagaagaggcagacttctgcaacccaatgagtgagtcctcagaagaaaccaaacctgctgatgccttaatcatggacttctagcctccagaactgtgataaaataaatttctgttgtttaagccacccattttatggtattctgttatggcagcccttaaaaacaaattaatatgtgagatttccagtttctctgcatccttatctcactcagtatcacactttttaattgtcgccattttaatagaggagagagtatctctgtttcaatttaaatatcctggttaccaaaaatgctgatcatttctcaggattactgatgaatgaagtcctcttctatgaactgctagttcatatactttgtacatttttctattacattgccttgcctttttcttacagatttgaaggagttctttataaaatctatataataatcctacattaattatatattttccattctcttctctccacctgtgacttgtctattaattttattgcacaaaaattgttagttttttttttttttttgagatggagtctcgctctgtcgcccaggctggagtgcagtggtgcgatctcagcttactgcaacctccgcctcccaggttcaagtgattctcctgcctcagcctcccgagtagttgggactacaggcgcctgccaccaaccctggctaatttttttttttgtatttttagtagagacggggtttcactgtgttagccaagatggtctcgatctcttgacctcatgatccacctgcctcagcctcccgaagtgctgggattacaggcataagccactgtgccctgcccaaaaatttttaagttttaaggcagtcagatttattagtctttctttttatggtttgggcttttaaaaaaaaatcttatttaagaaattcttttctctcccaagatcatgaagaatgcaaaatttcttctaaaatttttaagttttgtttgtaagattgtttgaattttctgtgaaaccatctcttattgaattatttttcctttccatattaatttagaatgatacctgtgtcatatgctaagatctctttctaggtgctttattctgttccattagtcttatctggctttgtgccaatactacactgtttccattagtaaaactttgttttgttttctgatggggggaaatcctattttttttcttattttgcaaaatgaactagcttattttggagattttgctttttcataagtattttaggatcactttgctaaatttaattaaaaaatccttttggaatttttattagaattgtatttaatttatagatcaatttgggaaacaactacttcttcagaaaatttataattttttaatgtatgaggtatgttgctgtttgttagatttattccttgaaagattatgattctgctgttactgttgtaaatgtgatattttaaaaaacacatttagtaatttgtggttgttgttgtatagagactttaatttctgtacattgatattgtatatagtgatgtccctgaactttattagtacgatttgtagattatcttggattttctgtattaaagtttatattatctgaataacatttgtttcttcattttctacacttgtaagtcttacttctttatcttattacctcagctaaggccttcagtacagtgatgaatagaagcatagatggcaggcctgtcttctattgttcttagatttaaaaggaatgctactgatgagttgatccatagaatgtgatatttattatgaatttctaatattccttactgaattaaagagtttaccttccattcattctttcttgttaaggtgtttataatgaataagtattaaattttatctaatgattttttgtttccattgagattgtaattttattttgttttaatttgttaatgtaatcaatttaaattaatagtttttctaatcgtaaaccaatgtagtattcttaggataaagttgagatagtcatgtatttttaaatatattgctgtatttactaatggatcatttgggagtttgaaaataagcttatatttgaattagtctttaatttctttgttatccttgtctacttctatatcaatcttatactaatctcaggaatggaattttagaatttcctctctttttatatttcctagattttgattcgatgttttatgaatatttgtaaaactcatataaaaatgctagaacctggccaggcacggtagctcatgcctgtaatcccagcactttgggaggctgaagtgggcagatcatgaggtcaggagatcgagaccattactggccaacatggtgaaaccccgtctctacgaaaaatacaaaaaaattagctgggtgtggcggcgcatgcctgtaatcccagctacttgggaagctgaggcaggagaatcacttgaacccgggaggcagaggttgcagtgagccgagattgtgccactgcactccagcctggcaacaaagctagactccgtctcaaaaaaaaaaaaaaaaaaatgcttgaatctaaagtttcaaaaaattcaatagatttttgaccactgaaaatttttatatattattgagttcattttgtagtttaattcctctagaaagtatgttttttatgtttttaaagcaagtgcctgaaaatatagtaatttttgatatgttttaaaattccttatctgtttgtgattctcttttctttcctaatattgtttatttgtgcctacgttctttttcttaattaagatctttattctttccaatgttcatggcataattgttgaaagtatttaagaaaggcaacctgttttacatgaattattaagtgcatttttgatgggaaaagtttaatttctcagagagccgtgtaatcatttcatttaggctacaactcactagtttttcatattctgattgcaaagcagtaatttactggttttcatattatgttttaatgcattgaattcctttagagtggggctaatgtttgggtattagaatggtacctttttgtttgaataaagattttcatcaagtttttatttgggagaataatttttgaaatacatatcaaatctcagaaaaacttaacatgtaggcatccttaaaggcttttaaaataggaatgaggatcatctacaggaaaccctagtgattagctgtttcatgttttgtgatgtcagatgtaagcagtgaaccaggccagcctatatagctattgctgcagctgcacagtccagctttcttggatttacctaataactaatgatgtctaacgtcttttagtgtgcttaattcgcctttttgtcttttttgttcaaacatttatttaaatctttttgcttatgaggttttttcttttttttcctgatgatttgatactttatgtagtctggatacaagtcctttaacagatgtaggatttaaaaatattttcttggccaggcgcagtggctcatgtctgtaatctcagcactttgggaagccaaggcgggtggatcacctgaggtcaggagttgaagaccagcctggccaacatggcaaaaccccgtctctactaaaaatataaaaattagccgggtgtggtggcgcgctcctgtagtcccagctacttgggaggctgaagcggaagaatcacttgaacccgagaggtggaggttgcagtgagccaggatcgcgccactgcactccagcctgggtgacagagtgagactctgtctcaaaaaaaaaaaaaaaatttttcctctagtctgtgggttatcttttcattctcttaactgtgtctttctaaaagaagagcttttaattttagtgaaatccagtttatcaattttttcttttgtggatcacacctttctgtcatagctaagataactttgctgaactgagggtcagaaaggtatatttcttgttttcctcttgttgtgaaaactgtctgctaaattatctttgtgactttatttaaaaaataaattgagtgtccatttatgtgtgggcctattcccggactcttttctgtttcattatgctctttgtcatctgtctttatactagtacctcactgtcttgattattgtatgtagttttataataggtctttaaaaactttttttaaattttttaaatttttgttcattcattcattcattcattcaatcagtcattcaaacaccaactcaagccagatacaataggtcttaatatcagatggtgtttgccttttagttttatctttttctgatttgtattgagtattctagatgtttgtgtttccatatgaattttattactggcctgacaatttctaaacaaattcagtgttgttttataattttaaatttataagtcgtgcccatcttttgccagattgatacttaatttttttcatttttttttgctattgtaactaataatgtggtttaaaatattaatttccagttgttttttgctagaatatagaaatgtagaatatagaaatatagaattgaattttgtatgttgatgttatattctgcaaccttgttaaacaacatcagattttcaacatagattatcatgttatgtgaaccgaggatagctttgcttctttcattccaatttgaatgcctttgtttctttttcttgccttggtctactggctagaatttccaatatcgtggtgagtagaagtggtgagagaggacatcttgttttgtttctgatattaggggcaatatatttatgctttcaccattaacctatggtgttagcagtaagtttttaatagataattgttatcaggttgaggaaatttccttaatttcctagtttctgacacctttttttttttttttgaaacaaagtttcgctcttgttgccctggctggagtgcaatggcacaatctcggctcaccacagcctctgtctcccaggttcaagcaattctcctgcctcagcctcccgagtagctgggattacaggcatgcaccaccatgcctggctaattttatatttttagtagagacggggtttctccatgttggtcaggttggtctcgaactcccaacctcaggtgatccgcctgcctcggcctcccaaagtgctgggattacaggcgtgagccactgcacccagccatttctgacactttttatcaggaatttacattagacttttgttaagtcctttttctgagtgtattcagataatgtgttttgtaaaattttgtttaaaaaaaattttgtctataggaagaattacattgatttattttttaatgctaagccaatcttggatttctaggataaaccttggttaaccatgatttactatctacattacatatggttgggtttggtttgctaaatttttttataatttttatattggtgttcatgagagatactgttctgtaattttttttcttactatatctttctctggtttgatatccagataatactaactttatagaaagaagtagtccctctaggtttttttgcccagtgtggctacaataggggttggcaaactatggctcatgggtcacatcctaccaaccacctctttttttcatggccagcaagctaagaatgattttccatttttaagttgttacattttaagtgtcatacacacacacacacgcgcgccccgcgcgcgcgcgcgcacacacacacacacacacacacacacacacacacacacacacacacacacacacacacacacacacacacacacacaccccccaagtaatagccttgattttgcttgttggcctataaaaccgaaaatatttattaggaaaaagtctgccagtttaattgattttctttcttttttttttaaagaaccagattttagttttcattggtttttatctatttttctttttctccatttcattgatcgtctctctgatctttattacttcgtttcttccacttaattggagtttcatttgctctttttttcttagtttcttagggtagacgctacaatatataatctgcagtaaatctcattctttatatttttcatttcagacattatagttttcatctgtagtagttcaacttgggtatctattaaaattttttctttctttctttcttttttctgagatggagtctcactctgccaccccggctggagttcaaaggcgtgatctcgactcactgcaacctctgcctcttgggttcaagcagttctcctgcctcagcctcctgagtagctgggattacagacgtctgccaccatgcctggctaatttttgtatttttcatagagacagtatttcaccatgttggccaggctggtcttgaactcctgacctcaggtgatctgcctgcctcagcctcccaaagtgctgggattacaggcgtgagccaccgcacctggcctattaaaattttaacatcttttttatatcttccctgtctctaacttttgaacatatgaaatacagtcataataactgttatttctatggtgattctaacatctgtgtcagttttgagttggttttgatagattgatttcactcttctttatgggttgtcttttcttgtttttttgcaagcctggtaacttttgtggattccagacatgaattttaccttgtttgttactagaaggtcttgtataatttacaaatattcttaaattttgttctgggatgtagttatgttattttaaaataatttgatcctattttgtcttttaataattgttaagtgggacctaagcaatgtttggtctggggcacattttcctgctattgaggccaaatccttctgagcattttacccagcatcccatgaattacggttttctagtttggctgataggatcaggaactgtttctacctaatctgtatgaatgccaggtactacttcctctaatccttttagagagttctttccccagcctgagtagttccttatgtgtgtgtgctgatgagtactctgctaattccaaaatggtacctttgcagatttctggaattctctgtcctctacagttctctcttattcaaactctgtcttggtctttttagactcttagctccatttcttcaactcagtgaatgtactggctccatctgcatttcccctccatacactgtggtctggaaactctctgaatgcagtaagctgggacagtcacagggctatcatcatttgttttccttctctggtgatcactgccctttgttgcctgattgcaattttattagatcattgtttaatacatctaacctggattttgagttgtttcaggcaggatggtaaatgtcttggctagaagtggaagtcttatatatctgtatctttggcatggtgaatgtaagaaagcattctgttccctaagtattcagaaaagagactgttcgtgcatattgactcttttctggatggagtttggaaagaatagttctcctgtattttttttttagagtgatttttccagtaattttcttttccagttttttttttcacagttggattagattattaggcaatatggattactaattccattatgttttattagaattagattggaactctttgtggaaagctactgaaaagatcacatgctatttttttcatggctgttttgcctctgatgtttattccaccaatatttgaagaaagagataaaaaggagaacctagacataatctttctattgtcaatttttctatcactaacatatgttctgaaaaaggacattcctgtcctatagtatattgctgccaaaataaatcccaagagattgaagttttattctattttcaaattgtttcctagaaaccagccacctaattcacaaagagattaagagccaagtcttagaaacataactttaaaaaactatataccaggacatgcctcatttgtgaatgtatgcgtgctcataaattgggtaattgtgcacctaactactgtattcattttttattattcgctttgtgcttatacaaatgaaggctttttcattcatattctgtagccttggacactcatgattggaggatagttactttttatgctcctgttcaatgttaatgcgtacaattttacaggaaattataaaatgtctccaattactttggtatagctgtaacaatagctactttattaaacgtgttctgaagtagtgtaggtaattgacagttaatttggctttatcaggttatatagaaaatgttagagaagctataaaaaacctttcgtatcagagtgtttgcctcaaaaggctatgttggctgggcgccgtggctcatacctgtaattcagcactttgggaggttgaggtgggcggatcacttgaggccaggagttttagaccagcctggccaacccaatgaaaccccgtctctactaaaaatgtaaaaaaattagccagggatggtggtgcattcccgtaatcccatctgctcaggaggccgaggcacgagaatcatttgaatctgggaggcagtggttgtggcaagccaagatcccatcactgtactccagcctgggtgacaaatcgagactgtgtcaaaaaaaaaaaaaaaaagactgtgttgacatctgaatttaagttctgccaactataatttaaaacttaagttcccttaaactggtcatgatggtaagaatagatagcccagactttttgagattacagctcatctctaaaatgacaaagctcagatataatagtagccttcataaaatttattgccagacactgctaagtacttttacagacatttcctcatttaaatagactttgaaagaaaaatcagctatttaatctttaggacaattttgtaaaaggatcaatatatgtacgtattaatttcctattgctgctttgacaaataccacaaactttatggcttaaaacaacataaatttattctcttaagagttttggaggccagagatctgaattgagtttcactgcactgaaaccaagatgtcaggagggctggattccctagagaagctctaggagagcatctggggtatttttgtttgttcgttcgtttgccttttccagtttctaaaaatgtcttccttgctcatggttgcttcttccatcttcaaagctaacagccacataaccttttcctcttctgtagtaaaatcttcttctaccttcctcttatgaagacacttgttattacaaaatggctcacctagataatccaatctcaaaatccttaattatatattcagagtttcttttgccataaagagtaatattcacagatttcatgattaggttatggatatctttgggagacctttgtttagcctaccacgaaattgtattatgtacatcaaagtggagtacagtatactgccataagtcacataaaaacaaaacaggaacaagcacagtttggaattaagttgaacagagaggttgataatataagtaagagatcttggattgctgttctgtgttccagcttttatattattgactgattgtttttgttgctgatagaaatgaatagaacaatgatcttcaattttttatttttattttttcgagacagggtttcactctgctgcctacactagaatgcagtgacatgatcatagttcattgtaatcttgaactatggttcaaggatggttcaagccatcctccttccttagcttcctgagtagctgggactgcaggcacacaccaccatgtgcccagctaatgttttcatttttgtaatgatgggggattgctgtgttgcccaggctggccatgaactcctgggctcaagtaatcctcctacctgggcctcccaaagtgctgggattataggcatgagtggctacacctggcccaatttttttctaatatgttttatcttctactcttgtctttcttttttctatataagaccaatgcttagtagtctaatgtcatgaattgaaagacagatttacatagtctgatattataattaatttagaaatacattatatttgatgtttgagcatgtccttagacacatgttcagatatgcttcgttattccctttaagccttttctttactttttccttcacttttgttactctcaatgctaatgaataattgacctctttgccactgatcatggtactctggggatgaaagatttttaggaaacagctctagaggtttgttaactcctagaagatcatagatttctgaagtagattaatattttctatttttcgttattatcatttcattgtccatttcactggttaatcctatacctttgaagagaaaattccatttggtactgcttttgtgctatatggttcaacaacttatggagtttacagtataaatgttttagaaagtgagcttgtattttgttgcacagtttgaaagctaaatgtttacattatcttccctaaactacaggataccagaaggccctattgatcaggggccagctataggaagagtacgcgttttagaagagcagcttgttaaggccaaagaacagattgaaaattacaagaaacagaccagaaatggtaggtgattatacagtgttttcccctcctcagtatatgggctttagcacagataattgaaagtttccttttatcaaaatgttggaaatgctacaactctctattctttgactacaggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtactattctcctttcacattttatttgggctttagaaaagattataatctaagaatgagaaacagacttgttaatccatctgttgagtggtaaatattaatagcacctacaatatttaagaggcgaagagtacctgaggtcccaaaggatggtaattgccaagtgcagttcatcaaccaaaatataccaccagaaagtattaattaaaatgtatttctagaaatctttacattctaaataaattctgaaggtagtggtgccagccaacaatacattaaaatatctttctataaatgttctttatatataatcagtatttgaagtggagtgtgcagttttgcattgcggtacattggaactcatagtgagtccgatggttacatttctaattcaaacattaaaaactttaaaatagcatttttttaaggatttctaatgaaaggttaacaggattttttttttctttaagtaaaaaggagcattctgttcattgttctttcattagttgctggaaagaggtacctgagatctgcctggttaaatttgtttctcctatgcacacgttgctaaataatatgaagtttatcttccacagaaaagaaaacattttggtgctgttgtattcatgcagaacaaaatgtatctgaaaatcattataaatacagtgaaacctgtctttaggcctgttatatttaaaagtctatgtttccagtaggattctgatggcaattactgtctcattagtgaacaataaaagaaaaattgttgtattagcacaacctactactgtgaagaggaaaagaattaccccatacaagtaagagatttcatatttattaacatcagcagcaatattataatgattttgaaaaattgcttggttgttttaggtgaaattataaataaaaatctgtctattggaatcattttagcattaatgaatctacagaaatatgatagcatggatttcaaggggcagtgaattattaggccacacattggacagactttttgatatatttagcccaacttgcagtcaggccatacttagaccactaaaccaaatgctgactaattctgtcattaatatttctctaccctaaagctgattctaggcacgaagcatctcttaaatggaattttgtgcttgtgttctttgcttatcacagttttttaggccaattcacatctgaagaggatttgacttgggtagactatgctgtatgtaaaggagaattttggccactgacttctgatggaatgtttaattttaagatttgagtaattgggctgggcgtggtggctcatgcctgtaatcccagcactttgggaggctgagataagagatctcttgaagctaggagtttgagaccagcctggccaacatggtgaaaccccgtctctaccaaaaatacaaaaatcagccatgcatggcacatgccctatttcattcttgttcatttctctcttctcttctccgccggcttcgggcggatcgcctgacccagcctggcacagagcaagactctgtctcaaaaaaaagatttgagtaataaataactttgaatttaatttccagtgtttttaaaaataaatatatatatatatatatatatatatatatatatatatatatatatatgtatgtatatatttatttatttattttttagatgtggaggtctttctatgttacccaggccagtcttgaactcctggtctccagtgatcctccctcgtcagcctcctgtgtagctgggattataggcctgggctaccatgtccagctgaattgaaataattctttaaggaattattttgtaaataataatataatttgtttatataactcgcatatgttttgtgaccatatgtacaaatgaaaagtgaatataagaaatgggcccctgagaaactgatataaatcagttttccattttgttgttgttgttgttgaattatgattccttacagtgccatttagtatgttaaataatggtagttcattgaaaacaaaaatggtaagtaaaggtacccaagtcagtttattttcctgtcttaaacagaaatgacaatgaatctgggacataacttcatagggtagtaatttaactccaggaagccagattagaatgcagtaatacaaataatgagcaaaacacaatcaaacattagagaaataacccttaaactgacggacgtacaaatagaaaggacttttattatgtagaatatacccttttactgaccattttcaagatccttaagtataagaattaaaatcaaaacaaacttttaggtttgcctctggtaatttttatatgatacaaaagtccattttatttttacattggctcaaatgatagtgtataggtttctaggtctgtagctgggaccatggtcagtgaggctgccacctgggtatgggcctgccttcttaaaagagccctcctgagtcttgggctctattagggttttgcagccttctacctgggttagaagattattagcagattattgaacttgagtagttcattgtgggagcccctgatttgacagagtgtgggtaccctggccactttgtacttgcgatggcatgtgaagtggggtgtagtattatggaactgagaggtctgggctaattctgggtagtttgtgtcactacctagttggtgtccacagagatttggagaattatctgatgtggaaaatgcacatatttggtgtcagaagtgttctgtggtgaaaaacagatcataatagtagtagtaatactaagggcagctaaagttgctggtttttgagaactacaactacagactccctgtttctctttgtgagttcaccacgatgcctgtgttgtttcctggtagaaatcgcatttctctgtaggttagtgaccccatcagtgagctgtgggggtaagactcctcctttgttgcccacttgaagctgtttcctagtagtcagggcaccatgtttcctctcctggaatctggctcctgttgttcatcacttgcattaccaggcattaaaatgcagcctgggggccaaatatcataagtttgatctaagattcaactcacctgagatttttagcaaaatactatttatttacctgattggccttgatagctaataactagtagagcctaatctctgcctgcaaccacagttgggtaatcaactggtagtaattagtaatattcttgggcttttagaagcttttacaggctgttttaagaatttagaggtgttgatggtataataaatttagagtagcatattaattattatctgctatattgatatcaagttttagcatcactagatttctaaatgatgatttcattctagtgattgcatatgaccattcttcccagtaatacagttaaatatacttgtagcttttgatatcattgatcatgaattgaccctagcctacctctttgcagtagagagaattaagcggtttagagttagtatttttgccattgtggttttaccatttatcttgtattgtaggttcagtgcttcgatttatggcagtttagatgtgtacctcaacctctaagcatatcatggagtctgtcttatcaacctttcaggctgatgcagagacatgtttaacttaatcactgttgctctgattctttttatcatcttcatattgccaaataccagtttatgaaaagggtaccaaagctgcttctttctgcttttaaaattaccatattttttttaaatttattcatttattttattattttttttaccaagttctgtttatggtaatttataacaattataaaactaaagtacaggagatgagccatttttcaactgtgttgactgaaactattgaaaaacaatctgttaaagtagcaatctcatctcccttacctagtttgcatttctcattatcagtaatatatagggcagctgtgcttagactaaattgtgttctccaaatagtgaatgatacttatgttaattatgctgatttgctaatgtacaaaaagacattgtgggggattatgtaacaaaagaaatgactgtgactcaaggggtacactgggaaagattgatagaatagcttacagattttttttaagtttatgatcatagttgttgttgcccaatagcttgtattttcattctgtttggaaggtccaagaattgatattcccactcttgaaaagttaagtttggtgaaccttcaaaccttctattctttgtgttttatttcatatacacaaaaacagagagagagacagagagaggaagggaggaaggaagatcttactaagttctctgagatgtgatttgattgagacttatattaagctgggatgtggatattctttcttgaatttcggatttgtttcaacaaaatgtttttgtatgattgtcttctaaggaatccaagcttattttcaagtggtgctagaacattcatcttaatattcatgtgcaaagggatacatttctttatgaagtcatccttattctgctcatcacttagtctctatcagccagataatgattcttcatcgcctgtaatggaacagtgtctcctaaaataaagtttgcattagaagaagaatctccaggtggaaaagggtgtttttcatctagtagttctaattctgttttgcttcctacgaccacacatcttttgggtgtgatttccaaacttaagaatgattttagattaaaaataatcacttactaaggatttcttacatgccagtcactatgataaaggttctgcattcattatgttactttatcagcacagtagtcctacaaggtatgcattatttgttcctgtttttttttttgttttgttttctgagacagagtctcgctctgttgccaggctggagtgcagtggtgtgatctcggctcactgcaagctctgcctcccggattcaagcgattctcctgcctcagcctcctgagtatctggaactacaggcacacgccaccatgcccagctgatttttgtatttttagtagagacagggtttcaccatgttggccagaatagtttcgatctcttgaccttgtgatctgcccgccttggcccgtttgtgctaggatgctaggatgacaggcgtgagccaccacgcctggcctatttgttcctctttttttttatttaagatggagtttcgctcttgttgcccaggctggagtgcaatggcacgatctcagctcgctgcaacctctgcctcccgagttcaagcgattatcctgtctcagcctcctgagtagctgggattacagtcgcctgccactacacccagctaattttgtatttttagtagagacagggtttctccatgttggccaggctggtcttgaactcctgatctcaggtgatccgcccaccttggcctcccaaagttgttcctttttgtttttgagatggagtctcgctgtgtcatccaggcagaagtgcagtggcacgatcttggctcactgcaacctccgcctcccaggttcaagcaattctcgtgccccagcctccgggtagctgggactacaggcacacgccaccatgcctggctaattttcatatttttagtagagacgggatttcaccatgttggccaggctggtctcaaacttctgacttcaggtgatccatctactccagcctctcaaagtgctgggattacaggcgtcagccactgcgcctagcttagttccatttttataactgaagttatattcagttctagagaaattaggtggcttaacacaggctaagttaacagaacggttttactccaaaatccgttctcttaattgctaaatacttagcttttctgagctttttctcttctacgtacggggatataattcctatagcacagcattgtgatgattacatgaaggaaaatatataaaatactttacctagtgcgtgacacattatagattctagtaggctctggtcagacctattaatacattaggaaaacttaactcttagaccctgcagagctggcacagataaaggcagattattgaaagactcaataggaaaaatgttaaggcctggaaactaaatgtaagcctagtgaacatcactcaccaaagtaacataattgttgtcttatatatgatagtataagctatttttgttgtcatccttctggagttttccccacctgtgtcagttgtcaagatggtggcatcctaaagttcctccttgagataagggaggcaataaggagctttgttttcttgcctgtctcctggtcacatttttatccttagcattgcttatttttgctgcaggagcaaaccgaagtaaaagcagctttggacaaaactcaagtaatttttcttgcccatgatgcagatttgcccatggatttgactttgagagtaaatcttagtcacatttacccccgtaagtgttaattccttcaccttcttgcctggattccatctctgtgctggcccttagggggagcttctctgttttttttttttttttttgaggcagtgtctctctctgtcacccaggctggagcacagtggtgcaaaaacgacctgggctaaagtgatcctcctgcctcagcctcccgagtagctgggactataggcgtgtgtccctgcagccagctagattttttattttttgtagagagggggacttgccatggtgcccaactcggtcttgaactcctgtgctcaagtgatccttctgccttagcttcccaaaatgctgggattataggcgtgagccaccacgcccgaccaaacttctctcttcaacattttgaatcaggcgtaaacaaaaagccctctttgtgtttggttcctcagtggcatagaggcagactagaagtctttttttttaaatagttttatgactattgaaatagaaaactagagaaattagcagaaaatataaggaacataaaacataaccaatttttgaaatagaggttttaatacctgtcataggtggcttgctttcagagtcataaattctattctacttggcggggcgcggtggctcatgcctgtaatcctagcactttggggagaccgaggagggtggatcacatgaggctgggagtttgagaccaacctggccaacatggtgaaatcccatctctacaaatacaaaaaaagctcgtcaggcatgtagctcatgcctgtaatcccagctacttgggaaactaacacaggagaattgcttcaacccaggaggcggaggttgcagtgagctgagatcgtgccactgcactctagcttgggcgacagagagagactctgtctcaaaaaacaataacaacaacaacaagttatattctactcggtgtcttcaggcaactttattgtatcctcaaatggccagcactattttgctggtaccttgcctagctttgttatttcccaaaccttgacctggtctcatactaggtctttagtatgcccacttattagatttcttgatatgttcgtagtcaaaaccacaacagccagattccctgctttctgggactcttctaggagatctggtttcagggtagagttactgaaaacccagggcttctgcagaatggttttgagtcactatggttcccttgctgatttgattatcttcttgtctttgaccaaaaaataaatactgcaggatgataactttcaaatataattgaatcagtaaagaactagtttgaatttaaggttgtatcctggacttaattgtcttgcttacatggtctccaacagagaggccgagaaacaaaagattttaaaaacaagcttaattttagtggatcatgaagttacagtaacttatattgataccctaactgcattatcacaaaacattagtgtactctttttttttttttatttgatgtttggtcttctagttgcttggttattctgctttctaggtagagacagatgaatgtgaataattaattgccaagacttagtactgatgtaaacttggtaaaaacattgacataaactaatttattaaaaaaagtagagatcagctttcattcacaatggtaaaggaatgtcttgattcctatgacaagaaagcataaaccatgctaatgcttatatttcaaggcactcttctctctaaattagacctaatgcagtttttacctccttgaggctatatgatgattgtcaatgaaatgtaatgctttttgtttctgtatctgttcctgtgcattcgtgcacccatgtgcatgtgtgtagtgacacatttgacgtaaaactgagagcatattgaatttccttttttccttcaacagacatttgctgataaactggttattccattgtatgacatctccagcacgatactgttatttaaaactgagacttgcgcctgcgcagtggctcacacctgtaatcctagcactttgggaggccagtcacctgaggtcaggagttcaagacaagcctgaccaacatggtgaaaccctgtcaatactataaacagaaaaaattagccgggtgtggtggtgcatgcctgtaatcccagctatttgggaggctgaggcaggagaatcacttgaacctgggaggcggaggttgcagtgagctgagattgtgtgactgcacttcagcctgggcaacaagagtgaaactctgtcataaataaataaataaataaataaataaataaatgtaaagttgagacttgcaacaagttttgtgattactcctatttgataggtaggaaaaaacaaatgaccacattctattatgatgaaacctatgaaatataaagaataatgagtgtgatgagggtgatgggaaagaggcttatgaaactgagaatatgttttaaatgaagttttagccgagccctatagccctattatagttaaagacttttgtgtttccatgagcaactcacaatttcatacagatagtgactttccccctcagtaactataaaaaaatactgtagtctacataatagtccatagaggactcagttttataatctgaaaaaactttgaagttgaaactttgcctagtctaaagacttcaggttaatttctgcattgtaggtttggtttttgcagccaaagtctctttcatgaaaagaaaatgttttgaatcctagctgagaataacaaataagaaaatggacaaggcatcacatattggcctcttgcctgttttaaaagggtgaaaatggaagtagataagctgcaaagtgtcctgtgtgtgatgaatgttgacacatgaaacaaatgtctaaagtgcttcacaaatggaactgttgttccaaagcatcgttcaaagttgttccactattaatttaggatgaatagtctaaatggtggctaagatttttaatttttaattgaattaatagtttcactttattcaaaaggggctattatcacgtattctctgttaatcatgtgtacttctaatggctttctgtgatagtaaataagactttcctgtgggctgccattgcatttttgctaaataatttagcatctagttaagaatcaggaataaaagagtactaagactgtgtcacaagcaaatcacagttgttgagggcatatttcaccatctcttaagtgattccttctcattgatcaatcccccttcttcagggtgttatatggaactcaatattggatcatttttataattgattatcaataccacgtgttactgttacccacatctaatggctccttcctcttggtagtagaattattagtaggtactcttcagacacagtgtaaaagctcagaaacaactctctgaggacctctagcattaaaaaaaaaaaatagcggctaccacatgtattactattttgtgtgtattttttaaagagctttagagaaggtcttttgatactttgtctcagagatgtcaaaataattttcctaggacacaaaattagtaggagatagaaccaaaattgagaaattggtatgtctggctcccaaagctctctcctctgattcagactttctgatttttggatatttacattgaggagaggacacattattgtgctctggacctcctactttgatatttgttagtgtagtaattagaagcctggactttaaaattcattgcttgggtttgatttcctactctgacatttctgaggtttgtgactttgagcaaattatttaacctctcagtgcctgccatttcttacctagtttgtaagattattgtgagattaaatgaaataatgtaaagcacttagaataggtgtacctatttattgttgttcttttttatttattgtaatacatcagttttctctaagtactcttggaatctccagctaatgctttatgtttttagttaatacagtcattgtaagtgatttctagatgtgtaatttttctgacaatataaatacatttctgactttataattttcataagcaaataatccataatcttaagcatgccagaggagttaatacaaagtgttgagaagggatgaagctggagctacacctgggtaaggattattccccaaacctgtctaccatcaaactggatttgtaaaagataaaaattatcaccgttatctcattatataaactcttgaaggtttttcttttgctactttttcattcatctaaagatatttatcgaatattttgtctgtgacatgcactgttccacatgctgattttaaataacaaaaaacaaaaaaataaaagaagcaaccaaaaaaaagttcattcttttggagcttaaattctagtagggcagaaagataagaagtaagtaatattgtatattggaaaatgataactgcttagaaaaaaaaaataagcagggaaggagtgttagcagcagtgaatccatacgggcctgcagcagctcgattcttgcttccttggaggaaataatttggccaggggaacataaggcagagtgagagatcaaggcaagttttagaacaggcatgagagtttattaaaatgttttagagcaggaatgaaaggaagtaaagtacacttgtaagaggccaagcgggcgacttgagagggtcaagtgtgctgtctgaccattgacttgggcctgtatatattgctatggttccggggtttgcatttcttcttacctgatttttccttggggcaggctgtctgcatgagcaatggcctgccagcacttgggagggatcgcatatgcagtgtgtttactgaagttgtgcacatgctcatttgaggctttttttccttaccagttgagtgttcctagaggaaggtcatataacagttaaagtctgccattttgcctcttagtacacgtttgagccaactcacacaactcttgaaaacttatcaggaagctgctgatgaccagcttcagttgttttctatctatttaggagactgccgttccctggcaccagctgtgactagttaaattattttagagagatactttaacaactgcctgaccatcacctgatggtcgcctgacattgcttggaggttaagggggtgccttcttctgccctcttaaggctgcctagctacctactcaaacaggaggagagggaaaaccaagggttgagggtgataggcgggagtgttggatttttaagtgggataatctgggaaaaccttatgaagatggtgacattagagcaaagatttcaaggtcatttagatgagccatgtgaatagatatctgagaaaagagcattccagggcagggaggatcaaatagaaaagctctggagtaggaatatacctggcagtgtcaggggttagcaacaagaccagtgtgactgaaatagagaaatcaagaaggatggtagtgggagatgagatcaaagtgagccatattgggtggggtcttttaggtcaaagtagtaattttggctttgactctgagctgaggagccaattcatgttaagaacaaagtagtaacattatttgttgatgttgtaacaggatctagctgatatattgagaacagactttagatgtaggcaatggtggaagcagggagaccttgttaggaggttgttgtaatccaggtgagagaagatggtgtctcagttggtaaaagtgctggtggtgatatgtgaaaaattagaaattagctataaatttgctgacagatttgtaggggatgttagacaaacagagactcttgctttttacttttctttcttgctaaatgcaagtcataatttttatttaatgcaatataaataaaaccatttgtagcagccctaaagtttctctttttagtttactggagattttactttactctgcaggtaatccagcatgttgtaattgaaattactgatgctacacagaatgggaattactgatgctaaataatcattttattagtttagaccaggactcagcaaattatggcccagagaccaaatctggctcattgcctgtttttataaataaagttttattcaaacacagccacacctattcatttgcatattatctatggcagctttctgctacaaaggcaaaggatcttagagatctgtagagactaaaatatttactgtctggcccgttaatgaaaaaatttgctgacccttggtttatactgttaagagttgtgtaaaaattttcctctgatctttttccagtcactcagagtgtttaaatatgaagagaaaaattaaaagggggcatgaaatgatagtagagagaaccaagaggtactaatactaacgtcaacttctttctctatgttaatttactcatttgtttgctttgcgtattcactttcctccacatctttgtagtgctttgtctgtgttgagaaacaagtgcagctgactagcttgaacaaaaaaagtatattttctcaacagtgaaaatttactataggaatgactattggattttaagagactaatttttgaattgcacaaccttgatagaaaataaaagatgagtaccagtgtcaatgcgagcatcaatctttatgaggaatctggcattcttcttaagactttgtgtaatccagtgaagcagtacagacaagttcgatctccattgttgtttgttttaacaggtctataatgacggatctatactacctcagtcagacagatggagcaggtgattggcgggaaaaagaggccaaagatctgacagaactggttcagcggagaataacatatcttcaggtaagaaggttgggttaagaataaatttgagtgaaaaaaagaaggatcataatataactaagagtaataatttcagttgtttttagtcttcctggcccttgaaaatcagtactcacacattttacatatttattcagaaagacactgtgttatgccttgagtggaatacaaagatggctaaaacaaagaccctgtcctaaagggagctacttcttacacacgtacacacacacacacacacacacacacacacacaatacaatacaaatataacatcttacattttataggagagaaatagatgaaatgcttattggagttttgagtaaggagacatcagggatagtcttgtagagaatgtattgtttgaagtaaactgtaaaagatagttaaataggatttggacacacagaaatgaaggaaaagaatgtaccagctggaggttatcagctaagcagtggctcgtaactgggaaagaacagtacaggaacccatatgataagtgtggcagttcagtttgtctggaattttaggttgtgtgaaaggagggatggagaataagttggaaaggtaggcttggaaacagattacagaggttaaggtttatggtacataggcagtaaggggtcactgaaagattttacttatttgttttataaatgttattataacaaatagaaagtattggtaaacatcaagtctcagaccctttaaaattaatttcactttgttttttgtgttcttttctagttcttattaatatgtacacaccgtcttacatatatgtaagaaaataatttatttttgattttgtttttctgcttaatatgccataagcatttttctattttggagtcacaacctgcttttgaaatgttttacatacaaaagtggtatgagagtggtacttaagtgatattaatctgaaactagtattttagttgaacttgattatttgaagagactagaagcagggagaccatttaagataagaggaccatagtgcaggtaagaagtattaaggtatgtggcagtttgctttggaagtgaagagacaaatttgagagagattgggaagataaaattgataggcctttccaagtagatgaaagaactgaaatggctgggataatggggacatcattatctgataaggtgctgagggacagaatagttttcaggggaaaacaatgagtcagtagaatcttcaaatctcaaaatgtttgaagttgaaatgaccttggaacatcctccaccctcatccttttctaatgctgtggatggcatactgtgtacgctctactttccctgtaaaattaaagtattgtataaaagcaaaatgacagccagtgatatggttctgtatattttaaggtgcacatttttctacacttaaataggaaaaaatagaaaatcaagtgtttaaagagatcattaaaaaccaaactgatcttggcatgctatcttggtctcatacccacatggccattcatcagaggtgtctgcagaatgagaaacacttcacctcctgtagggaagaggtaattatctcctatcaactagaacctcactcagtgaactataaacagctggtggtgcagaaccatcatccttatttaaaatggaaataactgtggtttctgagcttcctccatttcctcttattcgttaaattttcaccaactatatctggtgatagttctaaactatgatctagtgatagttcagctacctaaactgtaacaagtacctgccacctgttttagtttccttttttttttcctcttggtttgtgggtggccaagtgctttcacctgtagtactaatttgatcctctatatgctgatttttgtggttccgtattagagaatttcatttgcaaatcatgctaataatttaaagctacattggctttttaaatcttttaaactatagcaaaacctagcactttacttggaccttaccttcagtttcagatattgctatttaactttactttcatgcttttcctttttccccccattggaaggaaaaggtgatttttttttttaattttcaaggagatagggacaatctcagtagaaaaaaagtgctttggaaaaatatttttctttttttcataggttgttggagtacaggtggtatttgattacatgttctttagtggtgcttggtgagatttctgtgtgcccatcacctgagcagtatacactgcaccctatttgtagtctttcatcgctcgctcccctcccacccgtccctccaagtccccaaagttcattgtatcattcttatgcctttgtgtcctcattagcttagctcccacatatcagtgagaacatatggtatttggttttctattcctgagttacttcactcagaataatagtctccaatctcatggaagtcgctgcaaatgtcgttaattcattcctttttatggccaaatagtattccactctgcatatacatatacatatacacatacatatacatatgccacaatttctttattcactcgttgattgacgggcatttgggttggttccacaattttgcatttgcgaactgtgctgctataaacatgcatgtgcaagtatctttttcatgtaacgactccttttactgggtagatacccagtagtgggattgctggatcaaatggtagctctacttttagttctttaagaatctccacactgttttccctagtggctgtgctagttacattcccaccagcagtgtagaagtgttctctgatcaccgcatccaggccaaacatctactgttttttgattttttgataatagccattcttgcaggagtaaggtggtattgcactgtggttttgatttacgtttccctgatcattagtgatgttgagcattttttcatgtttgttggccatttgtatatcgtcttttgagaattgtctattcatagccttagcccactttttggtgggattttttttttcttactggtttgagttctttgtagattctgtgtattagtcctttgtcagatgcagactttgcaaagattttctcctgctctgtgggttgtgtgtttactctgctgactgttccttttgctgtgcaaaaactctttagtttaattacctctgagctatttatctttgtttttattgcatttgcttttgggttcttgattatgaaatccttggctatgccagtgtctagaagggttcttccaatgttatcttctagaatttatatagtttcaggtctcagatttaagtccttattccatcttgagttgatttttgtataaggtgagagatgaggattcagtttcattctcctacatgtggctagccaattatcccggcaccatttgttgaaaagggtgtcctttgctctcccctctcccctctcccctccccccccccgtctccccagggtctccctctccctctctttccacggtctccctctgatgctgagccgaagctggactgtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcctgaggtgcctggattgcagacggagtctcgttcactcagtgctcagtggtgcccaggctggagtgcagtggcgtgatctcggctcgctacaacctccacctcccagccgcctgccttggcctcccaaagtgccgagattgcagcctctgcctggccgccaccccgtctgggatgtgaggagcccctctgcctggctgcccagtctggaaagtgaggagcgtctctgcccagccgccatcccatctaggaagtgaggagcgcctcttcccggccaccatcccatctaggaagtgaggagcgtctctgcccggccgcccatcgtctgagatgtggggagcgcctctgccccgccgccccgtctgggatgtgaggagcgcctctgcccggccacgaccccgtctgggaggtgaggagcgtctctgcccggctgccccatctgagaagtgaggagaccctctgccaggcagccgccccgtctgagaagtgaggagcccctccgcccggcagccaccccgtctgagaagtgaggagcgtctccgcccggcagccaccctgtccgggagggaggtggggggtcagcccccactcggccagctgccctgtccaggagggaggtgggggtcagcccccgcccggccagctgccccgtccgggagggaggtggggggtcagcccctgcccggctagccgccccatccgggaggtgaggggcgcctctgcccggccaccgctactgggaagtgaggagcccctctgcccggccaccacccggtctgggaggtgtacccaacagctcattgagaacgggccatgatgacaatggcggttttgtggaatagaaaggggggaaaggtggggaaaagattgagaaatcggatggttgctgtgtctgtgtagaaagaagtagacatgggagacttttcattttgttctgtactaagaaaaattcttctgccttgggatcctgttgatctatgaccttacccccaaccctgtgctctctgaaacatgtgctgtgtccactcagcgttaaatggattaagggcggtgcaagatgtgctttgttaaacagatgcttgaaggcaacatgctcgttaagagtcatcaccactccctaatctcaagtatccagggacacaaacactgcggaaggctgcagggtcctctgcctaggaaaaccagagacctttgttcacttgtttatctgtggaccttccctccactattgtcctatgaccctgccaaatccccctctgcgagaaacacccaagaatgatcaattaaaaaaaaaaaaaaaaaaaaagaaaagggtgtcctttccccacttgtttgctttgttgaagatcagttggctgtaagtttttggctgtaaataaatttctgagttctctattctgttgcattggtctatgtgcctatttttataccagtaccatgccattttggtgactatggctttatagtataatttgaaatcaggtagtgtgatgcctccagatttattctttttgcttagtcttgctttgactatgcggactcttttttggttccatatgaattttagaattgttttttctaattctgtgaagaatgatggcggtattttgatggggattgcattgaatttgtagattgcatttggcagtatggtcattttcacaatgttgattctgcccatccatgaacatgggatgcgtttccatttgtttgtgtcatctatgatttctttcagcactattttgtagttctccttgtagaggtcttttgcctcctcggttaggtatattcctaagtattttattttatttttattttttgcggcttttataaaaggggttgagttcttgaattgagtctctgcttggtcgctgttggtgtatagagaagagctactgatttgtgtatgttaatgttgtttccgtaaactctactgaattcttcctcagttctagcagctttttgaaagaatctttagggtttttgaggtaaatgatcatatcgtcagcaaacagtgacggtttgacttcctctttaccgatttggatgccctttctttctcttgtctgattgctctggctaggacttccagtactgtgccaaagaggagtggtgagagcgggcatccttgtcttattctaattctcacagggaatgctttcaacttttccccatttagtattatgttggctgtgggtttgtcatagcttttattacactgaggtatgtcccttgtatgccaattttgctgagaattttagtcataaagcgatgctggattttgttgagtgctttttctgcatctattgaaatggtcatgcaatttttgttttcaattctttttatgtggtgtatgacatttattgacttgcgtatattaaaccatccctgcatccctggtatgaaacccacttgaacatggtggattatctttttgatatgttgttggatttggctagctagtattttgttaaggattttagtgtctattttcatcagagatactggtctgtagttttctttttcagttaatgtcctttcctggttttggtattagggtgatgctggcttcatagaatgaattagggagggttccctctttctctgtcttgtggactagtatcgaaaggattggtaccaattcttcctttaaatgtctggtagaattcagctgtgaatccatttggtcctggactttttttttttgttggtaactttttaattaccatttcaatcttgttgcttgttattgttctgttcagggtatctaattcttcctgatttaagctaggagggttgtatttttccaggaatttatccatctcctctaggttttctagtttatatgcataaaggtgctcatagtagccttgaatgatcttttgtatttctgtggtgtcagttgtagtatctcctgttttgtttcttattgaggttatttggattttttctcttcttttcttggctaatcttgccaatgatctatcaattttatttatctgttcaaagaacctgctttttgtttcatttatcttttgtatttttttgtttgtttgtttccatttcatttagttttgctctgattttggttatttcctttcttctgctgggtttgggtttggtttgttcttgtttctctagttccttgaggtgtgacctcagaatgtcagtttgtactctttcagtctttgtgatgtaggcatttagggctatgaactttcctcttagcaccacctttgccatatcccagaggttatggtaggatttgtcgttactgtcattcagttcaaagaatttttaaatttccatgttgattttgtttttgacccagtgatcattcaggagcaggtaatttaatttccatgtgtttgcatggttttaaaggttccagttggagttgatttctagtttacagtcatatatagctcagttgtgagaagaagtttggtctcaattttattaacctgtatattggttttacttgagaggagcaatttcacaggacataatggaaaattgaaaaggcactttgggcaactagagtttagtgggacaaagttcatagttgtcaaaatcattttctctttagagttgaaggcagtatggcatggtttacaaagattaaactgattaaaagattataatactcggattgaagacaaccctaatagacaagtatgctatcaggctcaaatagaatggatcaagcaaatcttgtaagggctttagtcttttactgtatatgtttatctaaaaagttttttcccgcaaagtgaacatataatattgggttgtattaaatgccattttgtcctggtcttactcttgtgttatataatcataacattgagaaaatgctattgtttctatttctgtagtttctgatgaagtccatttttaaaactgcacgttgctgatatatattcattatgagtccacattttaccataatataagtcattttcctagacttttgggtgattttatgtggaagagattatctttagaaaatttatgttgcgatttctgatgagctcatgttaaacaggcacgatgagtgagatctgtatacttcaagccttagttttttaacttgtttggagcagttggaagttggcagttctcatgtaaagtgctgctagttagagcaaatagcctctgcagaaggatatctccgagtttaacttgaaattatctgtctctgatatacgaaaatggattttgttttctgcatagccccaaagttgatattttaagcaaaattaagcccatttcaggtgaataaagtatgtaaaaagaaataacagtaaagatttatttatatttatttatttattttgtggagatgggatctccctattgttgcagtctgcttagtccctagctcagctaggtctgagttcttgttccacaaccaagaagaataaggcgtgtggacaccagagagtgagtagagtaggatttcttaagcaaaaggaaaggtctcagcaaacagaggggccctgaaagcaggttgccagaaacgggacttacttctggtcttttgtgtggcagaagccaggaagtcgtcgtggattttgcccaaataggagaggtaaagctccctcctaggggtgttgcatctgcccacgcttggagttggccagagtgacttcatcttggtattactcatgagtgcctaagccaaacccacaggtgctaaaaccacaatgttaatgtcatgttaatgacataatgagcttggtcaagttaacaacatttaggttgatttattgcacctgcgcctaagttgggtcagtcgtttctgagcaacaccctggcacaaggtgaagttcgtaaccacatttcttctggttagctgcagaagcagtgtaggtgctgtcctacagttgttcctgtgaacattgtccttctcccaagaccctccgtctctatctgcctaaccagcccctaactgcctcctctctcactgtgttacccaggctggtctcaaacttctgagctcaagcagtcctcctgcctcagcttcccaaagtgttgcaatcacaggcgtgagccactgtgtccggccagaaagattttttggtttgcccccgtgttttgcttgctttggtttatgttttgaataggacttttactggaaattggtagattatttttcttttttttttgagagaaagagaggaaaaaaggtgtgaaaatggaaaacaactatttcactttttaaatgaggatagggattttttttcattcaaaaataagttttattggagaaatagaaaacttctccagtgacagtatatgatcctttggaataaggggaatgttaatgctggggatacattattgaggctattaaacatacatttcagcttatggaacccctcactccaacacaggatttgcctgatctcatttttctttgacaggactaattcgttaagatagatttaaagccagaatataactatatacgttatttatgtgcttgtatactgactctgagatcaaattaatcatcacatattcttagagttgtgaattgtgttctaccaagtaattcagattgcatttgtatttccgcctaaccaaaataaagccagaagtggtaatatctgtaactcattagaaaaagttgtcagcctaactacattaaaatatttgctaaatatttaatacaactgggatgggcagaaaccttcagagcttttccctatttgaaagaaatttttagtttaagaggaaaccatctaggaaaaagcaggcagtttctcagaagtaaaacctaagagtatactgagaaagaaaataccttttccaagataaaaaaaaaaatgaacaacttgactaaggacagaacaagaagtggtagtggatatagtggcatgggtagatttcatgaagtagcagaggggattgctatactggaagttgactaaggacataggctggtgataggaagtaaagaagaaaatttattgaaggaagttttctaagcattattaaaaacaactttatcttgaattcttacagattttacagagctcttgcttgtgggagcgtaggtccaattgaatagttcattggtgcattcattccttaagtatttggatatactgggcattaggtacattgctggtgatatagtcataaatcaaatagacatagtgtctgcccttaggaagtttaaagtctagtagcttaaacttcctgtgagtattgtcttcaaatccagacacacacacacacacacacacacacacttttgaaacttccctacaattctttgttttgatagttatatttctgatactttttttggatctttctactatttcccatatctctggtacactaagttttcctatgggctccttcgtcattcctttttagaaaacttttattatggaaaactttaacatgtataaaaataagagctggtggacccttttgtcctcatcacccagctttatgatcagttttgtttcatctgtactaccagtgctacttaccatctctaggttcattttgaagcaaatcccagacattttataatttcatttgtatttatttcagtatgaatttctaaaagatagtttttcaaaacataactacattctattttacacctaagtaaattaagaatcattgtttaaaatcatcaaataaccagttgttgatcaagtttccccaactgccaaatacattttaatgtgccatttaaaaaatgattatgaatcatcacaggagcaatttgattgtaagctctgcatatactttttcttcctggaatggaaaaatgagagaagtgaatggtcagaagaaaaattagtgtggcctgacttgaaataaagaaataaagcaataaagaaataaatacaagcaaatgatgatagaataacttagaagaatgcaaaaactaaaagcaaaattaagatgaagaaaaataaaaggaccaaaccaatggatctaagaagaaaagaaaaaaaaaatgctacagtcatctcaagtgaaaaagcagatggtaaatactagagccagttttataaaattatagttatgatattgattttttaaattattacttagttgaatttctccagctaacagcttctatttctcttaagcgtttaacattcttggtcaaaatacataatatttttggaacatatttttaatgtaattgttatttaatgccttcctaaataatgataatgtgaacttaaactctttattgactttcatacaaaagtagaaatctgtcaacagtatttactcatattattttatttaatttgaagataagaacttggaagaataacatcatatttgtgttctctaacataatacttcatttagctttaaagaatttcccccaaaacaaagtgctacattagagagtattaacatagaatggatataaataaatgagttaatgagtaaatgaattatcaatgtaacactaagagaactgatatattatggtacctttgattctgtgctatactccagagcctggaacagtgcctagcataattataaatactccataaatatttttgtatgaataaattaaaaacctaacttgaattgactatagaaaggcatttaaaacaaaagaaaaatagaaccagatgtttaacacaaatatgaaggcttactgatgacttaaactcaagggtaatctctttatcatttggcagtagtttctttttctttttttcttctacagccttattgagatatagttgacacaaaataaacggcacatatttagagtatacaatttgttaagttttgacgtatacagacacccatgaaaccatcaccacaatcaagatagtgaacttatttaacactctgaagtgtgctcatgtccgtttgtgtttcctccaccacttcccaccttcatccacaggtttaacacagatctgctttctatcattatagatgagtttgtgtttcgtagaattgtatataaatggagacctacagtacatactattttgtctggcttcttttattcagcgtaattattttgacgttcatctatgttgtatgtattaataatttgttattcttaattactgactggtattctattatatggttatgccaaaatttacttatttgcctgttgatgaacacttggttgtttccactttggggctgttataaataaactgttgtgaatatttatgtacaagcctttctgtgggcatatacttccatttttcttggctaaatacctaggagtggaatggctgggtcgtataacagtgtaggtttaactttttaagaaactgtttgaactgtttacaaaagtgattgtgccattttatattttcatccagcagtgtctgagacttttagttctcatataccctaactaacactttgtatggttatcttttaaattttagctattttagtgtatgtgtaggggtatgtcatggtttttttttgtgtgtatgtggtttttttttttcattttcctgtaagtattgttgaatatcttttcatatgcatattttcatctgcatatcatctttggtgaaatgtctgcttaaatcttctgcctattttttaattgggatgtttgctttcttcttattgagttaaggttctttatatatattctagatatgagtcctttgtctgatgtgtgttttggaaatttttgtttggaaattctagtttgcagcttgccttctaattttcttaacagtgtcttttgaaaggcaaaagtttttaattttgacaaagttcagtttattaagtttttaaatttatgcttttgtatttcgtatttatgaaatttttgtgaagcctaaggtgactagaattttttctggtttcttctaggaattgtataattttagctcttacatttaggtctaagatccattttgaggaatcacgtaaactaagaattgaggttcatttttttgcatatagctattcaattggtctagaatcattttttcaaagattatgtctttcctattagttgctttagaacttttatcaaaaatcaattgactgctgggcgcagtggctcatgcctgtaatctcagcattttgggagtctgaggtgggtggatcacttgaggccaagagtttgagaccagcctggccaacatggtaaaactccgtctctactaaaaatacaaaaattagccaggcgtggtggcgcacacctacaatcccagctacttgggaggctgaggcaggagaatctcttgaacccaggaggcggaggctgcagtgagccaagatggtgtcactgcactccagcctgggtgacagagtgagactccgtctcaaaaaaaaaaaaaaaaaaaaatcaattgaccatacatgtgtgtcatgtgtgtctgtctttctgttagtaccacactgtcttggttactagctttgtagtaagtgttacaactgggtagtgtgatttatcgttctttttttgaaattttgttcattatatgttctttgcattttcatttaaattttagaatcaacttgtctgtgtgttgctagcacatagaaatacaattgattttttatatattgatcttgcatcttgccagtttgtcaaactcacctggtgcttttttgtagatttcatcagagtttctacataaagtatcatgtcatctacatatagatacacttacttcttcatttccaatatggattctagttggcagtagtctctttgagtcattaatcttaattaaatagtacagtttactattaggataacttacagtaagccacaaattaattcctccttcatttaaaactaaaatccttaccaaagtccaaatttcagcttttaggttttcttagcaagagttttaaaatattttgagattcctaatggtaatgaaggaatttttttaattcctgagagtacactcactaagctgacagcattttgacatttttcagtttacatatttttatatattcaaattctcttaattatcaataataaaaggctttcacaacatcattccttattgagggtataaaagggaatacatatttaggtcattaacatctgtgacctggaaataaaattgacagattctggcccagcgtggtggctcacgcctgtaatcccagcactttgggaggccgaggcaggcggatcacgaggtcaggagatcgagaccatcctggctaacatggtgaaaccctgtctctactaaaaatacaaaagattagccgggcgtggtggcgggcacctgtagtctcagctactcaggaggctgaggcaggagaatggcgtgaacctgggaggcggagcttgcagtgagcagagatcatgccactgcactgcagcctgggcgacagagcgagactccgtctttaaaaaaaaaatacacacacacacacacacacacacacacacacacacacacacacacacaccagattccattctagatgctattccttaactcatttaatccttgagagtagcaacacccagtagaggttttatccttttaactttcttgaatatacgttgaacttaaattcaaatttctttaatttaggtatatcagcccaatatgtacttgttttaaagttatttcgaaagtaattttctctttctagaaatacgcctcatttttttcaagaaatggcgggtttcgctatagttcgactctgatctaagtcacaatacagttctagaaacaattttccaaatcttaaagcaggtctggtttccacatagaaatagagtaataatggaagttctgattgtaactaccaagactcaagatggaatttcttcttccataatagtggtatgagttccagcgaagcaagaattagggagtagcaagacgcctatgaagggaatacgtaggctcttgagcagaggcagattcaggtttgggggagtcacctgaaacctattcaacttctggtgctgtctttatgaaaaggaatacaaaatattaaatgtttacaattggctgtcattattcatgttatatatatatatttttttttttgagacggagtctcactctgtcacccaggctggagtgtagtggtgtgatctccgctcactgcaagctccacctcccaggttcatgccattatcctgcctcagcctcccgactagctgggactacaggcgcccaccaccgcctcccgggttcacgccattctcctgcctcagcctcccgagtggctggttctgcaggcgcccatcaccatgcccagctaatttttttgtattttttagtagagacggggtttcaccgtgttagccaggatggtctcgatctcctgacctcgtgatccgcctgcctcggcctcccaaagtgctgggattacaggtgtgagccaccgcggcccggccaattatattctttaatactgaattagcaatagtgaaccactattcctaggggaaatacagagttaggttcctgtgagatcaacattttcatcaactgattaacatatataaccttgttttatgtgtgtttctatttcaagaaaccttatttaatgtatattgttgatttattaacatggataactcatatgtgaacaaagcttatctgacatacatactttctctgtaaagcacacacagctttcttgcccttagggacactggacagcacttcactactatgtttgggggccattttcaacagtgaaatcactggaaaaaaagcacaaaaatgagaaaaacagctaaatatactgcagaaaggacatttgtttatagtaagagatttgaaacaagaaggcaaaaagccaccttggctgaaattacgtgccttggagtactcaaaattttcattgcacgtgtccatgaatgaccgtgaaagcaccacaagtattgatttgggtgttacaaataaattctagtaggtaaattcacatggaatctgtgaatagtgaggattgactccaggatgaaaaaagaactcctaacaagttacaattgtataaagctgacaaatgccacaaatactaaaccccagaaaaataatttttaattaactgcttgatgctctctataatactgttttcccttacatttcttagctgcataccctttgattgtatgacagtgatttgtaatgttttctgtaaagagaattgagaatgactttgtaatattaatattgtctataaagagaatggaaaatctgaaaagatttttttctctagcatggttgatttaaaatgttgtttttaaattattgatatttgtggtacataacatttgaaacttcacatacatacatacttcatatttgtagtactgctgtaagcttgtgccgtttagacaggatttcagataattttattttatgtgattctcatcagaaaaggaaaaaatggttcatataattgcttgtgctacatttttaattgtctacactacattttcaagactattagtgacagaagagaacttctattttgactaggcatcattgagaaatgcctccttcatttctgttattaccttgtacttaccatgctaggaaccatgggacacattcatatcacagtgcaatctctcaccctgtatctatttatgtgacaaaaatatctctgcacaaaagcaactgtgaactacataaatatatctctaaatccaaactaaatagttctcagcttaatttctccatcacaggatcccagaaatgcagatggccactttatttgctacccaacactaataccgacgctggaaaactgagatggcaccgaatcctgagagacagatatcttaacttatttaacttaactcatttaactcatgatggtgaaattttacaaaaacacatccaggtaacatagcacaagcctctcccagggcctttgaagggaaccgtgcaagcaagggtcccttaagcttacatttcagcaaatctcctaaggaagctcttcccattgaactaggagggcacctcaagttcctaaggggttctcagtcctgctcccaagataggagattacttgagaaaaccaacattaagaaacctgaaatagagaaagctatattgcaaaattagatgaaaggtaatagatgctgaccctttaagattgagttctgtctctaatacaaagatataacagagaatgtccagattgcctctagttaaaattttgttttaatttaatactagaacagcagctttccattaaaaagtgctaacctctgactaggactcactttccatctctccttagagcctgcagcactttctcagattgaccagcctacaattgtgtatcaactgcttgtttactaactgccaagaacctttgtgtaagtcagccaataccctaggtgtgagtgttggttatggcagaccataactgagcagcctttccaatgacttttttttttttggtctctgttcagtaaccttcactgcctcctcttcctctatccctcccctctaattgcctagctaagggtagattaccaaatgagaatctaacatcaagtaagttgtagatatggctcattgataagtcataaatgcatacaaatacatctctgtgcaattgattaaaacatatggataagctctgaccctgaaaaatgaacatgataattctcacacattaaatattgttctgtggtaggttgtctaaaaaagtatttggatgtttgtgtacttggattatgcaaattcatgtatcataaatttgacctatctaaacctaaaataccaattgtgataagtaatttaacaggagtgatgtatgtgatttgcatagcttgtatcacttgaaaaacttctctgtgaaaggttcgcactgatttcttttctatagaaaattgtgacattctagtcattacagtgatgttatactaggctcaaggcttaggtcagttgtatttgatagatgataaaatacccagatcactcaaggtcttattaaagtcctttggttgtgatagggagcaggtgtttcttcttgttcctctagtatgttaaagtacattaaaggaagctgtgaggttgaagaacatttgtaagctgccatttctgagcactttctgtatgcttagtattatgcaaagtaactcttatgatgcaggtgttgtaatgttcaatatgcaggagagtaaattgagacttagagaggtttgtacttatctttgtctttaatgatagtatgagaggtgatttttctttctctgggttataaaaacttgaacttaatagtgatagaatgtagaattatgtgctaagtagattaaaactgataatcagaggtatgggtagaaagcctgacattttacagttgaagtattaaacacatcctaacctgtccattacacctatgggacatcttctttccagcttataggaaatgagtaatagttgctcttaaattttgttccatatatagtagaggtatcctggaagattcaaaatatatttatgatctaagtaaatgttgtcaggaaaatttcagttttagcagatcagacattaggaaaatattgctactagtgtgaatagaaagtaatgtggacattggagaatttccttaggtttactgaggacctaaatgtatgtgtctcattaaaggttaaaaaaaaaaaagaagtctcagaagttatattaaagcaaaatacaaaatggaacaagaccttggggttttgcttagggagcatatatttctgcccactttgttggaggttgctcttcctttttgccaccatgtttttacagattttattggcctagaccagaggtcagcaaactaccacccttaggccaaatccaacccaactgtttttgtaaataaagttttgttggagcataactatgttcatttgtttgtatatcatctactttcaggctacagttgcaaagttgaataattttgacagaaaatgtacagcctgcaaagccaaagatatttactgtctcctcctttacagaacaactttactgaccctggcctagacagtgatgaaaataattcttaaatgtttttcctcctattttccttttcttcctcttcctgttccttctattcctttagctatatatgaactcttgttggtattccaggtgtcagctttctgagcatatgcctttgtctgcctcctgttgaggttcccacctccaaacagttatttttttccatttttgaggctaaggatttttactcgttagagcaacaggactagacatcaggagttatgtaagtactcaggaatataccccttgctatcttacagactgaccaccatttgtttgccttttgaagagcacagtgatcttcttaaaatgtagtcatgttaccgatgataaagctgtcaaatgtacaatgatgtctttttaaatattgggaccaaatcccaatttattctgactaatatcgggttccacaagagggaatttgaagcatctctgctaatgaaatcagttttcattttaatttatctttgattttttgcatgttggaggtgaggagggaatgagggtaacacttttcatttagttcttaattttcttctgttctactctacaataaagttctgatggtatattggagctattatggtcatgctatcacaagagggtctaggatctaacagccagaaagattaagatgcaaatgcaaaaggaaccatacagatttcaatttggagaagtagggagtctctgacgatatttgaatggaaagagacatgtcattatttttaccattgcttcttattttctctcaactattccatgtattttccgtagttcttacaccttttattcctttcttttcattggtataaacattgttcattgttaaacaaaatatatcacctataaacatctgacacttttgtatgcccatagactaccatttctttgataaagatgaagcatatcagaaactgtctaggattgttagaattctagttaacattctgccaataaaacagccctaagctttggacatttctctttctcagatctacctgaggttggtgattttttgtttgtttggttggggatgttttggtgggaagggattgttttattttatttttaatctgaatcttcttcccttggagtgatagccgaacttgctgagtttgtgagtatcagggatagaagatatcctgaagccacaagtcacatctgaaatagaaaagttgctattgtgtcccatgtgagatggttgattatgtttaaagggctaaggacaagatagatactgtgtgtttggctttgcaaccaaaggacctagtgccctgccttttgtacttaaataatggatgaaaatggaaataaagctgaactctaaggaaaagcttttaaatctaaaagagaccattcagtattcaaagcctacacactacagaggctttgaataatctccttaagttttcactatgagagttcatttcaaataaatgttatattttccttttaaataaaaagatataatgatattgttctcaagattgagagattgttgaaaaaagttggtttaccatttttaaaagaaacatattagcaaatgcctctgaaaatacacttattagtttgccaataaatgagtaatgttgcagttgtgagttaaatgtgcattaaatgtttgagaaaatattgggcttaaaatacagttttaggcttctatttctggataagatatagtaaacacatcatacactatatatattagtctattctcacactgctataaagaaatacctggctgggtgcagtggctcacgcctgtaatgccagcactttgggaggccaaggcgggcggatcacgaggtcaggagatcaagaccatcctcgctaacacagtgaaaccccgtctctactaaaaatacaaaaaaaaattagccgggcgtggtggcacgcgcctgtaatcccagctactcgggaggctgaggcgggagaatggcgtgaacctgggaggcggagcttgcagtgagccgagatcgtgccactgcactccagcctgggtgacagagtgagactctgtctcaaaaaaaaaaaaaaaaaaaaaaaaaaaaacctgagactgggtaatttataaagaaaggaggcctaattggttcactgttctataggctgtgcaggaagcatagtggcttctggggaggcctcaggaaacttacaatcatggcagaaggggatgtgagatgtcttacatggtggagcaggagcaagagagagagcagggaggtgccacacacctttaaacagtcagatctcctgaggactctatcgtgagaaaaatactagcagggtgttaagccatttgtgaaaaacggccctcatgatccagtcacctttcaccaggccccacctccagcactggggattgcatttcaacttgagatttgggtggggacacagatccaaaccagatcactgtaattcctgctaattacaaaaaaaaaaaaaaaaaacaaaaaaaaccacaaacttgtaatttcctattttttgtgtgtttacttatttattttacttcctatatatcccagccaagggtactagaggcctgcagctagaaaccttagtggacagagaggggggaaaaaaaagccccattttaatgatatctatccagttgcagtcccttccccaggtgctgtagctatggagattgtgcatgtagccctgtccctcattcctgtcctgcaataatgagggtgcccctcccactcccactgaacactgttcctaccactcccactgggcactgctgccatggaaactgtggatggagctgcaataacaagtttgcagccctccccaatggatgctacagccacagagactgtgggcaaagccctgaccgccgtttccatcccctaaccctcccaactagagtgtggagggaggattaaaaagaggagggagttagagaaagagacttaaaaaaatctgtgtttgaaatcctgggcagatttcttagcatccctttcatgaaactgattagaatcaatacagaaaaaggttttagaattgggctctgctgtgttataccacccaggtttcagactggcctctgggtagcccagtggggcagaacagaacaacactaaaaagaccctaacaattaaattgacatttgattcacagcccataaaagttggctaagacatgcattgtgaatctaaacaacttgattgcctatcaaagtagaaaatttaaacaacagagtctcctaacataatattcatcatatcaagaaccaagaaaatcttaattcgaatgatgaaagttaatcagctgacactacactaagttgacacagatgttggaattgtctgacaaggattttaaagaagctataataataaatatactccaattacaattacagtcttgaaacaaatgaaaaaatagaaagtgtcaccaaagtaatagatgatataagggagaaacaaatggaaattttagaactgataaatataataaactaaattaaaaattagctcagtagtaaaatagagatgacagaggaaagaaatggtgcactcaaatttagatcaatataaattatgcagtctgaacaacagagagaataaagattttaaaaaggtgaagagagtcttatggggacctctgagaaaattacagaaacatcttcatatttgtatcattgaaatcccagaagaagaaaagtaggagtgagagattgaagaacatatttgaagaacagagagacacagggaaaaagccagtgaagtcaggtagtgattggagagatgtgtctacaagccaaggaatgacaaggatggctggcaaccaccagaagccgggagagagacatggaacaacttcttccttagagcctccagaagaagccaaccctgccaacaccttgattttggacttctggcttccagatctgccaagaaaccaaaagacaggatgagaatcaacactttgtaagagccttcagtggaccagaagctggaaaggccagatactcgctttcctagcaccctccctgttttgtatgccctctgctaggatggctgtgcgatttgctcctggttgattcaatataagaggaagttggctggtgggaacgtcagagaaatgtttttctttctgataaaaatggagagcacataagaaaaaaacttttagtgtacttcttcttctggcctttggatatgatgtgagaagcttgagaggacatgatgctttggagctgttacaaccatcttgtgaccatgaggcattcagataaaaagctaacattctgaggctggtgaagaagagactggctggaaacaggaaaacattcctgggactgtcttctgattttcttattaggtaaacaacgtgttcttagtgcttaagcactttttttttttttaaatacaaccaaaagcagtcttaactgatgcacaagccaggtgcctgacacaatgggggtcaatatgtatttattggataaaggaataagagaaagaatgaatgaaacttctactaaacctacctatactccagctgtccctgttaacaggacctcatgtggaatacttgaaggctgggctggaatcatctgagagcacattctcttggctgatgctggaaagagccaaacatttggagcatgcgatagcaggggatcattggccatctctctctgtattggtcttttcagtattgcaacttcaaggtagtaggattttttacaaggtagctgagggctccaaaggtagtcacttcaagaggcagagatagatggagaacaagccaggaggaatgtgtgtccttgatataacctagcctcagaagtcgcatagcatcacttctgccctactgtattggttagagcagtcatgagccccactaggtagaagaggagaggtagagatctcctctcttggtggagaggggatggttgtagaaaagcatgtggaactggaaatattgccagggctatttatttatttattagtttatttttgaaaatccagtctgctacagtgccttatatacacctctattatcacattgaccatctcgatgtcattcatgtctttcatgtctatccttctgactgaaggatgcaagcacctggaagttttagtctgtgatttattaactttagtatctctgatacctttataaagatatgtttaataaatgccttattttgaagaaaagaaaagaaattgaagaagtgacagaaaacttcttaaatttggcaaacctaaatattcaagaagctgggcaaactcctaacaggaaaaactcagatccattcccagatactttttaagtaatttgctgaaaactgaaaacaatgaaaaaaatcttgagagcagccagagagaagcagcgcattaattgtagaggaacaatttgaatgactctgggtttcttatcagaaaacatggaagccaagagaagtaggaaaactgtatcgtttgttttgagccaacatcttgctattttgcccattctggtctcaaactcctgacctcaaacaatcctcctgccttggcctccgaaagtgctgggattataggctttgaaccagatttaaaaccttgtgctgaaaggaaagaattaccatccagaatttttcacctagggaaaatacaacgaagtgagaaaaagacattttcggatgaaagaaaactcagagacttcattgccagcagacttgtgtaaaaaaggaagttcttcagacaaaaaatgatgacagaagggaattctgctggaacatcagaatgaagaaagtacaaattaataggtatagggaattgcctaatcttctcctgttgagtttttaaaatgttgggtaagaagcaaaattttttacaatggccgatgtggttcttaatgtttatgaaggtgatttttaaaacaatgtcataaaagtggggagagtaaaggaacctaaaaagtaggaaggtttctgcattccatttcaaatggcaaaatgttgagtagactgtaataattgttgtatatagatataattatccctagattaactactaaaaatgctctataggccaggcacggtggagcacgcctgtaatccctgcactctggaaggccaaggcaggcggatcacctgaggtcaggagttggagaccagcctgaccaacatggagaaacctcgtctctaccaaaatacaaaaattagccgggcatggtggcatgtgcctgtaatcccagctactcgggagactgatgcaggagaagtgttgcttgaacctgggaggcggaggttgcagtgagctgagttcgtgccactacactccagcctgggcgacagagcaagattctgtctccaaaaaaaaaaagctctataaaaagatattttaaaacactatagaagaccatactttacaggaaccatttctgtagttccttaaaacactatagataaatcaaaattaaatactaaaaaaggttcagagtatgtatagacaaggagaaatgggaacaacaaaaggagcaaataaaaaacaataaagtggcgtacttaaatcccaacatgtcaataattgcatgaaatataaatacaaatgatctaaacataccagttaagaaagagagaaaaaaaaatacaggacaaagactggcagaatggtgtttttttgtttttgtttttgtttttgatacagagttttgcagagacagggtttctccatgttggtcaggctgatctcgaactctgacctcaggtgatccgcccacctcggcctcccaaagtgctgggattataggcgtgagccactgtgcctggcctattttttattttaatgatccaactatatgctgtccccccaagaaactaacttcacatataacgatataggtagattaaaagtgaaatgatgggcagatacaccatgcaaacaataatcaaaagaaagatagaatgactgggctgggcacggttgctcacgcctgtaatcccagcactttgggaggctgaggcgggcagatcatgaagtcaggagatcgagaccattctggctaacacggtgaaaccccgtctctactaaaaatacaaaaacaaaattagctggcatggtggtgggcacctgtagtcccagctactcgggaggctgtggcaggagaatggcatgaacctgggaggcggaacttgcagtgagccgagatcacgccgctgcactttagcctgggcgacagagcaagactccgtctcaaaaaaaaaaaaaaaaaaagtacagtgactgtattaatctcagacagaatagacttcagagcaaagaaaactagcagagacaaaggaagatataacgataataaaatgatcaatttaccaaaaaaatgtaattttaaacatgtgcacttaacaggttttcaaaatatatgaagcagaaactggcagaactgaaaggagaacagacaaatatagttggagactttaatatccctctttcaataattgatggaagcattagaccgaaaacaaacaaggtcattcatcatgaccaagtgggatttatccctgggacacaagaattgttcaacatacacaaatcaatcattgtgatacatcattatcaacagaatgaatgacaaaaaccgtatgatcatttcaattgatgctgaaaagcatttaataaaatttaacttcccttcatgataaaaaccctcaaaaaactcggcataaagggaatatacctcaacataataaaagccatatacaacagacccataactagtaccataatggggagaaactgaaagacttttctctaagatctggagcatggcaaggaggcccactttcaccactgttattcaacatagtgctgattactctaggtagagtaatcagacaagagaaagaaatgaccaacatccaaattagaaaggaagaaatcaatttattcttgtttgcagactatatggttcaatatttgaaaaaatctaaagactcttccaaaaaaaaaactactagaactgataaattcagtgaggttgcaggtacaaagtcaacacacaaatatcagtattgtttcaaagtcaacacacaaatatcagtattgtttctatatgccaacagtgagcaatctgaaaaagaaatttaaaaaagtaatctcatttgcaatagctacaaataaaattaagtaacaagaaattaaccaaagaagtaaaggatctctacaatgcaaactataaaacattgatgaaggaaattgaagagaacataaaaaatggaaagatattctatgttcatggattggaagaataaatattgttaaaatgtttatactatccagagtaatctatagattcagtgtaatccctatcaaaataaccagtgacactcttcacagaaatagaaaaaagaatctaaaacttacatggaatcacaaaaaaaccagaatagtcaaagctatcctgagcaaaaacctcaaaagtagaggaatcacactgcctgaggaaactggaggaatcacactgcctgacttcaaattatatactacagagctatagtaaccaaaacagcatggtaccggcatatagaccatagaccaatggaacaggtggagaacccagaaacaaatctgttatctacagtaaactcattttcaacgaaagtcacaaacttacactggggaaaggaaagtctcttcaataaatggtgctgggaaaactggatatccatatgctcaggaattatattagaccccagcctctcaccatatacgcaaatcaaaatgaactaaagacttaaatctgagacctcatactatgaaactactaaaaggaaacattggggaaactctccaggacactggtttgagtgggtaaagatttcttaagtaatacccgataagcacaggcaaccaaagcaaaaatggacaaatgggatcttatcaagttaaaaaccttctgcctgcacagcaaagggagcagtcaacaaagtgaagaggcaacacacagaatgtaaattagtacaaccactatgaagaacagtttgggcgttcctcataaaagtaaaaattgaactaccatatgatccagcaacccagctgctgggtatataatgaaaggaaatcagtatattgaagaaatatttgcacttccatgtttactgcagccctttccacaatagccaggatttgaaagcaacctaagcgcccatcagcagatgaatgaacaaagaaaatatgtgatacctatacacaatggagtactatccagccataaaaaagaatgagatcctgtcattagcaacaacatggatggaactggagatcattatcttaagtgaaataaaccaggcaaagaaagacacacttggcatgttcttacttatttgtgggagctaaaaattaaaacaaattgaactcatggagatagagactagaatgatggttaccaaaggctgggaagggtagttgtgggggcgggtaaggggacgtggttaatgggtacaaaaaatagttagaaagaaagaataagaaagaaagaatatctcacagcacagcagggtgatagtcaataatacatttaaaaataactaaaagagtataattggattgtttgtaacacaaaggatggctaccccatttaccctgatgtgatttttcatgcatggtatgcctatgtaaaaataccttatgtaccccataaatatatatacctactatgtactcaaaaaaattaaaaattaaagaaaaacaatgctagaaaaatagaaactttttacttaccagcaaccccgttaaagaggatgaaagagaagccatagactgagagaaatctttgcaaatcacatgtccaacgaaggcatgtatagacaatgtattaagaactctccaatctcaatagtaagaaacaatctaattagaaaataggcaaaagtcttgtacagacggctatgcaaaagacatatacagatgacaaataagcacatgaaaaatgttaaaaaatcattagttattagggaaatgcaaaagacatgatgagatacaattagtcacctgtcagaatgactaaaataaaaaatgccaagaatgtggaacaaccagctctttcatgcattgcttatgagaatgtaaaatggtacagccattctaggaaacagtttggtagttctccataaacataccattaccaatatgatccagcaatcacattcctgtatatcctagagaaaacccatgtccacacagaaacttgtacactcatgtgcatagcatcttagtttgtaataaccaaaaagtggaaacaacccaaatgtccttcagtgggtaaataaactgtgatataatccacataatagaatactacctagtaataagaaatgagctattacacacaagttggatggatctcaagagcattgtgctgagtaataaggcaatctcaaaagattaactactatctaattccatttataatgctcttaaagtgactaaattatagtgatggagagcagttcagcgggttccagagattaagatttggggaagagtgtacctctaaattggaagtataaggggtttctttgctttgatggtacagcttgtatcctaattttggtggtggttgcatgagtgtatacgtattataaaatctgagtgcacgtgaaaactggtaaaatctaaaaaagtctgtagttaatagtattgtataatgtcaatttcctgattttgataaggtactattgttaagtaatatgttctccttggggaaagctttttggaaggtacgctgtaagtatagtaactctctgtactattttggcagtttattatggatcttaagttatttcaaaataaaagtaaaaaaatacagtgttaaaaatatttgaggagtaaagaataaaatgaactggttacagtactgttcattgaggtggtttgagaaaggtgatcttgaggtgttttttgttttttgttttgtttttttttcattaaaaaaacaataatagctggggattccagagaaattcatgctcagctaacagtgtatttttcatgtatggctggctgcatggagaaatgagacaaagactccgtcttcgagaagaggtatccagatttgaaatctagtctaattgttgttgatggtttggttttaaagccagtgaatagacaagtgctgtaagtaccagtactacccagaagaatggtactttgcagaatggaaaaaccagcaaaactgtgtaacttaaaactctgacttttatttaaaacgaaacatttggagcagcttttgcacaggaacagtttcaaccattgttttccttttgcaagtacttcatcttttacacttgatcttagccaaaaggccgagaactgatactttatctttttactcctgtgtagtaagacagggctaactattcataggcatgctttttactccttttccctttccaccctcttcctcttcccctttctgtcctcttctctcgtccgcctttcttcccctctgttctcctcccaactccccttttttctatcttatttcctcctctcctcttttctcttctcactccctttttgaaaagagtacctgtcatatttttgaggaaagagaccgtaatgaattctgtcaactaaaatgatgacggaggacctttctaaaattcaatcttaattttgtaagcatgctctttataacctcaacagttaaattgattctgagacctgggaattagggtataaacttacagagaaaagttgaggtgcttgagaagatacattttctgtgcatttatataggattgtcagattctggctcctcatgtaactcaacttctgtatccttggaggtagttttatttacattatattcttgaatgagaatatgcatcattaattatctgcctttcctttgtggcccttctgatggcagaaaaatattaccaaggttattctagcatgcaagtctcttgaaactaagttgagggttttctagagaccacctggaactcccagaggtaacagaatactgtcttgaaagcctcagtggaagaaatgccccacatttgcttgttgctttctattggatttatggaatttccatcttttaaaaatgactttaaagcatttaatagagactttcaggtaaagagcaaaagtttttaaaatgtattatttaaagtaagctaaatgtggctttacttaccaagataagctttcctcttctatgaccatatagtaactatctgcctttgctgcagtctttcagtctataaactctgtatcttggtatctttcctccctttagtttctactcttagattttacagaatacccatagggaaattgatttcctgaagcacttggtaaactacttgggcctgagctattgtgttgtccttactacttggtacagattagattgttctttgctagaggggtggaaaggatgccttagtacagtcttaactttgctatggaaatattcttgtttaatatgttaagggacaataatttctggtcttggcttttaaaagtgagcatgctttttaattgcctctttcatggttattaactgagtcttcattttaattaccacaatggagtacttcagttctcttatttgcttcattaccttttctccttggttttgaaaataatgttagagaaataaaatcagattgtttctaatataatgaaatgctttcactacactattaatgaattcgttcttcattaccagcacaaagctagatattgcaaatctttttaaacaaataaaaactgtttagtcttctgattagagcagacaaagagcacagtaaaatttaactcacctggcctgatccctttttttggtttttactgagctgtcttcactggaaataggagctatctttgacttaactccttccaatagaaggaatttcttagggaggagctggaaggatctcctggggttctgattcttaattttcagtttacagaaatagccagataggtgttttgagcctggacttcttgctgcatcttgtattgaagacatcatggtgaaatcgataagggcagtggacagtggatcaagagccctgaacaggtctcttgaacctgaacagatttgccacctgttaatttatttttatgactatggacttgacatcacctttgtctctgtagatgtaattcagttgaactaatggttattgagcatttactgtttgcaaaaggcagctggagatattatgtccagtttatatttactaaatgttttctttgttgttaatttagcctttttctgcaatgtttttggtcagtagtaactctgggcaggtgagggcaattacattgtggctggaaaatttgtactctgaagttgcttttattggtgtgtaggaaaaatctttattaaaagtcatagaaaaaaatcatttaatttataagccacaaaatcagtactattttgtaatatgttgtaattcacattgctactaatttactaagtggagtcagtggaaacccataaatcctagtagtagtgcctaagtagtagaagaacgcctatggtttactagttgattgaaaattgttctttttttgcaaagtggaaattaacctggtgtgctaatttgaaatatgtctaacagtgactatttttatattttaacctaagtaaaatatctcagcgttatgatggtgtgtttactgaattagtaatcatttatttctaaggactgctgctttccttcaaataccattttggttagaggcttattgattcaagtattgttcctaattgttgatttacagggcagagagagcaaatacagctttcagctctgttgaagcagggtcattcttggaaactaatagtgtcagatgaaatgcctcagatagtgtaaaagaaaataattgggccaggagtggtggctcatgcctgtaatcccagcactttgggagcctgacgtgggagaatggcttaagctcacaggttcggatcagcctgggcaacatgggaaaacccatctctacaaaaaactaaaaaagttagctgggctacttggggggatgaggtgggaggatggcttgagcccaggaggttgaggttgtggtgaactgtgattgcaccactgcactccggcctgagcaatagagccagaccttgtctcaaaaataataataataattgaagaaaataaaaagggacctgaattcagaagaatcctgttatatcttaaatccttatttcttgatttatatgtactatgatgacagctttgctgatgaattataattacaaaaatgttacataatgttgttagcatataaagactcgtgattgagctaccttgcaacactaatactcaaaaagaacacacacatacaaaaaactggatttattcagtgtgaaataatgtctcttgaaattatgagaataaataagtatgttcaaattaattttgtgcatacaccagctcatttatttagcctcatagtagctctgagaaagaagggcgagtgaacagggagaggttgtgtagggaggtaatttttgtgtctattttaaactaaccaattgaaaccaaatcacacaactgagttcataacagaaccttcactggaccaaaatcatatctttaacctctctatccaagctctttcattagagaatgttgtcttaagtaattttcacagatttaccttgtatttctaaaacttgaattatcattattgcaaggagctagaatatatctgcctattagtgagtctgacttttaagtagatcccatatataaaaatctcatattataaaatataatttattatgtttatagtttagagtaaagcttcttttagtaatgagacccttctatatatcttgctcatggatatgacacattttctagtcttttgcaggcatcaactggatagtataaaactaggatcagtggtaactgacaagagctatttggtaagaaatttgaaaattacaaaactatggctctgtatcccttttatagagtcccataaatctctttatatttgttgctattctggaactatgctgaataacaaaggcttagctcagaagaggggttttctatgaagttcttttcatcagaataaattcctgttcatttcagagttgttgctttattttttttttctagatacgtactctgataaacctaatcttgtgttaggaacataaataccttttctgttctttagtgtcctctgcctttttctggaacttttatgagcaagttattttgaattttccagacttttaagtattatttggacaaaaaaattgggctatggctctgagctttttcagtgtttaatttactgttatcagtacagtcattcattttctcgtatcacccttcaagtcttccattgattaccttatatgtatagacctttctcatttcagaatcaagcataatggattttccctctttctttatgtcctctatgacataaacagaaaagaattaatatagtctatcttcagcttgatttgagatatactaagcatcattcattaagccgcttgtacagattgcccttttaggtctcagctcttgtgctcaaagctttaggttctagtcaaactctgttctcaacacagtgaatatactttcttaaatgcagatgtgagtcttcttttaaatagaaaatctatagtttccaaactaaaggtcagatgtttcaattattatgttccttcactctttttttccttaaaaaagaagaagaagactaacataagatgtaatagtaggggaaattgggtgttaggtatatggggattctctgtactatctttgcagtaattcagtacatctaaaaactgttctaaaagaaaaggtttattgaagaagatatgagggacattttctttttcattcatatgaattttagtgatattcaggtactctatttctcatgaaaatctgacaaatgtcactgttgtttgtccgtacttttgatcaactgagtcaataataaacctttgaatcagttcgagaatattatttattcccaggatccttatataatattgtacagaaattaaatgatacagatctcccattcccacatgataccacactcctctgtttctctcagatcttttgtggctatagcaacaagtgtgagaatgcttattgctttaggagtctgccatgagttcacattttcaaagaatcagcaactctactacttgattgtggaaacaatattgaccaaatcttgctgaattttatcagggttctctcagattcaaaaaggctcttaactcttcctaaggtacttgatggtatgggttctgctttgatctaaaaaaagaccagcttgctgtgacacatttgaatatgaaaggtacttcttctggaggtaacttgtagtttcccttctcagtctttcctttggaatcattttatagactgcagcttttgtttctagggctctgcttgacaggacagataatatccctggaaaatagttttagagttgatgtttggtgactgcattattcaaggctcatataaattgagaactggttacattgcctcttgctatgtaggataaaagcttctgttcttggaattacccgtcctctctcttgtagacaaaatagctaggaaaactgctcagactgattttgttatatgaagaactaagatgcctaggaataatttagcaatagctcatccaaattaaagcagagttgaactttagaatggaaaaaaaaaaagaaattatcatgttagctaaacatttgctgtctggatctcccagttaaaaagtggcataatacttctcaagttagccagtatagaacatgttccacattcagttgtgaaaatggctggtagctattatcaagtatgattttttaaatgttccatgcctgatattttgtaattgttgaattcagatatccctctactcagtggcttttacttcataatgaaaaagtagatttggttgtaatatataaaattgtgaagatagatggaattaatagagaaattagagtttttcttttaagataatttgagtttcatcatagaaggtaagctcagaatgctgaaatgctgctggaataaatgaactgttttacttttttcataaagatattgatgtatgcaactttgaattcagagatgattccatttgcatgttctgagtgatgaataagtgaaagaaataaaagactgaggaataaagaagtgaaagaaagaacttatacactgctggtgggagtgtaaattagttcagccattgtagaaagcagtgtggaaattactcgaagaacttttactaccatttgacccagcagtcccattactggatatatacacaaaggaatataaatcattctaccgtaaagatacatgtatgcatatgttcattgcagcactattcacggtagcaaagacatggaatcaacctaaatgcccatcagtggtagaatggctaaagaaagtgtcatacatatacaccatggaatactgtgcaaccataaaaaagaatgaggtcatctcctttgcagggacatggatggagctggaggccattatccttagcaaactaatgcagaaacagaaaaccaaatactgcatgttctcacttataagtgggagctaaatgaagagaacacatggacacagatgggcaccacagacactggggcctatcggagggtggacaatgggaggagggagaggatcaggaaaagtaactaatgagtactagacttaaaacctgagtgagtaaataaagtgtacaacaaacccccatgacacaagttaacctgtatacaaacctacacgtgtacccttaaacttaaaatttaaaaaaaaaacaaaatgcaatgttaaaaaagagaagtgaaagaattttttaaatgtaactgcttaatttcacattgtttacagttcttctcaagtaagcttcttttcactgcaatctccttaaatatgtacatacggttttctttggattcactgaaatccaatccagcaggattctttcctgaataagaaacgtactggatcagtcctgacctattttatgatttttggtacttgtcacctgtaaagagaagttaagggaacatcaccaccaaccccacagaaatacaaaaataccatcagagactatgttcataacactctgtgaacacaaattagaaaacctacaagaaaaagataaattcctggaaacatacaacctcccaagactgaaccgggaagaaattcataccctgaacagaccaataacaagttctgaaattgaatcagtaataaaaagcctgccatccagaaaagtcccaggaccagatagctaaattctgccatacgtataagaagacctggcaccattcctactgaaactattccaaaaaattgaggaggagagactcctccctaactcattctgtgagggcagcatcattctgataccaaaacctgggaaagacacaagaacaaaaagaaaacatcagtccaatatccttgatgaacatagatgcaaaaatcctcaacaaaataatagcaagccaaatccagcagcatatcaaaaagttaattcaccgcgatcaaataggctttatccctgggatgcaagattggttcaacatacacaaatccataaatgtgattcatcacataggcagaactaaaaacaaaaaaattatctcaatagatgcagaaaaggctttcaataaaattcagactctcttcatgttaaaaatcctcaacagactagccatcgaaggaacatacctataaatagtaagacctacctgtgacagacccacagacaacatcatactgagtggacaaaagctggaagccttccccttgagaaccagaacaagacaaggatgcccactctcaccattgctgttcaacatagttctaaaagtcctagccagagcagacaggcaggcaagagaaaaaaattaaaggcatccaaataggaagaaaggaagtcaaactacctctctttgcaggcaatatgatcctaaacctagaaaatcccatattccctacccaaaagctcctagatctgacaaacaacttcagcaaagtttcatgctacaaaatcagtgtacaaaaatcagtagcatttctatacatcagtaatatccaaggtgagagctcaatcaagaatgcaatcctagtcaaaattgccacaaaaagaataaaatacctaagaatactgctaactagggaggtgcaagatctctacaaggggaattacaaaacactgctcaaagaaatcagagatgacacaaacaaatggaaaaacactccaggctcatgggtaggaagaatcagtatcattaaaatggccatagtgcccaaagcaatctacagattctatgctattcccatcaaactaccgatgacattcttcacagaactagaaaaaactgatttaaaattcatacagaatcagaaaaaagcctgaatagccaaagccatcctaagcaaaaagaacaaagctggaagcaccgcattacccgaattcaaactatactgcaaggctgcagtaaccatggtatgggtaccaaacaccatggtacccataccatgtatcaccataccaaacagcatggtactggtacaaaaacagacatatagaccagtggtacagaatggagagtccagaaataaagtcatatacctacaactttctaatctttgacaaagctgacaaaaacaagccaaggagaaaggactccctattcaataaattgtgctgggataactggttagctatatgcataagattgaaactggaccccttcctttcactatatacaaaaattaagtcaagatagataaaagacttaaatgtaaaacctaaaaccataaaaactctagaagaaaacctagggaataccattgtggatataggccctggcaaagattgcatgatgaagacgccaaaagcagttgcaacagaaacaaaaattggcaaacagaacctaattaaagagcttctgaacagcaaaagcaattatcaacagagtaaacagacagccaacagaatgggagaaaatatttgcaagctatgaaaggtctaatatccagaatctataaggaacttaacaaggaaaaagcaaccttattaaaaaggcaaacacttttcaaaagacagactcttttcaaaagacatatacacagtcaatacgtatcaaacatcactaatcattagagaaatgcaaatcaaaatcacagtgatataccatcagaatgaggcaacagaatgctgttattaaaaagtccaaaaataacatgctggtgaggctgcagagaaaaggggcatttatacattgccagtggaaatgtaaattagttcaaccattggaaagtggtttggcagtttctcaaagaacttagagagctactatttgaccccgcaatcccgtttttgggtatataaccaaaggaatataaatcattctgctataaagacacatgcaattaacatgtttatcagagcactatttgcaattgcaaagacatggaataaacctagatgcccatcagtggtagactgaaaaaagaaaatgtggcacatatatatcatggaatagtatgaagccataaaaaagaatgagatcatgtcctttgcagcaacatggatggagctggaggccattaccctaagcaaactaatgcaggaacagaaaaccaaacacttcatgttcttattaaaagtgggagctaaacattgagtacatatagacacaaataagagaatagtagacactggggcctacttgagggtgaaaggtgggaggagggtgaagatcaaaaagctgcatatcacttactatgctgattacttggggtgtataccaaaccccacgacacacaatttatctatagaacaaacctgcatgtgtacccctgaagatgaaagattaaaaaaaaaaaagagcagttgacctctctgtacaacttatctttattttcatttctctttctccctgacagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtaaggagcttgtgcagcatatgagatctctgggctgtttcactcaattaccagattattagatttctaggtagaccttcatggaacatacttatcttttcctctggatccatgaatactatacattatccagataaaatctagaagaacagtattttatcttaaaagtattttattatgtatttcatttctgatgctcatttttatgtgaatttagcaaaatcactgagtttttttcagggagcataatttaatcttttaataataatgatatgactttcactctataagatgatttcacattattgaactcattttaatatgaagtaatcatcatataaagtagtccagtttatatggactactatatatgagtagcatgagcatgcatgagaatcatctggaaggtttcataaaactccattttctgttaaggaaggtctaggctgcagcctgagagttttaatatctgacaaaagttttaggtttagggaccgtgctttgagaaccactgaggtggaccttgctggtaactttatcttcaaatgaagcctaatttgtttatgtgattttaattgtattcaggaaacatttaatgaatagtaatgtgactaaggtactatactaggcattataagcagatagaaacatcagtaagaaatttcctttctctccaaggaagtggtgaaggagtagaatatagaaaagaatttcttaccgctagtctagtgcttttctttctacaatcatgatctttaagatctaaagttgggctaccttgttaaaattgtggctttattgttttgtaatcttggacaagttacttaacctaggtcttagtttccttatcagtaaaatgaagagtaatcactttattgaattgttggtagattaaatgaaataatatatgtaatgcacttagtactgatatatgaacttatatctagtaatttttagctattatgaatagcctttattcattaaacaaatgtataatgagtgcctacagtgtgacagatactgaattaagtgatcaggataaatactaagcaagacagtacacatcctctgcactcatatcttgtgggaagtccaacatttttcaaaaaactgaggcacttcagttaatatcatttattgtggggctaagcaccttttttcacgagctacaacactagatacgaaatagggagctatgtcatcagcaaagtaactttggttccttcatttcttttgcctcctttgaaaaaaaatcggtaatatctgactctttgcagaagtgtcatgaaacttaattgagtactttctataaaatactttgagttgctctgcaagaggtcctgtatggattaaaagtattgtgttttgtcttctgtagggtgttttagaagccttattttatatatcacccgattttttatttttaactcacttcagattttaaggtgaacctctttatctagaacctagttaagctttagttttaaggttatatcttccactgatctggtctgtacttttcacggctagtgccaacagattagttataaaggttaggaagatactaaatttgtcattcaggaaaagaaactctaccagccccactatggctaacttttttcatttcatggacttagttcagtttaaacttccttgattgtggaaataatagccagggccaaactatgtttccctggttctagggggagacaactttttgtatggtagtcagaaaagtgaaaagttacagatttatcaggtttaatatatagtttagccctgcccgtgtgctacaagtggttatttggtttgtttgatttttaatccttacttgtacattttgtagtcggtagtggcaaccacagggtatgaaaatttaacatggcttgaatttcaaacactcagaatttcttaatgttacaactaaagaggatgtagaaagcatcctttctttattcatctggaatcaaaggcctagttaaggctaaatgacttacccacggtcatacagcttataaatgccagaactctggttagcacattcacttgtacatacccccagtctaagtccttatcagtaaactcatgccaaacactttacctcgttactagcagaataatctaccatcattactagaagaatgatgattagaggcacagaaactgcctggaatatctaggaattaaataattttaataatttagataccaatcttttatctgaaaagagatttcttttaagcttagaatatttttgtttttatgaagagtatggctgccatcaatttatctgcttatttacattatctatatatgtgccctttagagaaactattgaacatatttccaagaattagaggaaatagtgaattttaataagctccttgactttaattctttagttagtcataaatcagctgtgtctgttgtcattctgagttgtacaaaaaatcttgggatatttcctttgtcaccattactgtgaaattattattgttcatacataacttgacatgatgtccttgcagatggaatttagtaattcttgttcaagtctgtccaccagtgcaggaattagtttgtacagtgatcatttcatagctatatcataccttattatggttggtgtctatttttctcctccattattttatgtttgtgtgtgaaactatatcctttgtaccaagtaaaatggttaagtgaaggaaaatactaaaggtaatgcttccagtaaaaagtaatcaaaatatttcccatcacctgtacatgccatgtctattcctaatagtttatgtgccctaaggttgttgatgaaatgatcaatttagttttttacaccacaagatgtttcctcagcctgaactaactacacatactagacctgattcttccacatagattgcttgtgataattcaaaatgggaatcttgcctttatgtttaatagtttgaagtacctttcaacaatatttatttattgttttttgttttgtttttagagacagagtcttgctctgacacccaggctggagtgcgggggcatgatcctagctcactgcagcctcgaactcctgggcttaagcagtcctctcacttcagcccccacagcacctgggactacaggcatgctccatcatgcccagctagttattttattttttattagaaatagggtctcactatattgcccaggctgatgtcaaactcctggcctcaagcagtcctcccacctcagcctcccaaagtgctgggattataggtgtgagccactgtgcctggcctcaacaatttataatttggttttttaaaggatattgactattttaggctatatatgatgactagctttcaaaatgcttttctagcttatataaacaatattgaatagatgatttagtgatagagaactccacttaaattcagttccccacttcaatctttttccttgtaaaaattaaaaattattcaccttaacagttaaactacctaggctgttctgtctttccttctcttgtctttttcccactgtcttaataaatacataagttaaactgaattcttaatatgataaatgtaattggaaaattttatttgtaaatgaaaataatgactagtaaaaaaataatttataaatacgataaagtttgatgccctggaggcgaggtgcctggtttaaatacatgtttaggtagatgaccgtttggtatatccacttatctaaactgaacagttaccttctctccatgcctcatttccaaaaggttttagtcaaagagttttatttgacatccttaaggtttatgtggaggcaaccttgaaataaaagtaattcaattaaagtatttgctatttgctagatacctatgctgtactacatgaagacagacacagtctctttcgtgtaaagggcagtcaagggggaaagatagacaactgaataagcaattaaaatatgttgtgctaatgtggtggtatggttaagactaccctgaagcaaatatctaatgcatatttggggttcttttggaagaaatgatttttaagctgagacctaaattatgagtaggagtcaaccaggtagggacatggtggaagaattttctgtcagtgggcacaacatgtaaaaagacaggcaagagaacatggagtcactgggggaactagtagtaattcattgtaaagcttgaatactgagagactagctaatgtttccttttaaaaacaagcatcacttacaggatttccattttgatggttgtgtattcttgttcttcactaaaactgacaggttttaattcgagagtcaaagctgtttttttgattttggtttagagagtagacagagttataagaaattgatttcagatgacttttttgttatctcataactattaaactgtttattcaaatatctcactcaggtcagaaggaaaatctttagcaagtagaacacaaatgaaattatactttcagtctttcctttgatactaatattttaacctttacaaaactactaagatgtctgttggaatcatctaaatattctaaccaagttgtatccttaataaggattgacgtcaggtagactaatttataaactgatattaagcaataatgtgattaagaatatatagatataatatacatattaggctatagatatgcatatgttaagtctttttacagtagtattttcagtctttgataattgtattaatagaaacttaaaacaagtacatttactatttttgatcccttatgctgcaaaaaatcttgatttctctgtttaggggatctgagggagaggaaggatattagactgtgagtctgatccagttctgttgtttttagctttctgaactttgtgaattaacttagcttctgaacctcagtttagctctttaaaaaactcatgatactcattatctacctccctgtccacctggaatatattattaggttataacctgcaacaacaggaaagttatccttttattctgagatgaaaatcatgcctttataagagcttcatatgtagttttctgtctaagttaaatggaaaagttgaaagaaatacagagaagcaagataacttctgagaataacttctagacattcagaatatctctatgcttaataaacccacaatttaatcaaaataaaattctgggccactcatagagtctctccgcagctacctgaagccttcagcagttttaagtattttttctatctcaacatacctaagatagaaggtatactctttcttatgatagttattctgtgtaattagtgaaactggctttgttgcagcaaagatctggttgtgcaggaggctatttggagagtgagttggtaccacatatagttgaaaagctagctgtctcctctccaagattctagtaggtttctctgccctttacctgactccttttagaatcattaacctaaacaagtatcattgcaggtacataaggacttttgattcaactgctataaaacttttttgttttactacttatgggccacaaaagaaagaaagatctttgcttcaggaatttaaaattccagttagaatatacttaatgtctcagaagaagttaagctgcttttcaccattacatcttctttcatttcccacttaaggagatagaagtctatggtatctcattaaaatctagtgggatcatcaggaaatacaggaatagggaactgaagctttgtccacattgtagccttgacccttgtgagcctacactcttacaattacagatatttattttcgtgtttatcctgtaagtgcttctcagattgagttgtgagtaaacctggggaaagtgaattagagatttgcaacctaccaggataaaacatggtacattttcttggactattaattttatttactggtaggtaagctaaatcattttcaaataataaaacaagatctgtaatggtataaaatgaaaatttgatcaaactccagcccattgattgaggccagacttcatattctcagtagcatgaatttaccttcctctgctgttaggagcattttggtggaaaattttaagaaacaccattctatgagttttttagctgtttatttcaccttgacagagactccatatgggagcaaagcagcaaggtacttctaggttatttaccttctaggttatttacacagtgccaagcgtttgaccagagcacattagatgtaataagagaggccgggcgcggtggctcacgcctgtaatcccagtactttgggaggccgaggtgggcggattaccagaggtcaggagttcaagaccagactggccaacatggtgaaaccccatttctactaaaaatacaaaaaaaaaaaaatcagcctggcgtggtgatgggcacctgtaatcccagctactcaggaggctgagagggaagaatcacttgaacctgagaggcggagcttgcagtgagccgagatcgcgccactgcactccagcctgagcgagagagcaagactctgtttcaaaaaaaataaataaacaaaaaataaatgtaataaacaaaacctgtctccccagatccccatccaaatttcaaaacattacccttctagctatgtgaagcacttttattaaactgtagattttgttttgaaaaaatagtctattaccaagaatgaatcttttaagcaatttattctcccctttttagaaaaggttctggcagaatgagttcagagataaaaggacgtgtgacttaggaaaaagcaatacgtatttagcatccacctcactatggagtgtaaactatttcattggaaaagtttctgaaaaatctcctaaagtctatttaggacctatccaaggttgttagagctagagatagaatccaggtgttcttaatttcctgtggggtgtctgggccacatagccttgataactgtctcagaaattatcagtgtttttataaatactgatatacctattatgatagatgtattccttaaagatttggcataaattattacaaattgagtcgtgtttgaaacattccagcggagctagattacaaagtaaataatcttttttctaataggagctagtagtcggtcccctgagtcaccccccacccctccttccttcttccttccctccttcccttcctttcttccttttgtaagtatttgggtttttctgttttcctcagacatacttatgtgaatctttgagtctcagtcacagttgaccttcaactcaaacaccaaagtatagaaaaagaagattgcaatctttcagtagcattttgataacagagtcttgtttgcttaaaacatgtggatcacgttagagtgattctacaaacaagataattgttgacattttgaagaaagtaaagaatgcatcctgtcccttttggttagttttatatgccagagctctgagtatgatgtgaatctgtaatttctttgtctcccttccccaggattatataaattgtaggctaatttcatggaataggaaataataaagtccgtgatctttagtggagttatacatatttttttccctccaaaaggttgttactcagtaagaaagttctatagtggtttatacatcagttccattggaaagaaagacatatttgtgtgtgtgtgtgtgtgtgtgtgtgtgtgtgtgtgtgtgtgtgtgtgtgcgcgcgcgcgcacgtatgtgtgtgcgcatgtgtgtttttaagtaatagactttattactcatgcatttttgttgccttagcagaaggtcaaaagcagattacagaatcataaaccttcttagatgatactttggtatcaggcttctttcttttgttttgcttccccaaatacaaagatcaaaaatattcttagcagttattgaaaataattagagttgagtcttccacctcttcctaaagaggtcctccttttgattcaatttaagtttagtctcctattataagtagccattaaacttaatgcaggttatattctctggaagcaagaaattgcaactagtgatactataagtcatactgattttcccaaaagatatattacaattagagttatcatttttgttcagattttgatatccaactttacttttgaaaaagtacaactgccagcaaatactgtattaggtataaataatgggcacatttatatttataatgtttttaattataaagtttctttaaaaaaaatggatcagtaccataaacagggaagtacactagtcattcagtaaaaatttgaatgtttctagatgccatgggaaatataaagatgactcttcaggaacttgtcattgagtatcatgagacccatacatctgtaaatgtaaaaaaggtagtgtcataagagaggtataaggtcctgtgggccaccagagaatagaaaaactgtttctggctaaagcaatcagagacttcactagatccatgagctgggctcttagagaatgaagaacatcatttaccaggacagatcagtgtcattgatttggagtcagaagttattagctgtgttactttgggtagtgtcccttaacctccctgttctgtgtaccttacagagttgttatgagcattcagagtgataatatatttgacagtggtttatatattctaaatcaccatatgttattattaccactttagttttatgggaacaaagcaaaataacaataatagcatgattgggttatagagtttcagcagggcttcttttaactttaacagccaacattaatgaaactcagagctacttgatggctttttgtgtagccatcctcccaaagagagccagctttggctcccgagctcccctagcccacatgaggatcattctccacttctgttgggttttatttaggttgccctgtaaaaatctcagtgtctaggctgactaaacatcaaaaatatgctcctaatcaaggagctgaccagtttctcttagtttctgggacagggttgccttcttagctagagccatcgctgaccccagtcagagagctctcctgacaaaacagtcttcagatagtctttttaaggtctccaagttgataggatgatggctgggagtaaaggggggtactaggaataaaccattttgtcttggagctctaatatgtatataatactaagagaagcaaaaataggcccctgtgaagcctctactctgtgggagctaatgcttaggaatctgaacataccccaggtaggaatttccacgtaaattttacctaaaagtagaaagggttttttcatttaaaagtctttttttctaaacactgcaatggaattgtacaaatcctaaggatctgaatattagaaataaatacataacagtgagggcctttgactgagaaaacatccctttggtatctctctattgactggaaggagctacataatgccagaccagcagagattatgtaagcaaccaaaaacgtagtattgaagcactgcagcatgatcctttcctctctaggttttgggtcttgtatattatatttgaagctattatttagtgcatctaggttctggctaggaatgaactggaacatttcagtgggattttaaggcatggtgaaaaaagtagttgatgaaagagtaaatcaccgtgtttttctttctttgctgccactgcccatcttgctgtgttcactgaaatcaagtgtaggagttggggagtaggttaaatacctgcctctgctgctacatctggcaaatcttgatccatataatttagaattaataataggacattggcaaaaataggcattatactgtatgttcctcttttctagattagatccagtaccaaccatggggccacccaaattgagacattagaatctatacagcaatctttctgcattctttggaaatataatacctagattgaattcagaatatgttatctacattttaaaagttatatggtgtctctatttcagagggaagattaatattttatggcctgtcataaatgaccatcttagaggcacccatttgttttatgtatgcattaataatggaaattgagttcattcaactattgtaatttttgtacatctgtatcatgatttatatattgcctcattgatgagcatgtaaattatttcaagtttttgccattataaacagtgacatagtatctttatgcatatctctttgtgcatatatattaattttcctagggcagtgcttacaaactgtatcacattatactatatgtaaaaattatttttactgcccatattatcacctgggggatggtggcaaagctacagaggtctctgacagtgtgtcacatataaaatcttatgctctaaaaaagggcttgacaaactatggtcctcagaccaaatttagccccctacctatttttgtaaatatggtttcattagaatatattcatgcccatttgttagtgtgttgtctatggctgcttttacactacagtgacagagttaaatggttccaacagaggaaccattgtatatggcccactgtattagtcagggttcttcagacaaactgaaccaataggatatacagtgagatagagcctgaaagatgtattataaggtcagtaccttataattagctcacacagttatcaagtctgagaagttccacgatctgccatctgcaagctggagacccaggaaagccagtagtgtattatagttgaaaggccagacagagagctagagggctgatggtgtaatgattccagttcaagcctgaaggcctgagaaccaggagtgccagtggcagaagacagatgacctaaagatattctcttatgttttcttccagaaactttatagttttagcttttgcatttatgtctatgatctctctagtgttaattttcatgtgtcacataagataagggttaagaccattgttttccgtatttttattcatttgttctagccttatctgttgaaaacttttcccatttgaattgccttggtcccttttgtctaaaatcaatcagtaatatatggatctatttctggtttctccatcctgttcagctgctctatttgtgtctgtccttacactttaaatttttatcagccatcagatatttcacagcatgttgattagaaagctgtacatatgcctagaagtggtattgttaggtcatatgaaagtatacgtttctttaacttgcctacatatgcctaatccctctatggaaaaattatttcagtatctcctctgctctcagaatccttctctttttaatctgtcttccacagtgccatcagaatgatattttcgaaaccaaatatgactttctctcctaaggccttccatggctgcttagtgtatagaaactccttgcttagaatataggatataagctccttcacataaacagcctgcttttcaaaatgtgccctgcactccataattcactagtccacctacaaatgtattccttgaaagttttgtgtacttttactgatatactgggaacatgtaattcttcctctctagagaatatctttcctccacttcatcccatgaaatcctatttatcttttagtatcattccctttgtgatatttccctccaattgtccccatgttttcactgtatttaaacagttcatgtttctttgagtatactgtgagttctttaagaagcttgtcctatttatttttgtttcctcattgcctaatactactggccaatacttgttactcagtttttttaaattaaattgtctatgataagcagaatggtccttgaaaaattttaatctccttctgaatctatcaaataaagaaaataccaccttacctatgttattcaaaggtttctggtgaagagcaaatgaagtaataggcatggaaatgtttgaagaatgttttaaaaatgtgatggccttattgttgtttataacaaaatttcactagaattaatcctcttggtttcttacaagctttattatggtggaactttgccttcatatatttgcattggttaaaattatcctaatattaaaagactttaaatatttttatttctaatgtttccagtaaaactgaaaataacttagttaaaaaatatttttgcatttaaaactatagaaaataaggcattttctttataaaatctcagttgtatgtgtgtatgtgagtgtctttttggatatctttgattcagtgaatatactgagtactgctcagttcaggcactatgatcgtgatcacattacagtaatagctaatatttagtgaaccatactacgttactgtgctaagaacatcacatataatctaatttaatattcacaataacccttattatccacattttatataggtaagtaacttgccagaggtagtacagccgctgatacagaaacccagtctgacttcaaaacctgacctttaaatattgtgctcagggatcagcaaactataacacccacagcctggttttgtaaggcctgccatattttcaacaggttgttttaaaaaaaagatgtgacagagacatatgtggcctgcaaagcataaaatatttactatctggccctttacagaaagtgtttgccagcctaaagatggttaaagagagtccctgtaactctggaagctcccaatccaaataggaaataaacacaaacattttaaaagtctgcctcaagaggcaaaatgtggttagtgatgttattataaagatttaaacaagaatcccaagggggccaggtgtggtggctcacgcttataatcccaacactttgggaggttgatgcaggaggatcgcttcagactgggagtttgagaccagctcatcaacatagtgagacctggtctcttaaaaataaatttttttttaaattagctgggcatggtggcacatgcctgtagtcccagctacttgggaagctgaggtaggattgcatgagcccaggagtccaaagctacagtgaactaggatcatgccattgcactccagcctgggcaacagagcaagaccatgtctcagaaaaaaaaaaaggaaccccaagggattggaggttgtagtcattccagccagaaaacttagaagaaatggcatttgaactggttttgaaaaagttgtaaagtgaccagacatcttaggtatagaaatctgcacacccggagtacttggcaggtgatgataaaaatacttgcccatgacatgccaagataccagaactcctgggcattatttttccttctacctcttatttgctgaattatgtagaagagtgcatcaaaacatctgcttcttagtttagcctttagtcagttgtgaataaaaaattggttctgatagttatcttgtatttttcaagtgaatcaaaaacaaatctgatagagggtgcttcagtgcaagttattttttaagctgtaaaaatgtgaaaatggtagtgctttagttaaataaaccttgcattttgtattcagtcttagctgtcattggattggcaaaactgaaaaccaatgtttacattcacagtaattgcaatttttttttttttttttgatacggagttttactcttgtcacctaggctggagtgcagtggcaccatctcggctcactgcaacctccacctcccaggttcaagcgattctcctgcctcagcctcttgagtagctggaattacaggcgcccaccatcatgcctggctaattttttgtatttttaatatagatggggtttcactatgttggccaggctggtctcgaactcctgacctcgtgatccgcccgcctgggcctcctaaagtgctgggattacaggcgtgagccaccactcctggccaggtttcttatttttaggaattcagcatgtaattttataatgcatttgcattaatttgggagaaaaaatgaaaccatgcttttgaagaatattggcaaaagttgtcaagttaagatagaattgcttgttaggaaactttttaattgaattgaggaaatgacacaagattggcattgttattactcaacccttgattgtaaacagtgccaaaaatataataacactaccatgaaagatttatattttgtaaataaagcacacagaaaaatattaaactacattgggagatgcattttctgccaacataattaagaatattacagttaaataatcaaatatttggatattgaggaattttattctcaaagagaaaaaaggatactttatgtggattgaaaaatattccagacaccaaaaataaaagcagaggaggcataaagattccctgattttacagtttgtgtagaatagcatccattgtatgaataatgaatattatgtctatattcatgacatttttttaaaatctgataatagcttcaagctgtttctttttctgaatatcattaatattaatatataatcattaaactaattaatgtgtatgtgggcaaatcactgttccctattctattgtggatatataattgaaattaaatgtttctcatttgaataagtgaaatctcttctttgaacatttttcttagcctgaaaagaatatatattaatgataagtagcaactttggtttctttgttatacgttggtgcagatattttggttggcattgattttatattaaaaatatatatatattttatcgcattttcagtttgataaaaagacttctactataataactataatatacccttaaatatttatcagtacatattcctctgtattttagtagtggaattatctatgtaattgagtgaaaacaggagtaaccacagatgcataaaaaaacacatctgtaaattattgcatttgccatcttttattaaagactgccttgcaattctgtttcacggaaatgaattaccagtaggtctttagaatatgctaagatgacgaaaagggaagaaggaattcttctcaaaagatttgaatgtagtctttgagttgtagctaaagaatagtctgaaccctctatctactcatgtcattctttaaaaatagtggaaagaaatggttccaaaagctatattttgaagctattatctgttgtcaagggcaaactagcattttaaagctattgctttgatatggtttagctttgtgtccccacccaaacctcatcttgaattataaccccgaggtgttaagggaagaacctgatggaaggtgattgaatcatgggggcagtttcccccatgctgttcttggtgagttctcacacacttcgtaagcatctggcatttcccctgctctcacttctctcacctgccaccatgtaagacttgcctgttttgccttccaccatgattgtaagtttcctgaggcctccccagccatgtgaaactgtgagtcaattaaacctcttttctttataaattacctagtctcgggtatgtcttcatagcagcgtgaaaatggactaatacatgcattttggtaaaacagtatgttattatccagtttcatgtttaattagtttaatttaaattaatcaaatgccattttgtattaggggccacaggtaagagaaactcacagaaaaggattgttgaatttgtggatttttaaaggccattgctgtctcctttcctgcctcctctctatatttaggctagtgactaccagaaagaaataggaagataaaagctcacacttaaaacaaacaaacaaacgaacaaacttattttacagtcttttatcaatggagtatgagacagcatatttttgcaaagtaccgctccatttcctaattcaaaaaggagatttggacacagttttccctggcagcactgaaataagaatttgctttctctcagtggccgtataaaacagtgagaataatgcagtcaactctctaaattaatttaaagaaatataattgtagatagtttgaaatggtaaatattcaaaaaattaattttccttcactttggacagttgtatgccatgctattgtaggttaaccctattaccagaaagggggtcccaatccagaccccaagagagggttcttggatctcacacgagaatttggggcaagtccatagagtaaagtgaaagcaagtttattagtaaagtaaaggaataaagaatggctactccatacgcagagcagccctgagggctgctggttgcccatttttatgattatttcttgttacatgctaaacagaaggtaaattattcatgaattttctgggaaaggggtgggcaattcacggaactgagggttccttcccattttagaccatatagggtaacttcatgatgttgccatggcatttgtaaactgtcagtgatgctggtggtagtgcctcttagcatgctaatgtattataattagcatataatgagcagtgaggatgaccagaggtcactttcctcaccatcttggttttgatgggttttggctggcttctttatgcaagttgttttatcagcaagacctgtatcttgtgctgaccttctgtcttatactgtgatttagaatacctgacctcctgggaatgcagcccagtaggtcttagcctcattttacccagcccctattcaagttggagttgctctggttcagatgcctctgacaactccagagtagagaagtggtgaacagaggccacagaaatgatgagcagtctacctaccatgtggagaagacacctcagaaatggagagattttatatttttgttgcatgatggtaaacagctgtaaccaccagcttggcctttttggcagctggctttatttagcattttaagctttaagtttgcctctggtgcctggaattgttcaattaaaattttaaatttattcttatcatcctctaacacaaagcttacttatacaataccaaatctagcctgagacacttgttcttgaatcgattcttttttaaataataagttcagtatgaaataaatctctgctgaaatgaaagaaagcacccattatcatggaactgtggttcctgaaagctacttaggtaggttaatagttgaggcctattaatggatatgccatattattacattaaagccattctcaatgaaggattaaagttgttagttttaagagttgtttttgttttgttaagaacagtttgtacaatgattgatttttgtcaaagaattgaaaatgccatctaatacaggtagggagaggaggttgattgtcagtttgatttaagtcttaaaagttcatcaattagcaaagaacaagaaactgtttttttaagagggcaaattttatgtatctgtttaccatgaaagagaacttaagagaagctgtatttccacttttatcaaattagaacctttatgtcaatattaaccagaaaatccttagttacaaacttgaaaacatctatacttaaggacagttgttctgttcattcaaacagaacaagtttcttcccaggttgagaagtcttaggtaacctgtgactcatgctttaattttaaactacttcttcatatggcctttcagttgaactaaaaaggccttagatttagtagaatggactctttgtgtttctaatttgtgataagtttggcctttgttagttggttagaggtttccttgaatcattccaggactagccctctctttagtcaaagagaaaaccttttcccatccttaataattttaccagttactaggtaaatcattccaggactagccctctctttagtcaaagagaaaaccttttcccatccttaataattttaccagttactaggatatcatccttttttacttttaatctttaaagagtttttctcagttattctttccagaaaatcacatggtgaggtatcattatttttaattaacatagaactgaagaaaaaaagagagattgtgttaattggacagtagtgttagggatcagaattttctggatttaattacatttgtatcatattgtcattttggtgatgccaaatctgtttatttagcataatttcctttaaataaaacttttaagtttaaagcaatgaacacctattgctgaaaaacccagaaagtacagaaaatccaaaaataaaaataccacttaaatatatatgtgcatatctatatgtattctttttggtcggttttgaatgaatatatttttaaatattagagtttatttcttagagcagttttaagcttatagaaaaattgaacagaaaataagagttcccctatataccccccactccccctaccccctgcaccaagtgccagccatgacttattctccccaacctttttaagagagtcccactctgttgaccaaactggagtgcagtggtgcgatcatagctcactgcagccttgaactcttgggctcaagcagtcctcccacctcaaccacctgagtagctgggactataggtgtgctaccatgccttgctaagttttaaattttttgtagagacaggtcttgctatgttgcccgggctggtcatgaactcctggcttgaagcagttcttttgcctgggtttcccagtgcactgggattacaggcatgagccaccatgcctaaccctctattattaatatttgtattggcatggtatatttgtcataatcagtgaagtgatattgatatattattaactgaaatccatagttcacattagggttcactttgtgctgtacaattctcttgcttttgccaaatgcataatgtcatttattcactgtagcataatcatacagaagtttcactgtcctaaaaatctcatgctccacttatttatccctccccacctgccttgccccttaacccctggcaaactaatcttttaaatctccacaattttgctttttccagatgtcatatagttggaatcatacattatgtgttttttttctgactggcttttgttttttttaaggttcctacatgtcttttttgtaactttacagctcatttctttttattgctgaattgtactgtattatatggatgcatcacagtttatttatccatttaacaacagttagttggtgctggaactggacatccacatgccaaaaaaaaaaaaaaaaaaaaaaaaaggcaggggagttgggattagacactgaccttatacctttcacaaaaatgaactcaatatggatcatagatgacatcttgattgcttccaattttttggcaattttgaataaatctaatgtaaatatttgtgtgcaggtgtgtgagtgggcatacattttcaactcacttgggtaagctgtagcagtgagattgctggatcatatggcaaaactatgtttagctttgtaagaaactgccaaattatcttccaaaacggctgtctatctaggctgttataacaaaatataaactgggtagtttaaacaacatacagttttggtgagggccttcttcctggtgtttaccttcgcatcgtggagagagaaaattctgtgtctcttcctcttcttctgagaccaccaattccatcatgggaactctaccttcattatctcatgtaacttaattacctcccaaaggccccatctcctcataccatcacactggaagttaggacttcaacatatgaatttgaggggagaggagggactcaaacattcagtccataacagtgattataccatttggcatttgcagcagcaatgaatgagagttcctatttcttcacatcttccccagcatttggtgttgtcactatttcagattttagccattctaatagatatgtggtagtattctgttttaatttgcaattcactagtgccatacagtgttgagaatcatttcatatgcttgtttgtcatctgtacatcttctttggtgagatgtctgctcaggtcttttgcccattttataattgggttgttagctttcttactattaagttttaagggttctttttatattttggaaagagttcttatatattttggttataagagttctatttatatataaagttgagttgagttggatataagttctttcatctgtgggttttcatttcattctcttaactatgtctcatagagcagaggttttttgtttgtttgtttgtttttttgttttttgttacagagtctcgctctgtcgcccaggctggagtgcagtggtgcaatctcagctcactgcaacctctgcctcccgggttcaagcaattcttctgcctcagcctcccaagtagctgggactacagccacatgccaccgtgcctggctaattgttgtatttttagtagaaatggggtttcaccatattggccagactggtcttgaactcctgacctcgtgatccgcccacctcggcctcccgaagtgctaggattacaggcatgagccacagcacccagccgagcagaggttttcaacttcactgaagtttaacttctcaattgttttattttatggattgtgcttttggtgttatatctgaaaactcattgccaaatccacagtcacctaaataatctcctgtgttatcctctagaagtgttacagttttgcattttacatttaggtctgtgatccatgttgagttcatttttatgaaaggtataaggtcaatgtctagattctataccctgtttttgtttgtttgtttgttgtttttgcaagtagatgtctaatttttccagcaccatttgttgaaatactatcttttctccattggattgcctttgctccattttcagagatcagttgaccatctctgtgtgggtctttttctgggatcttctgttccattcatctatttgtctgttttccaatatcacactgtcttgattactttatatataaagtaatcttcaaaaaagtctttgaagtcaggtagatcagtcctcttactttgttattcttcaatgttatattaactcttttgggtgttctgcctttctgtataaactttagaattagcttattgatagccataaagtaacttgtcaggatttcaattgtgattgtgatgaatttatatataaagttgagaaaaattgacattgacaatattgagtcttctatccatgaacctggaatagctctttatttatttagattttctttggtttctttcttcagttttataatttttgtcatatagagctcataatgtattttattagactttaacttctgtcatccctttatctctctctctctctctctcattctcgtgctaatgtaaatggtggtgtgtgttttaaatttcattgcccattggtggtatataggaaaacatttgactttttttttttttttgaaacaagagtctcgctctgtcacccaggctggagtgtagtggcgtgatcttggctcactgcaacctctgcctcccgggtgcaagctgataatcctgcctcagccttccgagtagctgggattacaggcgtgtgccaccacaccgggctgattttcgtacttttagtagagatggggtttcaccatgttggccaggctggtctcaaactcctgacctcaggtgatctacctgcctcggcctcccaaagtgctgggattacaggcgtgagccaccacgcccagccacatttgacttttgtatatcaaccttgtatcctacaaccttgatatagttacttattagttccagcaggggttttttgctggtttttttggggggtggaggggcaggggcaagttgccaactcttgggatttcctacataaatgaccatgtcatctgtgaacaaagatagttttatgtcttccttcccaatctgtataccttttctttctttcttttgtcttattccattgacttctgctactgactgattccttttatttttagtgttacgtaggaatggtgagaggggccatccttgtgttgttcccaacttaggaagaaggtatcaagtttctcaccattatgcagtttgctagctgtaggctgtttgtagatgttctttcttgctgagagtttttaatcatgaataggtgttggatttggtggactacttttcttgcatctattgatattattaaattatttatctcctttagcctgttgatttgatggactatcttgattgatttttcgatgatgaactagcactggatgtctgaaataaattccaattggtcatagtgtataattctttatttatttatttatttatttattgatcattcttgggtgtttctcgcagagggggatttggcagggtcataggacaatagtggagggaaggtcaacagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtagacacagctcatgtttcagagagcactgggttgggggtaaggtcatagatcaacaggatcccaaggcagaagaatttttcttagtacagaacaaaatgaaaagtctcccatgtctacttctttctacacagacacggcaaccatccgatttctcaatcttttccccacctttcccccctttctattccacaaaaccgccattgtcatcatggcccgttctcaatgagctgttgggtacacctcccagaccgggtggtggccgggcagaggggctcctcacttcccagtaggggtggccgggcagaggttcccctcacctcccggacggggcggctggccaggcggggggctgagccccccacctccctcccagatggggcggctggccgggcagaggggctcctcacttcccagtaggggcggccaggcagaggcgcccctcacctcccagacggggcggctggccgggcgggggggaccccccacctccctcccggacggggcggctggccgggcggggggctgacccccccacctccctcccggacggggcggctggccgggcggggggaagacccccccacctccctcccagacggggcggctggccgggcggggggcaaaccccccccccacctccctcccggacggggcggctggccgggaggggggctgaccccccgcacctccctcccggacggggcggctggctgggcggggggctgacccccacccccctcccagacggggtggctgccgggcggagacgctcctcacttcccagatggggtggctgccaggcggaggggctcctcacttctcagacggggcggctgccgggcggaggggctcctcacttctcagacggggtggttgccgggcagagggtctcctcacttctcagagggggcggccgggcagagacgctcctcacctcccagacggggtcacggccgggcagaggcgctcctcacatcccagacggggtggcggggcagaggcgctccccacatctcagacgatgggcggccgggcagagacgctcctcacttcctagatgggatggtggccgggaagaggcgctcctcgcttcctagatgggatggcggccgggcagagatgctcctcactttccagactgggcagccaggcagaggggctcctcacatcccagacaatgggcagccaggcagagacgctcctcacttcccagacggggtggcggccaggcagaggctgcaatctcggcactttgggaggccaaggcaggcggctgggaggtggaggttgtagcgagccgagatcacgccactgcactccagcctgggcaccattgagcactgagtgaacgagactccgtctgcaatccaggcacctcgggaggccgaggctggcggatcactcgcggttaggagctggagaccagcccagccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagacggcgagatggcagcagtacagtccagcttcagctcggcatcacagggagaccgtggaaagagagggagagggagaccgtggggagagggagagagggagggggagagggagaataattctttttatacattgttaggtttgatttgctaatattttgttgaggattttgcatctacattaatgagagctattagtctgttttctttctcatgatgtctttatgtggttttggtattagtgtaatattagcctcatagaatgatttaggaaggattccttctgtttctattttctggaagaaattatacagaattggcatcatttgttccttaaatgtttagtagaattcaccagtgaaactatctgagtgtggtgctttctcttttggaaaattattgtttattctatttctttgatcaatatagagacctattcagattaccaaattctccttgtgtgaattttggtagattggatctttcaaagaattggttcaattcatgttagctatcaaatttgtgggtacagtgttatccataatattcctttattatcgttttaacgtccacgtgattagttgttgtggcctgtcttttatttctaatattagtaatttgggtcttctccccttctttctcagttagcctcactagaggtttattcattttactgatattttcaaagaactagcttttcagtttgttaattttctctgttgtttttctattttcagtttcattgatttcttctgcttactttggatttaatttgtgcttttttctagtttgctaatatggaagcttagataattgggtttagctttttcttccttttcattatgtgtattcagtgctgcgaatatacatttaagtaccacttttgcagcgttccacaaattttaatgttttattttcatttagtttaaaatattttttatttcttgacatttctttgattcttgtgttataaataacacaaagtgcttcagctatctttttgttaatgatttctagttccattgtggtttgagagcatactttgtatgatatctgttcttttaaatttatatttgacccagccatcccattactgggtatatacccaaaggactataaatcatgctgctataaagacacatacacttgtatgtttattgtggcactattcacaatagcaaagacttggaatcaacccagatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcacttataggtgggaattgaacaatgagaacacatggacacaggaaggggaacatcacactctggggactgttgtggggtggggggaggggggagggatagctttaggagatatacctaatgctaagtgacaagttaatgggtgcagcacaccagcatgtcacatgtatacatatgtaactaacctgcacattgtgcacatgtaccctaaaacttagagtataataaataaataaataatttgttaaggtgtgttttgtaggtcagaatattgtttagcttggtgaaatgttccctgtgaactcgagaagaatgtgcattctactgtggctagatgaagtattctataaatcaattagattgatggtgctgctcagttcaactgtgtctttaccaatattctccctgctggttatgtcaattactgatagacaggtattgaagtctccaagtataatagtgaatttgtatattctcattgcaattctgtaagtttttaccttatgtattttgacagtcagttgttaggtgcattatacatattaggtataattgtgtcttcttggataattaaacctctgtcattatataatgctgtctattgctgataatttttttgttttttgttcatttttttaaaaacttttttattcaatattagagctcaggtaagatattgctgataatttttcttgctctgaaatctactttatttgaaattggtagagctactctagctttcttttgatttgtgttagcatggtgtatttttctccaaccttttacttttaacctatgtgtatatcttcacatttaaagtggatttttgtacctaacatatagttggtcttcttttttttttaaatccacttggacagtctctgcctcttaactggtgtattttgggctatttacatttaaagcagttattgatatagttgggttgtttctataattgtggctgttttctatttgttgccctatttttgtgtccttttttatcttcctctagttttctgccttctctggttttaatgggtcattttataatgattccattttttattatgtcttagcatatcagttataacttcttctagtgtttgccccagagcttgcaatatatatttaccacaaatccaaatccactttcaaataactttatatatcccttcatgggatatataatgccaagaccttataacagagtattcctaatttctctctcccatcccgtaaagcattactatcattcgtgttagttatccataagctatgatcaccaaatacattgttgctagtattattttgaatacactgtaggtaaattaagaacttaaaaaagatttcatttatacctctctaacactcttctttatacatatttgagtttatgatctatataattttccttctctctgaagctagcaacaaatttcctgttttgtttatctgagaaattcttaattatccttcaaaagtgaaggagaaatactgcagaatgcagaattctaaatgggtggttttattctttcaaaggaattcaaacatctttattctattccactctcttcttgcttgcatgattcctgaagagaaggcacatgtaaatattgttcctctctagataaggttcctccagcccagcgtttttcaaaatttttttctgactttttgcagtttgaatatgttattcttaggtgtagttttatttctttggggttttttgttgttgtttgtttgttttttgtatggatacttgatgttctctaggttttatagatttgtggttttgtgtctctcattaattttggaaaattctcaggcattattatttcagtaattttttctttttctttcttctcctctggtactcccattacatgtatgtccaccttttgtaaattgtcccacagttcttggatattctgttccattcttttaattcagttttgtaagtttatgttcacatatctttaagctgattctttccttggtcatatccaacctactactgaggccattaaaggcattcttcatttctgttatggtgtttttttatttttagcatttaaaaaaaattttttttccttggagtttccatctctctgcctgcattactcatctattcttgcatgttgtccatttgtttattattaggtttttagcctattattcatagttaaattcccagtctgttacttgcaaactctctgtaatatcggagtctggttctgagggtttgtatcttcagactatattttttgccttttagcatgccttgtaatgtttttattgaaagccaaatgtgaggtattggataaaaaggaactgaagtagataggctgttagtatgaggttttgtgtttatctggctaggagttggggtgtgcttactgtagccatagctatggtatcagatgctaaaatttcttctagtgtccttgtttttgtctcccttgtctttaggccttttagagactcctgaaataggcagttcttttagctgcaatttctccttattgttcatcagtcttattgatgtgatggtatggtttgtggggaggaggaagtgttccgtagtaatatcattaggtctcagtcttttagtaaacctgaattgggtatttctcttccccctggtgggttaggctttgataaaactccagtagattaagctctggtaaactagttttcctttaggccatgcgttgttaaggatctgttgagtatgaattgagctaaaacgtgaaaattctctggaactgaagaaaagtacaattatgttttattataatgatagtaatcatcacaaacagctataaaaaggaatatgaggccaggtgcggtggctcacgcctgttgcctgtaatcccagcactttgggaggccaaggcaggtggatcacctgcggtcaggagtgaggtgggtggatcacctgaggtcaggaattcgagagcatcctggctaacatggtgaaaccccatttctactaaaaatacaaacaattagctgggcgtggtggcacattcctgtaatcccagctactccagaggctgaggcaggagaatcacttgaacccaggaggtggaggttgcagtgagctgagatcacgccattctgagatcacgtcattccactccagcttggacaacaagagcgaaactccatctcaaaaaaaaaaaaggaatatgaaaataagttggttttaaatgtaatgtttaatttttgtaacttctgttattataatgtgtagaaatattccaagtgagattcttataaatgaatttcaatatttatttcaatatgaaatctacaaaattctgaatggagggacagacattctagcaataatacatgcctagcataatttcatctggctctgtacttcatataaaaattaaccataacttcttacattactgaataactaaaatatagattctataatgtttatcgaaatgctcaaagatcattctttgggtccaggaaattagaggcaactgcctggaaaagtgtacagtaaaataataaaattaacaaaaacaagaataatatctcttttcctgtcatgtactatttcggtagtatatatttatgaaatagttgatgggtctgaggcagaagacctatgtatttctgaagtattgtgcaagcagtgagaagaatagaagtgtccatgtagcttagcaagtatttatattccctttttgtaggtatttgaggtcttaaactattatctaagaaactgttaaagttcttaaataaaggtagaacctgagtaatattaacgttttgcatcgtaaagtaataaaactgtggcatttgcaaatctcaaaaattaccaagaatgatgcagttgtgatgctggatggtaggctcatctattgtctaggtaagcgatcatttcctatagcaaactgtgggatccctgttaggtacggcacgttatattattaagtttatttattcaattacgcatttattttgtgctttttatttgcctgcaatagtggtagttactaaggcaacaaaatgaataggtttatgtttatgtccttgttccagacttatgggggagacagatacacataaaaacatgcagtttgctaaatgcaatgattgagatacctctgagagttaaatttctgaaaattttaattcctgaaagccaaagattttctgtaccacttctgtgtggagtacatatcaaatgtcgggaccagggatactaattattaactctccacagcccatctaatagaatctatttgaggaatacacctctcgctgtcttgtgtatgtcatgtaaacactccctcccttctacacacacacacacacacacacacacacacacacacacacacacacacacacacgcccatgcagaaacacatgcccattcacacctgttcctaaccctgggaaactaatcctttaggctgggctctgccaatcaaattccctgtttagaggtaatgtaacctggtagttgtgctctccaactctggagtctgactggtctggattctgactccttcactggtcatctgtaagtgtacttgccccataggattgttctggcaattaaaagaaataatatttctaagcatgtagcacactgctcagcacatggtcttagtgttagaatcattacaagatagggactctagtttacatggaggtgagactaagctgtaaaatcttgtagactgatgctgatacctacaaggtgggctgtgagcaagagataagtcacttagcagaaaggagagtatagcagacccacccagaccccacagccacatagaaatgggtaagaattgcagatttctcattgcgggaagatcagttatactttctgctcttcatctcttggcaattccattgtattctttcagtaatctttcttttcatttgagctaatttgtctaggtttttattccttacaaccagtgaaccttgactaacaccattctcaaagaatatttactggttttttttatataggttagaggaaataatcatacgcaagttacgttccatgtagtactaacttctgaactccagtattctttatgaattatatattctagtctaacccagcaggtagcatcatcaggcataagtaatattctgtttttcctcttcttatacttttctggtttttgtggtatatctacctcttatctccaatactgcaaggaaaagaaataatttgttggtacactaagaaaatgcatcctttagagccaaaatgtaacataatctgattatgttgtatatgttgtttcctgtgcactgaagcctaagaagagcattttgggttatatcactgattcattccattcactactctgattaacagtgattctcagtgactttgtaggacatatggttgccatccatgacatcaaggcctgaatattcatattttcccccaaacatttcatctctgactttcatattctgttgtgacaattagttctgtaagaattttacatattgtataaaagttttattttacatgctcttaaactactttcttttctttctttctgtttttttttttttttttttttttttttgagacggagtcttgctttgttgcccaggctggagtgcagtggctcaatcttggctcactgcaagctccgcctcctgcgtacacaccattctcctgcctcagcctcccgagtagctgggactacaggcacccgccaccacacctggctagttttttgtattttttttgtttttagtagagacggggtttcaccgtgttatccaggatggtctcgatctcctgacctcgtgatccgcccgccttggcctcccaaagtgctgggattacaggcttgagccaccacacccagcctcttaaactactttcaatgaaagggtcctagttctaagatttaatgaacacattcttgaacccccatccaaatatttggatttttgtaagctttgaacatactgcctctcagcgttcatctttttagatagaagagaatcatcctattgtcatttggggggatcaccactcttttaaataaaatgatttgtcttctttattagaccattctttgatctgcagtggttgaaccacacatatttatacataacacatcatgtatgtgtgtccaacttagtgatctgttgaattaactttaaaatcattttgcgtcccctctaaaagttctttctctaatctttttaatcttttataaatttcactgacaagaataatgttaattttaatgataatcagggctgaaatttatttctgaaaacataaaatatttgtattcatgttgtgattcattttggataccatcaggtgttatatcccaaattttggatcatatcatcaagagtagatactttaatttataaggtcttcatgagtaaactgaaattttttatccctaattatgtcacttaagaaattaaaggaggaaatatatttaaggacggaagcaaaatgtgtgtgctttaatgtttaatggttggaagtaagtgtttaaatagataataggaagaggagtttacaagtttaataaacctctttgtgataaatttgctcctgggttttctgtcccaaagtaggctatttttccttcatggaaagcttattacgtaattttacataattattagaaaatacgactgtcacaggacagctgattctcattctctaagggtattattaactcttaaccatgagctttaagataactaaaatgcaccctaaatgtgtcatacaaataaattaaatttgagataagctgtctttagctattatttttctttctttggggatcccagtatgaacccaaaatgacaatttatgaagttgttaagccacaattcacatccactaattgctttatatggctatacatgatgatgcatgtttgaagtttatatcatttatgtaaattcctagatctagtacacattatagagaaaaatctgtatcttacccataggaacttctctagagcccctccttttatcatgctatttaaactcacacctggagtagccacctcgcctctccctttgttattccatgaagagtcattttgagtctcactgaaactatgataatggagtgggaatggaataggactaaagattctggaatcagaatgtctgggttcaactcctgtctctgactcctagctgagtgaccttaaataaggtgcttaacctcagctataaaatgggaacaagaggccgggcgtggtggctcacgcctgtaatcccagcactttgggaggccaaggtgggcggatcacctgaggttgggagttcaagaccagcctgaccaacatggagaaaccctgtctgtactagaaatgcaagattggctgggcatggtggcacacgcctgtaatcccagctactcaggaggctgaggcaggagaatcgcttgaacccgggaggcggaggttgctgtgagctgagatcatggcgttgcactccaacctgggcagcaagaacaaaactccatctcaaaaaaaaaaaaaaagggaacaagaaagtacctcatcacaactttgcggattaattgagataatgcgttggaaacatttagtatagtaccgcgcatacagttggttctcaataactgttagctcttaattccagttgctaatagagagctgggacaaggaggtataaatgcagcggctatgttagaagcatcttatagcatggctcattgagaaaaggtgaagtagtatatggaaaaaaaggagtctggcccttcatccctgccagaatctttatgacctcagatgaatataggagtatcgtaaaatgatttggagctaccaggtaagatgttgtggcctactgataaataactgtctacaggttgaggcgtgtgttacatagggtagaaatttttgtggtttttttttttttaaacagagttttggtgtgtcgccaggctggagtgcagtggcaccatctcggctcactgcaacctccacctcccaggttcaagtgattctcctgcctcagctactcagcctcccaagtagctgggactacaggtgcatgccaccacgcccagctaatttttgtatttttagtagaaacagggtttcaccctgttggccaggatggtcttgatctcttgacctcatgatccatctgccttggcctcccaaagtgctgggattacagacgttagccactgcgcccggcctagggtagaaaattttaagtaaccttctaggcgaggaagtggcagaagtcttcctttgtaaattctagtccaagttctaaagaaagttgtcatgatactgtctttgttttaagctcaaatgagaaattgtatgagaaacataatgtcaagtatcaaatctgtacaaagcattgtcttttaaagcaatggcaagccaaagcctacttcccaccatatcagacatctcctccttgccctgtttgctacatgtatcttcttccctcctcccacttgcatgctctgttagttaaggtttcatgccttttgcttcatagttctttttcttcatttatggatatcccctcttcttcccaattaaacccaaaaggataaaatatagccatttttttgagtaatacctttacactatttgtttcagctatgccaccagaagctatagattgtaaagtattaattagctctctttctagagattttacacagcgcaaaaggaagggagagtggagtgacctatgtcagatcatcagtagcagtgacagtagcagctgtggtttggcacataagaccatactccacaccccatcatctttcttccacaatggaagcagaggcagctggggaagaagatacattgtgcagtctgagatggcagcaagagttaaagatgggagtgtgatggtagggtgaccgttgaagctactggtactttttagattggtggaatttatgatactagggagatttgctgctccagttcctgttttagtaggctaagatgtacgtctgttttatcagcaatttgtacagcactttagctatgcaatactaaattaagctatacagtgttacactaactgccctctttcctcatattccatagaaatcttaagtgttttgtttttgcttcctttaacatgactctgcgttttcattttcttctcttacgatgtggccagaatttctacttaataattcttatatcttagggtattgacctttacgtataatgaagaaacccaataggtctccctgatttaacataattggatgataatttagcagaaaaattacaaatagccttaaagccattgtgaaacatctcattcgtaactcctcaagtatgctaattacagaggcagctgtaaaattcacccagagcaaaaaggaatccagtgtgctgactgacagcttcatcctgcgagatcctgatggcatacctgcttattctagtcgtttctttcaagggggcatgacatgtagtgaaggaataaggggaacttaagagtggaattgtgattttttttttttaaatagggcaatggaggaaagtgaggctggaatttagctcttgggtaaatttgatgaaattaagccttgccttcctactgctttctgttcctatattcttgtttcttgccaatgaagagaagctgttctagtatctttgtgatcctttgagccggaaggaggttctaagttaggagaaagtactaacttatttaaaaaaaatagaacaaacaaaaaaactccctcaaacgtctagccatggactcatagggtcttatgaatcatcaaagagactgttggcagtatcccctttattagcaagctgtctgtagtctgcaacttcttggcaaagcaacttttatatgtttataagttaaatggctaaatttgttttagaaatattaagagtgacttcagggagccttctgtttagtggcatgaagcaaacaaatctcttttgtcttttttcttttgacactgtcctgcctgcctcatcctgaactgcataactcactaagatattacctgttttccattagccattcttttagtccccaacccagagttaagtctgtcagaatatcattgagatcagttaaccataagtttagctgcctttgcaaggcatgtctgttgctattaaaagcagcaggcacctcatgagaatgctgcccagtcattcccagagtgtgatatgctaattcttaagaatgttgctaacactgcactatgtttcatatgattcaatttagaactttttattcaattggttggaggcttcaagttgacagtaataatagtctttcaagttgttgactaagtagagcagtgatagaattcatatgacaggccatagttgctcattcaagtccaagaagagatctctacaggccacagtggctgaaaaacaacaggaaagtagcctagatgttcactttttaatagtataacatatctttcctccctattttaagtgaaaacagatctctgtcattaaatgaggatataaatatttatgtcatcattgttgaaatcccaaagaatagaccttacacatttctgtgttcattttaaatggccgtcttttgtgtccaagttaaatttaaaaagctccctcatccctctaaaggtctcaccatagctagttagctttcagccttgatctccttttactcttgcctcctctaaaaactttttgatagttctctaagaacctaatcggagtcatacttggcaatacactgttaaagaaaatgtgtatcctagaagtccagatagtctttgtagatataaattaaacatacaaatcccttgctgtaatatgagcagaaagtgttactgttttagacaagtagctgctattctgtgtttcagtacagaacagggttttggtcaaatcaaggtagtgatgacagaatgtcagaacttcacggtagctaggagtccctactcttcattgtagtcatttattgaatattttgaaaaggtaaaaactgctcattgttttattgtctgtggtaaacagcatgaattagatatactttgggcataaagtgctcactgaaatggggtcctttcatatatttttcagataatatgatattttggcaaataatctcttcctagatcaaactatagctggcttattgagaattgttcagcagaatcgtccccaaaataaagaactaacattttctgagaattactttgtgtcagccattgtgctaagctttctacatgtaacattttatttcatccttaaaataacttaatgagtaagatactattatcagtcccattttatagatgagtatggtgctaatattaatgccattttccagatgaagaaactgggatgaagttaaatataacttcttcaaggtcacacaactggtaagtgatagaggatttggacaccagtttttgtgattccaaagcccatactctcagccactacatgctacagtcaaagactgcatgcataggcatttgccttagtatattttgcttgatgtgcctctctgctccagcctccagcaagactatgggtttcagcgatctcccctttgctaagggcagataagagtgttacctgtccttagtaaagagaatgaatgaccttataaaacaggattattaaccagaggagtgtcagtccgtttgggctgctataacaaaatactataaactgggtggcctataaacaacagcaatttatttcttgcagttctaaagactgttggcaccaacagattcagtgtctgatgagggcctgcttccttatgggtgatacttttttgctgtatcctcacatggtagaaggggcaaacaagttctctggggtctcctttaaaaagttattaatcccattcatgagggttttgcctgctcttatgacttaattacctcacagagacctcctaataccatcaccttgggaagtagggatttcagcatatgaatttggggggaaaataaaaattcagaccatagcatggagacagacttgaaaatgttcctgaaataatcagtaataaccatattaattcatgttgaacggggctagtttgtactgattctttataaatgtatagtgctaacttatgtgtgatttttacatatgaaacgttttcttgctggaaggttggtatggtgtattcttttagagccttaaagtcttgatggaatggcagggctctcttgattaaactggccatacttaaattattttttaaaaaatatagattccaaaatggctgaactaatttacattcccaccaatggtgtacaagggttccctttcctgcacatcctcgccaccacttattattgtctttttggtaatagctattctaacaggtgtgaggtgataactcattgcagttttaatttgcatttctctcatgattaaagagcatttttttccatctatctgttgaccgttagtatctcttcttttgagaaatatctgttcagatcctttgcccatttttaaattggattatttgctttcttgctattgttgtttgagttgcttattattatagatattagccctttgttgggtgtatggcttgcaatttttttttccaattcatggattatctcttcactctcgttttctttgctgtacagaacgttttattttgattcagttccatttgtctatttttgcttttgctgcctgtgcttttagagttctttccaagaaattgttgcccacaccactgtcatgaagcttttcccgttttcttcctatagttgtatagtttcagatcttaaagtcttataaccattttgagttgatttttatatatagtataaaagttcagtttcattcctctgcatatccagttttcccaatactgtttattgaagagatgagcctttttgcattgtgtgttggcacctttgtcaaaactcaattgaccataaatacttgggtttatttctgggctttcagttctgttccattggtcgatatgtctgtttttatgccagtaccatcctgttttgattacagtagctttatattttcaaatcaagtgggtctggtgcctccagctttgttctttttgctcaagattgccttgactatttgggttttttagtgaattcatacatatgttaggattgttttttctatttctgtgaaaaatgacattggaattttgatagggattgtattgaatctgtagattgctttggatagtgatacggttatgctttacatccccacccaaatctcatcttgaattgtaattcccataatccccacatgtcaagagacctggtggatgtaattgaatcatgggggtggtttcccccatgctgttctaatgatagtgagttatcacaagacctgatggttttatcaggggctcttccctcttcacttggcacttctccttcctgctaccttgtgtagaaggtgccttactttcccttcgccttcttccaggattataggtttcctgacgcctccccagccatgctgaactgtgagtcaattaaaccttttttctttataaattaccgaatctcaggcagttctttatagcagtatgaaaatggactaatacagataatgtggacattttaataatattagttcttccaatccatgaacatggtacatctttttttacttatttgtctttttaatatcttttgtcaatattttataagttttcagtgtatggattttcacctccttggttaaatttcctcctgttttattttttgatgctattgtaaatgggattgtttccttaatttccttttggaatagtttgttgttagtgtagggaaacactattgatttttgtatattgattttgtaacgtgcaactttactgaatttgttcattagttctgacagttaaataagccagtcacagaaagacaaacactgtataatctcacatgtgatatctaaaaacgttgatctcataggaagagtagaaaggtgataatcagtgcctgctgcggtcgggggatggtgtgggaggggatggggaaaggagagatgttgatgaaagggtacaaagtttcagttaaactgtaggaataagttttagtggtctgtggtactgcatggtgaccacagttaataataatgtatatttcaaaattgctaaaagaatttatttctaatgttctgattacaaaagaaggatacgttggtgaaataatgggtatgttaattagcttgatgtaatctttctacaacgtatataaatatcaaaacaccacattgaaccccataaaaatacatatacaattattaattttcaattcaaaataaattaaaacaaaacaaatatgtaggtttcataaagtaggatgtagtataagtaatgagtaaacactagggtctgatcttggccgttttattaacaatattacctttgagaatttcttttaatctctcttagtctatttcctctgtaaaatgaaagtttgaataaacctttgtttcccaaactctgaaagattactagagatgattttaggtggcatatgagattactttaggcagtgccttgataaaacattaaaataaacattgaatcacatagtaagaaagttactcctttttcaatctttctgattacatcaaaaagaaagtctcagtttggtattaagatatctttaatagttctctaacactggataattgtttggttgtgggggtagggtaggggtgagagtgaacaggtactgtgaattttatactcctcaagagtttccacatgagagtcacacagaacaatgaaagtaagaagaaaaaaagtttctacagaagcgaaattaattcccttagaatgaaaaagtacagaaatgcttttttgctctttctgttgacctcatttcccttgcacttggaacaaaatcaatgtgttatccaactggcacgtttggcaggaggaaccaaacgtgtgaggcacagccgtttctgacttctctcatggtgtggcccatactcaaggcacttctcttctaccatgtaataggctttggttgacaaactttgcttaggacaggatggcaactgtgagaaagtccacgaagccataaatccaaaccacaaaatcacattctgcaattcatcgacattggttatcaagctgatattttgattgtcattttatttctctctctttttcagttggtttcaaactcttaggaaatgtaagaggaaaagcagttattaccctttaaaacctcactaataatctccctttttaaccgaacttcagcttagagttttccataagcaatggtattcatatagaatttaataacatgtttttttcagtgaatttatatttatggttaacatctataaaagaaactcatttaagttttaaaagatgaattggcttttaaaatattaaataatacatatggtacatggatataaaaatcataaagatggtacacaaatgactaaaatttagaaaatactgaacaagattatttgtgagatttcttttagattaaaattcttttgcatgtatatttgaatagaatatataatgttatatggtaaatcaagtaaaagaagggctttctaacatagcatgtactatgttattttctttcattttgaaatatgttgttattgaggaaattaagcttttgttctatgccaattttcttctataagtgtaaatatcttttagtagtttactagacagtagcgtgtatctttttgatagcatatttgttggtgatgatttttttttaatctatttttctttcattgaatgcagtctagtctggatgagggttttgaactggaaatcttgagtagttattatttagaggtgaagaatcatgtcatcactgtataccctttctagcacagtgttcacgtagtagttgttttagctcgttttgcattgctataaagtaatactcaaggctgagtaatttataacaaaaaaagatttatttggctcatggctctgcgggctgtgtaagaagtatggtgccagcatctgcctctggtgagggcttcagaaagcttgcactcatggcagatggtgaagggacatggcaagagaggagggaagagagagaggggtgaggaagatgctgggctctttttaacaatcagttctgctgagaactagtagagcaggaactcactcattacctctagaacagtaccaagtctttcatgagggatctgcccctataacccaaacacctcccaccaggaccaggccccacctccagcactccaacactgggaatctaatttcgacatgagattaggagggggcaaatgcccaaactgtaacagtaatgatcactaaatatttaaacaagtgaatgaataaatgaatgaataaagaataaaaaactgagttctctgtcttaaatatgtgggcagtttttatttctttcttaaagctgttaatggagcaatctgtaaggaaactgaggccttgggttaatcagaagataacactttcatataagtaaaatttggagctagttacactgaacatttagaataaccttgctaggaagaagttgttaaaggaaggcagccctactaattttgcttttacttacaggaagctgaatttatggtcatatatgagactagggttttccttcctttctctcttttttataacaaaaaaattctccttcttgctctttcattcttctttttcttacatgcatgtactatatttctgatcatcttcacctcaaggaaagcaccccagttttccttacattaggggagactattacagcttaatttaaaatgcagctaattatttactcttatactcttaattatagtttcttgtctgataaaggtgcccacctcttaactggcaccctagatgaactgcagtactgatggtgaattattttactgccatttattcaggcaacaaatgtcatgtttcaaagattttgttctaagaatcctaaaaggagttttatatatcagagggagagaatatgaagaagttattagccaaactgactttctaataaccatgtagttggcttgattgactatattatattcctagatcatttcatttattttaaaacattttgcatatatacaggaaaacaatttgaagactgtgttttgttctggtgaatacattttaaacatattctaggtttattctttacaagtacattatttctttaatggtacagtgatttttattctaattcattatagtcagagacatcttaactggagttattttgtatgttcaggttaatattttttgttatcaaaaatttaacttagtacattttatggtagtgaaatatttctggtatctttgggtctcgtagttactactatgtggtcgtgaatatgtaaaataaactcggtgctggctatcacattttggattatacttatcattggattataaaggtgatagaacatcagtaacattcatgatttatggaaatttaattctgaaagtaatcataatctgtaaaaattagcatctagtctctgaactttagagttcaaggtaaaaagcaatacacattctattatcatatttgaaaatacagtttttttgttgtgatggtggtggtggtagttgcgtttttgagacgaagtttcgctctattgcccagtctggagtgcaaatggcatgatgtcggctcactgcaacctctgcctcctgggttcaagcgattctcctgcctcagcctcctgagtagctgggattacaggcatgtgccaccacacccggctaatttttgtatttttagtagagatggagtttctccatgttggtcaggctgatctcaaacttctgacctcaggtgatcctcctgcctcagtctcccaaagtgctgggattacaggcgcgagtcactgcgcctggtgaaaatatagttttttctttttaatttttgaaaaaattctgtgggtacatagtaggtatatatatgaggtaatgagatattttgatacaggcatacaatgcataataatcacatcagggtaaatggggtatccatcacctcaagcatttatcctttatgttacaaacaatccaattatatgtttttacttattttaaaatgtacagttaaattatcattgactgtagtcaccctgctgtgctgtgaaatactaggtcttattttttcgactttttgtacccattagccatcctcccttaccccccacctcccactaccttttccagcctctggtcactgtcattctacactctatctccaagatttcaattgtgttaatttttagctcccacaaataagtgagaacatgccaagtttgtctttctgtgcctggcttattttatttaacacagtgacctccagttccatccatgttgttgcaaatgacagggtctcattcttttttatggctgaatagtactacattgtgtatatttaccatattttctttgtttattcatctggacacttaggttgctttcaaatcttggctattgtgaacagtgctgcagtaaacatgggagttcgggtatctctttgatatactgatttcctttcttttgagcatatacccagcagtgggattgctggatcatatggtagctcaatttttagtttttttgaggaatgtctaaactgttctctgtagtggttgtactaatttacattcccaccaacagtgtatgagggttcccttttctgcacatacttgccagcatttgttattgcctgaattttgacattttttctggggttaaatgataccttgttgtagtttttgatgatcattgatgctgagcacctcttcatatacctgtttcccatttgtacatcttcttttgagaaatgtctaatcggatcttttgcccatttttgattggattattacttttatcctgtagagttgtttgagcttcttttatattctcgttatttatctcttgtcacatgggtagtttgcaaatattttctcccattctgcaggttgtctcttcattttgtttattgttttctttgctgtgcagacttgagtcggtcccatttgtccatttttgctttggttgcctgtgtttatgtggtattactcaagaaatctttacccactccagtgtcctggagagcttccccaatgttttctcttagtagtttcatagtttgaggtcttagatttaagtctttaatccattttgatttgatttgtgtatatggtgagagataggggcctagtttcattcctgagcatatggatatccagttttcccagcaccatttattgaagagagtttcctttcctcagtgtatattcttggcacctttgttgaaaatgagtcagtgtcaatgtatagatttgtttctgggctctcaattttattccattggtctatgtgtctttttctatgctagagccatgctgttttggttactatagctccacgtttttatgctagtgccatgctgttttggttactgtagctccatagtataatttgaagtcagataatgtgattcttctggttttgtgctttctgcttaggacagctttggttatcctgtgtcttttgtggttccatataaattttatttatttatttatttatttatttatttagtagccacagagtctcattgtctttgcaaggttggtctcaaacccttggcctcaagccatcctcccggtttggccttccaaagtgttaggattataggcataagccaccacatccccatttaagttttaggattttttttttctatttctatgaaaaagtcattggtattttcatagggattgcattgaatctgtagattgctttggatagtatgggcattttaacaatattgattcttccaatctatgaacatggaatacctttcctttttttggtgtcctcttccatttctttcatcagtgttttatagttttcattgtagagatctttcacatctttggttaagttaattcctaggtatttaactttatttgtaactattgtaaattggattatgttttggatttctttttcaggttgttcactgttgacatatagaaatgcactgatttttgtatgttgattttgtgtcctgcaactttactgaatttatcagttctaaatttttttttgtagaatctttaggtttttacaaatgtagtgtcatatcatgtgcaaacaacaagaatttgatttctttctttccattttggacaccctttatttctttctgttgtctgattgctctagctagaacttccagtactgtgttgaataacagtggtgacagagagcatctttgttgtgttccagatcttagagaagtggttttcagcttttccccactcagtaggatattagctgtggatctatgtatatggcttttattatgttgagatacgttgcttttatactcagttttttaagggtttttatcatgaagagatcttgaattttatcacatgctttttctgcatcaattgaaatgatcatgtggcttttgttcttcattctgttgatatgatatgtctcattgattgatttgcatatgcccaaccatccttgcatctctgggataaatcccatttggtcaagaatgattgtttcagtttcatttatttctgctctgatctttattcttctcttttactaattttgggtttgatttgctctagttttgtggttctttaagatgcatcattaggtcatttatttgaagtttttctacttttttgatgtagacacttactgctataaacttctctgtcagtactgctttcactgtatcccataggttttggtatgttgtgtttccatgatcgtttgtttcaagaaatttttttaatttccttcttaatttcttcattgatccattggtatttaaggaacatattatttaatttccatgtgtttgtatagtttctaaaatttatcttgttactgatttcttgttttatttcattgtggtctgagaagatacttgaggctgagtacagtggcacataccttgtggtcctagctactcaggaggctgaggtgggaggatcacttgagcctgggaggcagagtctgcagtgagctgaggtcacaccactgcactccagcctggacaagagtgagaccctctctcaaaaaaaaaaaaaaaacaacttgatagtatttcaatttcgtgaatgttttaagacttgttttgtgacctaatttatggtctgtccttgtaatactatccatgtgctgaggagaagaatgtgtattctgcagccattggatgaaatgttctataagtatttattaggtccatttggtttctgatgcagattaagtctgatgttcctttgttgattttctgtctgtccaattctgaaagtgaggtgttgaaatctccagctatgattatattggggtctacctctctcgttagctgtaatatttgctttatgtatctgggtgctccagtgttgagtgcatatatatttataattattatatcttcttgatgaattgatccctttatcattatatagtgaccttctttgtcccttttttttttttttggaaaataatggaatttattctagacaggatttctttttttttttttcctgccttcaagcatctgtttaacaaagcacatcttgcaccgcccttaatccatttaaccctgagttgacacagcacatgtttcagagagcacacggttgggggtaaggttatagattaacagcatcccaaggcagaagaatttttcttagtacagaacaaaatggagtctcctatgtctacttctttctacacagacacagtaacaatctgatttctctttcttttccccacatttcccccttttctttttgacaaaaccaccatcatcatcatggcctgttctcgatggtcgctgtctctttggagctgttgggtacacctcccagatggggcagccaggcagaggcactcctcacttcccagacggggcggccgggcagaggcgctcctcacttcccagacggggcggccgggcagaggcgctcctcacctcccagacggggcggccgggcagaggcgctccccacttcccagatggggcggccgggcagaggcactccccacttcccagacggggcggccgggcagaggtgctccacacttcccagacggggtggccgggcagaggcgctccacacttcccagacggggtggccgggcagaggtgctccccacttcccagatggggcggccgggcagaggcgttccccacttcccagacgacgggcagccgggcagaggcgctcctcatttcccagatggggcggccgggcagaggcgcttctcacctcccagacggggcggccgggcagaggcgctcctcacctcccagacggggcggccgggcagaggcgctcctcacctcccagacggggcggccgggcagaggcgctcctcacttcccagacgatgggcggccgggcagaggcactcctcacctcccagacagggcagccgggcagagacgctcctcacttcccagacggggcggccaggcagagactctcctcacctcccagatggggcagctgggcagaggtggctcctcacatcccagacagggcagccgggcagaggcgctcctcacttcctagacggggcggccgggcagaggcgctcctcacctcccagacgaagggcggccgggcagaggcgctcctcacatcccagacgatgggcggccgggcagagacgctcctcacctcccagacggggcggccgggcagaggcgctccccacttcccagacggggcagccgggcagaggcgctccccatttcccagacggggcggctgggcagagatgctcctcacttcccagacggggcagctgccaggcagaggcgctcctcacctctcagacggggcggcctggcagaggcactcctcagttcccagacggggcggccaggcagaggcgctcctcacctccttctttgtccctttttatagtttttttttcttgaaatctattttgtctattacaggtatagctactcctgctcttttttggttttcattggcatgaaatatctttttccatccctttatttttagtctgtgtgtctttataggtgaagtatgtttcttgtaggtaacagatcattgaattttgtgtttcttagctattcagccactctatgtcttttgattggagaattcagtttgtttacatttagtgttattaataataagtaagatcttactcctgccattttgttatttgttttctggttattttgtggtcttctcttccttctttccttcctttctattttccttttagtgaaggtgattttctctggtggtttgttttaatttcttgctttttattttttgtgtattcattgtatgttttttgatttgagattatcatgaggcttgcaaataacttatagctcgttattttaaactgatgacaatttggcaccgattgcataaacaaacatgcaatcaaaaagaagtctaataaatactctgtactttgtccccccaactttttaactttctgttatttctatttatatcttatggtaccaagtatgtcttgaaaagttgtagttatttttgatcggttcatcttttagtcttttacttaagatatcaataggttacataccacaattacagtgttataaaattatgtggttttttgtatgcttagtatgaccagtgaggtaccttcagatcattttttaattgcccattaacaccttttttccttcaaattgaaggattccccttagcatttcttgtagaacaggtctgatgttgatgaaatctctcagcttttgtttgtctgggaaagtctttatttcttctttaagcttgaaggatgttttcactggatatactattctagggtaaaagttttttttccctcagtagtttatgtcataccactctcttttggcctgtaatgtttccactgaaaagtctgctgtcagacatattggagctccatggtatgttatttattttttcttttgctgcttttaggatcctttctttatccttgacctttggaagtttggttattaaatgccttgaatggtagtcttctttgggttaaatctggttgatgtataactttcttgtacttgaatattgatatctttgtctagaattcggatgttctctgtttcatccctttgaataaacgttctgttcctatctctctctgcctccttcttaaggccaataactgttagatttgcccttttgaaactattatttagatcttataggcatgcttcattgtttttcattcttttttcttttgtctctgttgacagtgtattttcaaatagcctgtctttaagcttaccaattctttcttctgcttgatgacttctattaagagactcagtatgtcagctgcatttttcaaccccagaatttctgcttgattccttttaattgtttcaacctctttgttaactttatctgataggattctgaattccttctttgtgttatcttgaacttctttgcatttcctcaaaatagctcttttgaattccctctctgaaaggtcacatatctatgtttcttcaggatttggtccctggtgccttatttagtttgtttttcaaggccatgttttcctggatggtcttgatgcttgtgggtgttcattggtgtctgggcattgaaggtatttatcgtagtcttcacaatctgaactcttttgtacctgtcttagaaaggctttccagatatttgaagggagttggctgttgtgatccagttttggtcattgcagccatatctacattagggggcaccccaagcccgataatgctgtggttcttacagacttgcagaggtactacctttgtggtcttagataaggtctagaagaattctctggattaccaagcagagactcttgttctcttcccttactttgtcccaaacaaacgagtctctgattctgtgctccaagcctcttgtagttgggggagtggtgacacaagcacttttgtggctaccaccactggaactacactagaccagacctgaaaccagcatagcactggatctcacccaaggcccagtgtaacccctacctggctacctcctgtgttggctcaaagttctagggctctataatgagcaggtggcaaagccagtcaggcttttatccatcccttcaggacagcaagcaagttcccctgggccccaggcaggtccagagatgccatctgggagccagcatctggagttggaaaccttagaaccctatctggtcctctattctcctgcagctgagctggcatccaaaccataaggcaaagtgcttcccacttttcactcctcttttcataggcaaaagagtctctccctatggccaccaccactacaagcccacagggattattgccaggctacggttcatgttcacttaaggcccaagggctcttcagtcagcttgtggtgaatgttgccaggcctgggactcgcccttcagggcactgggctcccctctggcccaggcaggtccaggagtgccatacaagagccaaggtctggaatcaggaaccccaagagcccacttggtgctctgttccactgtggctgagctgttatccaagttgcaagataaagtcctctttactcttccctctctactgctcaagtggaaggaaggagtctcttttggagctgtgaactgcactgccttagattagggaaagggtggcataagcactgccttagccacctcagctggtggctcactaggttacgtgccccctaggtccaatgactctcgaacccagcacagcactaaaacttgcctagaaattacagttcttgtggcctagactgcctttcaagttcatttagggccccaggacacttcagcctatagtggtgcggcttgttgaaactcaggctccaaccgctgggatggacatttcccctctggctagggcacatctaagttctccctccatgggcattggctgagttctttgctaatggcccgggtgttgcttgccagttggcctggtgttgctttctgctgtgacatggtaacactgagttccagtgcaaagtcccacaatcactgtgctccccctcccccaagcacacagattctttgcaccacacggccactgcatgggggtggaaggggtagtagacaatcgaaaactgtctttcctactctcttcagtgtctctttcagcaatatgaagttaaaatcaggtactgtgatcacttacctgatttttggttcttgtgaaggtgcttttttgtgtagatagttgttaaatttggtgttcctgtggtgggggcagcgattggttgaggcttctattcagccatcttgcttcatctccctccaatagattaaaaaaaaaaaaagattttagaattatctaatttttttctttaaaagatgtagatgattggcttataattataatcttcaggtgtttccagagtcattgtgttctgtcatgaaagtaatgcaagagcaattttgctgtaatgaaaagctagaagtttcgagaacactttattttctaattccaaaacaacaacaaaaaatagaactttgctagctggctgtgtctactgtcattctttgattagatactttgagttctgcataccatgaggtgttggtatgatagcatgttatgatagaaacttttagaaaagaccagagacttgagagatagactaacctgcatgtgaaattcacctccgtcacttttgctctggtatttcgagcaagttatttaacttcctttgtaaagtgaagattatacttctttagagttgctgtgaggatgaaagcactcagaataagttcttgttgaatggtggatgtataaggaataccatgtggtaatgattatatgtttcaatattgtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattgggtaagaatctgattttttccctcaaactgtgatatgtagtagttagggttatgtatctttacaatatattgtgaattttacaatatgtagttcaatttttatagtcccaccaaaggacagaggttctagagctatcctaaggacacatggagactatttttttttgtttgtttacttagaacagctaagaaagttgcttagtagtgctctattactgtctccagttctcctcttcctttgcttctttctcctcttatcacagctctcttttggcttttgttgttgttatttttgagatagggtctcactctgtcacccaggctgaagtgtagtggctcactgcagcctcaaccaccctgggctcaagtgatcctcctacctcagcctcccaagtataatagctgggtctaaaggcatgtatcaccatgtccagcttctttttatttttattttcatatttcccaccccacatctttccttgtgtcttagtcttcatatgtagaggagttattgaccccattctaagtgttagacgtaaagaaggtacatgtgaagtcagaatatcaaatcgtatttcttctcatgtaacttttgattgaaattcaatggaatcattcgttctgcccacttcatctctatagagcccactgaacaattccaatttccccagaaaaagagtgattatgaaggatgtgggaaggaaagatgatagaatagatgttcatatgattgtatccacatctgggttatagtctggaatgcaaagcaaagaatagccgtgaagatggcagagtaactctggtgaaatcaaaccttcactccagattcataataaaaaactggccttaagtttggcccatatactgtgacctaaaggcgtataagtctacctttttctacatataaatagtgatttagtaatttggggggaggggaaggcaagatttaaggagggtgttttaatttatgaaaataaactgttatttttatttccattaatattgctttggggccaggcatagtggctcatgcctgtaatcacaacactgggaggctgaggcaagtggatcacttgagcccagaagtttgagaaaactcaacataggcaacatggttgaaaccccatcaattaaaaaaaaaaaaaaaagcaaaaattagccaggcttggtgacacatgcctgtagtaccagctgttcgggaggctgaggtgagaggatcacttgagcctgggaggcagagattggagtgaaccataatcacgccactgcactccaatgtgtgcaacagagcaagaccttgtcttaaaaaaaaaaaattactttggaaacactaagatgggaggagagaggagaaaactgtggaagtcagtgccttattcagtacagggaagtgtgaatctgtgtccccaattttacaattttggggcttttcttaaatatgacaggtgaaattaatatctgctgtcatttgatatggtgaaaaacagagaaaggaaatgcattatgcccacaacagaagggctggaatcggtttcatttacctaaaatagtaaaaaccgttaaaaggtttgctggtcttaacggtgctgtaaaagtttatccaggtctatgttttcctgggacaacttttaagttctacaagctggcagttatggtgactctccagggtaaaataaagaggaaaacccttggtatcagaactttacaaataatatctctaatgttctttagtaacaactgtgaatcctggtatcatcctggtaacaaaaatcttaagttgtattcagtttttttccagacagctggttgctgcctagtatgaaatgcagctctgaaatttcccatttattcctaagatgtgaattattttctctataagaaatcattcttcaaaggctttacttactttctaattccccttgtattgtttagcctgcaaatatatttagaatatgtatttttgagtttttaaaatactatgtgttttactttttctaatagtgaaaatgaaagaaaaatcagttaaaaatgcctataatgccaccataagtaggggtataaattgagtaccctcaaagcacccagtgtcagtacattaccagtagaatctgaatttctcccccagagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaagttagaccaactagtgattctagagtggggttgtctctttcagtttaaaagaattcttacttcccatgacttgtgatttttgtatattattattgctaattattagggttttaaaaattcaatggactatgtacttgtgtaactgtcagtctaatcaaagtgtttttattagccatatccaataatgccttataagaagtctaaaatgaactggaccactgacttacgcattgtcaccagcaataatcattattatcattaaaagtatcaccctacttcttggtactaaaatcttcactagtctgttggagctgccataacaaaataacatagactgagtggtttaaattacagaaatttgtttctcccaggtctgaggctgggaaattcaagatcaagatgctagcaaggtagatttcattttctcttggcttgtaagcagccactatttcactctgtgctcttgtgacctcttctttgtgtgtgcagggaacaggagaggaagtgttctgatgtctccacatataaggacactaatctcatcatgagggccccattctcatgacctcatctaagcctaattatttctcagtggtcctatttccaaacaccatcacattggggttagggattcaacataggaatttgtgcgaatgtaaacgttcagtcgataacactagccagccatacagactgttagcaataaaaccaggtgcttatcgttttgatttcactgacttcattaacagttacagacaactgaacacatatgtagagttttgtcttataataatttgtggaatttgaaagttatactaaagaaaggtaaggaatcaaaaagtaagttttgtaagttgaggaataaagactactactgtgtatggaacagtaacaattattttttgagcttgcctgtatttcaggcactgtgctggtgctggggatttcatgataaacaagatactccctgctgtcaaggaattcccaaatctaatagggcaataaacaattaccctacagttgagtaacactattatagggttaacatggggtattatgaaaacacatagataaagcacaaatcctgattggacacttcttataggatctgagtaaacctggagttagtctttatttactatcaataaatgaaggatgtattaaatgtatgtaaaagtaggaaattaaggagaagaaaattctagtcttagttctgctcagatactatctcctccagaagtcatccctgaacccttgactggcctgtgttccccactctgtacagttctctgttgtagtgtttagcacttgcttacttctgtctccttcactagattataagtactttggacataatacctagctgtagttaaatgcccagtaaatattaaatggtattgatttcaatcccatcagtttgaaaacattaacacttaatcatttaagctttttggctatttaattaatgtatttgttgtcccccatgtttcaaatggggatgaggaaaataaataaatttagaatgaggactataatgcaggtattaatctaagtcattagataataatttaaatcctctttctacctctgaagaatccaaatgaacctgaagcaaattgccttttttattcaaggctccctctcttgagcatatgcacacactaccatatacatgcgcgcatgcgtgcacacacacacacactgagatgtgtatatatataaacaaagggcaaataattcatcagccaagtataagaatgagttaatgtaagagggattaaatgaacatttgggcacaaaacacaataaaaaaatgtatagtttaccatgtttcttcaatttaaaacaccaaactgaatttgtagcttggttgaagaaaaagatactaattttgtctactctttcacttgttctggaacgcatcacaagcttttttccttgttttcttgatgagcaaattaattcatgctcacttaaaaatatgcaagttggtaaataccctattagttcattttcacactgctgatagacataccccagactgggcaatttacaaaagtaagaggtttaatagacttacagttccacatccctggtggggctcacaatcttggtagaaggtgaaaggcaattctcacatggcagcggactagagaagagagcttgtgcagggaaactcccatttttcaaaccattagatcttgtgagactattcgctatcacgagaacaccaggggaaagatttgcccccgtgattcaattaccttccactgggtccctcccacaacacctgagaattcaagatgagatttgggtggagacacagccaaaccatatcattccacccctggccactcccaaatctcatgtcttcacatttcaaaaccagtcatactttcccaacagtccccccggagtcttaactcatttaagcattaactcaaaagtccagagtccaaagtctcatcgaagacaaggcaagtcccttccacctatgagcctataaaatcaaaagcaagttagttgcttcctagatacagtgggggtacaggcattggataaatacagccattacaaatgagagaaattggccaaaacaaaggggctacaggccccatgcaagtccgaaatccagtggggcagtcgaatgttaaagcttcaaaatgatctcctttgactccacgcctcacagccaggtcacagtgatgcaagaggtgagctcctttggccttgggcagctccacccctatggctttgcagtgtatagcccccctcctggctgctttcacgggctgtcattaagtgtctgcggcttttccaggtgcatggtgcaagctgttggtggatgtaccattctggagtctggaggatggtggccctcttctaacagctccactaggcggtgtcccagtagggactctgtgtgggggctctgaccccacattttgcttctctactgccctagcagaggttttccatgacagccccattcctgcagcaaacttctgcctgggcatccaggtgtttttatacatcctctgaaatccaggcagaggttcccaaacctcagttcctgacttctgtgcgctcacaggcccaacaccatgtggaagctgccaaggcttggggcttccaccctctgaagcaatagtctgagctgtatactttagcccctttttgtcatgacggaagcagctgggatgcagggcaccaagtccctagactgaacacagcagaggaaccctgagcccagtccacaatatcattttttcctcctaaacctctgggcctctgatgtgaggggctgccacaaaggtctctgacataccctggagacattttccccattgtattggtgattaacactcggctcctcatgacttacacaagttttctgcagctggcttgaatttctcctcagaaaatgggattttcttttctgtcacattgtcaggctgcaaattttccaaacttttatgctctgccccccttataaaactgaatgcctttagcagcaaccaagtcacctcttgaaatctttgctgcttagaaatttcttccgccagataccctaaatcatctctctcaagttcaaagttccacaaatctctagggcagagacaaaatgctgccagtctctttgctaaaacataacaagagtcacctttgctctagttcccaacaagttcctcatctccatctgagaccacctcagcccatactttattgtccatatcactgtcagcattttgggcaaagccattcaacaagtctctaggaagttcgaaactcccacattttcctgtcttcttctgagccctccaaactgttccaccctctgcctgttacccaattccaaagtcacttccacattttcaggtatcttttcagcagcactccacttcttgtaccaatttactgtattagtccattttcacactgctaataaagacatactcaggactgggcaatttacaaaagaaagaggtttaatggacttacagttccacatagctggggtggcctcacaatcatgatggaaggcgaaaggcgtgacttatgtggtggcagacaagagaagagagcttgtgcagggaaactcctgtttttaaaaccatcgaatctcatgagacttattcactatcatgagaacagcacgggaaaggtttggggacccagccaaaccatatcattaccgaatcaaggaaaaagtattatcctcaatcccatttatgtagtctcattttctaatacagtcatgtaccacataacatttcagtcagcgatgaaacacctgtatgatggtagtcccatagattataaaactatacttttactgtaccttttctatgtttagatacacaaatagttaccattgtgttacaactaccttcagtattcaatacaatagcttgctgtacaggtttgtagcctgggagcaataagctattccatatagcctaggtggatatatatgtatagcctaggtgtggtatagttggctatgccatctaggtttttgtaaatacaccctatgatgtttgcatgatgataacatgcctaatgatgtatttctcagaacatatcctcgttgttaactggagcatgactgtagttgatcgaattctatataatttaaactcttttcacttaatacagcaatagatccattcccctaggttgctaaaatagtcattgtaaacatgttttttttttttttttttttttgctttgtcacccaggctggaatgcgttggtgcaagcatggctcactgcagcctcaacctcctgggctcaagaaatcctccttcctcagcttcctgagtagctgggaccattggcatgcagcatcatgcccagctaattttttatggtagagacgggattgcatgttgctcaggctggtctcgaactcctgggctcaagcagtcctcctgccttgtcctccaaagtgccgggattactgtcgtgagccaccatgcccagcctaaacatcttttttaatgactacatacatatacgctgtacagatatgccgttgcttatttgaccaaccattcttctaatattaggcagtcagcttatttccagtgtttcattcttataagtaatgctatgacgtatgcctaaaattatccacattatttccttaggctagatttctggacttggaagtatttagatgcaaggatataaacttttttttttttaaatacagggtccaggctggagtgcagtagcacaatctcagctcacggtagcctcgacctcctgggctcaatgatcctcccacctcagccatctgagtagctgggactacaggcacatgccaccacactcagctagatataaacattttacagctttgatccatagcacagcatgacagttttataccaaacaacccttatagtacagttggcagtatctacttggactgcaagaatagtaaaaccagaatttcctccttgtagccaacagctataactcccctgccagtggtagtccaggcagcaattttctccatattctgttataaatatagtagtagccttttatgcataattttttctctttgtaaatccttttatttttattttcgacttgagtcgtttctcggggatttaaatgatgggttttttttctttactcttttactgaaatgtttttctactctgatttaattctgctttaaaatactcaggattggttttgatacctaagcaaatcataaaaatctctgccattgttttaagagaccaaaagcatgaattaatctattatcaaagtatatagtatccaaggtaatcattgtaagacttttctgcttcaagagggtgaagagatgaaaaattaaacttaaatgatgtatagtgttcacacagtcagaggtatagtgttgacacagtcagaggagaatctattttctgtgttgctcattctttgaaaaggggttaaaattagctttatacacatagcttctgtgtgaagatgattggttaatgctttgtggcttggtattgcacttcagatttctgcatgttaagattgagtccgaccggacgcagtggctcacgattgtaatcccagcactttgggaggccgaggtgggcggatcactaggtcaggagattgagaccatcctggctaacatggtaaaaccctgtctctactaaaaatacaaaaaattagctgtttatggtggtgggcgcctgtggtcccagccactcaggaggctgaggcaggagatgatgtgaacccgggaggcggaggttgcagtgagccaagatcgcaccactgcactccagcctgggcgacagagcgagactcaatctcaaaaaaaaaaattgagttcatccacaagattttaccaccagcatcccagtgactgtggcagccattgctattgtggcgatctcttaagtagttcagtattacagtgtttgaatcacagaatcattgacagtcaaagaaataagaactattaaagttggctatccaacattgcattctaagattgtggagattagggatggggttaaaataggaagaaaaacaagtctttaaaagtttcccaggtaaaatatttacaaattgagtttattctttatttttaaaatgctgaatgagttctttctaaaagtaggtacattgaaatgaatagagacaagaacaatttgttaaaagttttttgtaaagtatttggttgccctgtgaaacaaagaatcagcaatgagtggtgtatttgttcactattttattgaactcctataatatgctggacacagcacagagcactaggaatacaaagtcaaaatataatgtgtggctccttatctcagggagtaaccaacaggtagacaatatacatgtaacacatattacagtaaatttagatacgtctcctgaaggagtttatgtaccaggtacagtgaagtcacaaagagaagtatctccctcagtcaagagaaggacttcagaaaagaacaccagatattagtttataactgcaagctagtcctttgtggatgatataaaaataaatttttataaagtggaaaaaaaaattattattcccagtatctgaaacctcaaggtagaagaattcctccactgacatacttgagggcaaaagacaagaagcatgtttgtgcaaaaagtttcatgctcattatgaaaggtgtacaatttccttcttccattatttactttgttttgtttgtgtgtgttttgttttgttttacacttaggtatcctttatgaagccatagagataggcctgagagctcttttgcatgtagagatgggcctgaggaacttaggtacctttttttaaaaaaataatggtagggtttcactgtgttgcccaggctggtctcgaactcttgagctcaagcagtctgcctgcctcagcctcccaaagtgctgggattatagggatgagccaccgcacccagccttaggtacccttttgatttggttccagagagggctcttttagttaggaaggccattaatgttagtgttacttcttggtaaattgatcactcctttgtttcactgagcatccaaatcatgctgacaaagttagtctttattcaaggataaaacctatgctggttttatcagttcccccctttctttctccctctagcatttcgtatttctttgttgttgtttctgctccatgcctgggtatgcagcttcccaagaatcacattaaaactatttctggttgttttcttttccgaacaaatgtgacattttcttcatctccttgattttgagctgaagaaggcaaactgtcaaaaataatgaggccagatggatttgaacactgaatagcagtctgaaacagtgctcagagactttgcctttacaatcattattacagaggcaatgagggaaagctccttggtggccatgaaatgaagagaaactgaaacagctcttaggggattagggaaagtcccaggcataggtagcactgacttgttcatgtatttattcactcagcattgtgtggagtgctagatgctgtgatgcaaagaaaaataagtcatggtcctaaccttttttggaatactgtttggaagacaaacatgtaaactgactcctgatgcttcagggtttctatataagaactattattccttcagcaaatatttattcctcctctattatattccagattcttttcaaaagacatcctgtatgaatacttttaaacacacactatctctagcaagactaccaaaatattacttggtggacatctatggaatttgcttccataaatattagaatgggctttctattactgttattaggtaagagtagatggttcttcaagaaggatgcaggttaagggagactgttagttctcacaaatttttaaaatattcatctcttaacttctttttattattaacttgtaatgtcaatgaagaagacatttacaaagtctaacccaaatctgaattatcagaaattctaaattaaaaattttaatgaggttttatcacagtatttgtattctaaaggaaaagctcagtgaccaaatatgaaagcagtttgaataaactcttaaaagtcactcattacaaaaagaaaaaggagacttcaattttcagctatttcatgaattgataaaggacattttgatgtgtgtatgtgtgttttatatgatatgccaataaaatttaatatacagggcattccagaatggtttctgccccactgatggacttcaaatatgtctcatcaactacagtattaaatgccataattaaaggtctcctttctgtgagaagctcttagtcaaaggagaaagtctgccttctgataggatactgtgatatctatgaccatctataaattaatttattttttcaggtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtaagtgtcagtagggcattttaaaataaccaatactttttggttgtataggagtcagaaaaattatttgtgtgtctatgtgttgttaatgttcattattgtgactcaggtgcaatttttctgatactcagtaatgatcccttttgtgaaagaatggaaagatcccataacatagccattcacatgcactaatatttagttgtttgcaagtaatggttgactacatctccactgaagccagttactggagttgtttaaagtacttggcttgttcacagcatttaacagaaacaacaagtaattaagcttacttaatactttctaattttgcatatagtcaatatgtaaccagaatccatccatttctacacatcatcgcactgatactgagaggcttaaatgccctaaattttgcctcagttgattgctttatagaaaagagagtaaatgtaattccctttcaagttctattacatttctaccaagtgagaaactgtatgttaaatttaagcaatataatatcacaatctttgtttgaatttaattgttgcagatgattatattttatgggtttggtgtatgtgtttttatgagggtccagccagctttgtatgccctgtggaatatcaggataacaatatttattgtggattttattctgttctctcatttatgcacatattattggttagttcattcaaccagctgttaaatgcgctcaaaattatactaggtgcagaggagatttcaaaggagattgaagatacagttcttgccctggtccagaatctaataagcaaaatacacacatcaaataactagagaataattaccagaacatataaattggtataagataaatgtatgcttaaatgctgagaagaagcggagaaaagaaaatgtgaaaaaaaggaaagccacatcatttttacaagagtatacttcggagagtaaaaggaaatggagactttcttattatatgacaatacacattgtcatgatgggatggcgatatgatttttggaaagataccttgccaggcaaaggttacagattcctttaatatggaataagaatacaacttactacccaaagatagctgcacagaacacgtagcagcaatcttaatcagaagggaaaatgtcttcaagttcccatgaaggcatccactatttatgtttctccctaattggggtgtggatcctatctttaagaaactcatttccattcttattgcaagaaaggggcaaggtttataactacttggttccttgcaactgtttttgagagtctgactatgcatctgcctgatcaacaggtacatgtaactggtaacaacctccaaacattcttgatgcttattgttacaatgagtgaatcaagagtcacttccccagctatgccaccttctctgtaggcctggattttaggcctgcctgaagtcaactcctctagtccaggtttctcaaccaaagcactattttagaccagagaattctttgttgtgaggagccgtattctgcatgtaggatatttagcagcatccctggccagtaagaccctcacttaaaattgtgacaaccaaagatgtctccagacattgccagatgccagatgcccctgtggagcaaaattgccctggttgagaactacagttctagtcacaagattctaaagttaaataaacatacacatgtctaaatgtttaccaacctcacatgtaggtaggcactgagacttacagggttgtactcatgttttgcttttcttctcccaatcctccttagtaataccattaggcttattctggaatagaaagaaaattttttgctttactatttttttttcctttttgaagttgtactttagaattttggatcctcataactccaattttgacctacaaatcaggatctctgtcacttcatgatggtagaattctgtctaggcttgaggagaatattgttctattactttgtttggttttatgcataatgtcaacttcagtgtattcagaacttgggtccagagaagcaattcatatgaagaaagagtggtgctgagaagactttctgtatccaaaggaataaggctcatacttatatttcacattgttcctaaaaactcctggcagtcaaagtttgcccaaaataatttcactcatttgaacctaagcaaaattaaaacagtatttcataacccaaaatagacttgaatacctcaaaatattttatgttaggattcacaataaaagtttaacagtagaaataccttacatttatatagtgagtagcagtttgcctaatgtgattacctccttatcatgtaccttatttgatgactaaccgctgtagcatttgaaattgtagagtaattccatattcagtgataaatctttgagcttacttgcacctcattatttttctcaaatatttttagtaaagaagtatttagtaaagtttaatgtttttgtagtgtgaatgaaattgtttgcaggattattatgtagattcctttacataaaccaaaattggaattgtttgaaaatgccctagaaatatcttgccatcattgccaatagagcgtgagaaaaagtcactgatgggataaaatgccaaaccattgaccactgatcacagaacaagaaagaggcaacctgtgctgtagagtcaggatatctgtatttgcatccaactttgaccaattactggctgtgtgtccttgaacaaattgcttagcctatttcttaactggtttatttttctacatgtgaaaaaataatagtacctatagtatagagtctttttgaggattaaggagttatgaaaagtaaagcactgcgaatagtacctagcaatacagtgttaaacacattagctgctattattatatatatgaatagttataggaatatctctgcctgttagagacactctatagtatttattttgcagctctttttcacatggcttcatttcagactgtatgcgctcacattttagaaggagcatgaaacgagctagtcaaggcctccattagctctgcttgtggttacgggtaatgcttagggtccgtaaagaagaggaactgttaacattcagcatgtacaatttctctgggccaatgtaccacctcaacttcattttgtttagcttattgaaagagaatattgccatatgatgcgatttttcagaaacaaaagttcttcattcccaaaaggtgagtgaagacttagtatttgaagtaaatgtgtgtgtgttgactttagtgaaattaatcttcagactttcctatatatgtcataagcattctagaaaatggaggaagactaaagccatacatccagaagagtgacagaagataaacactgagaataagttcagcccagaataaaaacatggataaccaactctcaactttcttagatgataatttcatgtgccaagagatgttaggaagtgatccaagtttaatatctccttcataattctttgacaatctttaagttttattcatgtaaactttctgtctcctatacactatcctttcaggaattttataccatataacaatagtgagaaagagttgacctgttgaccatgagctattgtagacaatactgcaggaatgaaatgccatgctagaaggaaaaatacaaggctagatgtttggaaaactgcaggcaaaaatgtcatgggaccttaatcgggatttctcataaatttttagacctatctccctcagtctcaggacttctcatctttcttggttttatatccataagtgaggtctgggaattctctcttcttcaatgaaaaggttttaaaagccaacactgtggctctgctctctaattttgttactattattgctgttaactttcatcagatctgtttctcaaagccaagtttgtcctaaaagcctcataaattgaatagcacagtcctcaggatttaatatgaaaattggaggcaatattagcatttttttcaagtacgtcaagtgaattttgaaagctatgcaactacattctaaaacgttctaccaaatacattaatcctattctgtgttactggaaatcgcctatgtgcaaagcatctcctttgtcacctattttcttatttgaatcttaaatctaaagcaaagaatttatagttggagaataacagcagttgacagcccagttgtagataggcacagtatcagaaaggttttctgaaaatattgcttatcaggttctgggatcaatttttatttttctgaaatctgacttaaaaaatggttgcagatgctcactttaaagactaacattgttaaagacattgtttaaagagcagttaatgttactctgtagtttcagccattaaaagttatcataatacaaaatcctttttttccccctatgacacctccctttatggcagttattacaatactctcatgagcctctcttggtctaattccaaatccgcacgcaattctactccccttattacactttgaatcagattttggaagcccagagggcaaaaccaaaaactacgttaactattccagacagatggctctggacaggaatttccattgagatgtggctcatgaaacaacagtggatacctgttgagagtaccatggaggaaagcacagggtgaaatcccaaggtgtgaactctgtgattacttcccagagcagaagacaagaaaagtatttgcatccacagaggctctatctagcttacaatgctgagtgctgtacagtgcagctgttactgcattaatccttctggtgtttctcacaacaaagaaaagacctgggtcttattctcttattgtatagtaaaacaaagcagattacaggaaaagtgcacagatctctcagccacttccaacttctcacactaggatatcctcctgcccctatctatctattttgacaaaaataagatcccatctactctgagaaagctttggaggcttatgtaaactcaggctacttctaagggatgaaattcagactaatggattcctccccctttttaaaattttttttaatacagtcatatctgttttatcctttggcaggatttttgctgttacccattactgtgtgctttacgatgtactaaaaatgatacagtgccatgtcaacacagaataaagttaaacatactacatgtagccaaccactgctttgcaaaccatggactgctctcagtcatgccacctgtcaagcatcaaacctgagtatggacgtcagctgcaagccttcatttacctgccatgtgatttgaacttttaaaccacgtggtaggtaaggaaagaagagaggaagcatagagtgactaaatgcgaacattaacactatagtaatctttttagccttttgcagtaaattgtcccatggttgatatagacagttttaaaattacttcctcttaatgttatatatggatcttaagggttaaatatcacccatggacttgtgtctccattactgggctggtattatgcctggagcaatattcattcaacagatacttattgagcacgtactttgtggcaggcattgttctaggtgtttatcctaagggaatatatactcaagagcctgaaagagttctgactgtggctctgccattaactagttcctttttggatttttatttttattttttgaaatttacttaatctttctgtggcttagcttcttcatctgtaaaatatgaataataatagtacctcacaggtttgtcataatagttaaatgagttgagacaaggtgagggaagagcacactattataacactgcctgggacataatcggtgctcattaagttcagctgctatctttaatggtcattcttatgagaaaaataaagggccacacctgtgtagcactggtatgcttgcagaggcctacagtcacatttgtcatttttataatgggccacctcagtgtctgaaatctctactattattataatagttatttctttggtttaagaaaacagttctgttatccaccaaggttaacacatgaacaactcttgatagcaaaacatacactaattattaggattatccccagaagaaacaggtctctaagggtgtgggacagggtgcgatgttgtttttatgagagtaagacgtttaagagtggagaggaggaaacacatcacggttcattgtcacagtagagattgtggtcatcctaagagtaacacaaggtcctgcattcctggctagggatgactgaagagtgggtgaagacaccctgaaaagaagactgtcaggtttacccaagactgtctttggtcttatgctatatctttctggtgttacaatatgaacatggagaataagatttacaagagaaaatatatatagcagtttcaagcatatgcagactgcctgggttccaacctgaatttaccacttattagtataaccttgagcaatgccttaacttccctttgacatttgtaaaacaaacataatgatagaattttatggggatgctgaaaggaatctaattacattagataatgtctaaaaacaatgtctgacagttagcaaaagctcagtaaatattagcctctgtcattgttattgtagtttgctattattggagctgctttaattatttagtttcttcttttcctgagtcccacttaattttgcttgccttctatgagcctttggctgaatttgaaattcaaaagttccaaatctttttgatccctattttattatagtctcggtattctaccaatgatctcaattgtaaaatgacattgccaatataatcgttgttgaactaataaatctgaaagcaaggtttctattattttggttctatatctagttgaaattctgtcactaaaatttgcataaatcacttaatctccttgtgttttagttgcctatctgcaaaattaaaaatattgtctaaatgtagtttcatttgcaaattatatatagcatttgagaattgcccctcaagttttctgaaattcagattctctaagttgaggtgatgattaacctagtcagattttatttgataagagttaagaataggcatctccatttgtattagtctgttttcgcattgctaaaaagaaatacctgagactgggcaatttataaagaaaagaggtttaactggctcatggttctgcaggctatacaggaagcatgatgctggggaggtctcaggcaacttacaatcatggcagaaggcaaacggggagccagcacttcacatgactggagcaggaggaagagaattgggaggtgccacatatttttaaacaatcagatctcacgagaactcactactgtgaccacagcatcaaggggtgatggttttaaccatgagaaaccgcccccatgatccaatcacctcccaccaggccccatctccaacattggggattacagttcaccatgagatttgggcaggtaacacaaatctaaaccatatcaccattcaagtttttaatcttcataaatgccaaggttttaaaagactgccgggtagtcctaaattgctccactgagcagataagcaattactatgagtagcgtcattttaaatacatgcaaaactattggtatagtgacaataaagcattaactaagattaccataactggagatttaggaaaatttcatctgagttgcattgttctcttttcacaatgtataaattgcttaaattgggtgatagtttagtttaactttattactaagcattaacctcaaggattgaagctcagattgtggaatttcacctgctatccagtgagcagagagggtattctttggacatagggaccttttaagtagccttaaaactatagtaatcagggtgatgcatttcctcaaaggcttgcccagtttatgtcatccaagcatgccactctctacacagcacacttaaaactttttagaacagaaattgccgatgtgttttagctcacttgccagtgcttgttgattgtcagtaattacatgaatctctcttgaaaacagttctgggagcggggagggatagcatttggagatatacctaatgttaaatgacgagttactgggtgcagcacaccaacatggcacatgtatacatatgtaactaacctgcacgttgtgcacgtgtaccctaaaacttaaagtataatttaaaaaaaaagaaaacagttctgacaccaagttataaattagcagatgagaatgtgtgattgattaacagtgtatgaaggaaagggaccatcagcatttatttgtgttaagtttttttatcctaatcctaaacttcaaattctttaagggcacaaactatgtcttactcattttggtatcatgagtgcctagcttggaccactgtgtatgtagctcttaataaatgtttgttaaaattaactaattcatattcttaaattcttttgtactatatagagatagagagattttaattgtaataatctttcgtgagtttttcttctttatttgaaaaaggatccagacacagagatgaagaatgacttgtaccatcttctgagaacaaatggactgaaagcttgtgactagaatccactacttttcaacctcttactcctagagcccatccttttggccaagggcttttagattgctgtgaaggagagtgtttatatactaacaatttcttttaaattctttcccaaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttgagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaattttgtaaagtttctagaattttatatcattggatgatatgttgatcagccttatgtggaagaactgtgataaaaagaggagctttttagtttttcagcttatttactttgttttttttcctgtttctgatatagtaactaattcttaactcagagacattggtccattttaatactgaaaaccaattttcattggtacacattacaaaattgctaagaacactgtttgggagctttcattctcatattttggacattgttttaattgagtgaaataatcataactccttgctcccagagaagctatcacctccatttctaaaaccatttcaggtttgtttggtagtctttcttaatgtatttattatcgctttttgtgagtagggtcctgttttatccaggaaccaatttctgccctagcctatcatgccctgcttttgagagtaccaggtatctttgggattgggaagctggctgtttcagaagtatatgtctcatagtgtgcagaacttggtgaccaagtgagaagcgggaccaatgggagactcacaatggactgagtcttgggattatcttttccaaattcttccatgttagaatcacttcagaaaataagactttgatgctttgtctctgagcatcatttttctcctcataaaaacacttccttattgtatgtagcctgcctcctacagaggcctggtaggtgttactgcattctaaaagaaaaatgtcatctctgtaggagcgactatcaggcctagtgtgaaatattagggatcctaggcagaagagctattagtcctggccttcatatcttcaccaaatgaaaatactgtatataaaatttcaccaccaaacttaactaaattctttttctcaagtcaagcctcccaaagaaaaaagaaattaacttcctacagtgtcagcaagcaattttccatttagttttggtacaaataaaagtcatttgaaacaatctccaactgagcggaggtaattttgattatgagttattttgcaactcgcatctcacatgtcattggaacatcagtaactgtggatctgatttgtgcccttatagaagatccaaaggtaaattaagttagtctcttttccttctaaattgaccgagttccaggggtgaaaggaccaaagaacagagatacgaaggaaataaattaaggagtatttcccaaagggagtcttcaactgaagagttaatttttgacattttatcatttggttctagaatttctccctaattctttatatttctctactgagatttttttattcactacatgcatgttttcattgaacataactatgtagtgaataaaactatgaaccttgaacataacagatgaacataactatgaacataactgaacaaaacattgaacataactatatagtgaataaaaaaattatttgttctcagtagagaacacataaataaaaaaattatgtgttctcagtagagaacacataactatgttcaatgagtttaaattatgctttaaaattcttttctggtaaatttgacatctggataatcttagaattggtctccattgttcctctttacagaatggtcagattttggggggaggtccctcatatattgagtgatttagattgtgtcctgaacattgtaatgtttatgttgtagattctgttatattgctctgaaaagtgctgtgatatatacatatacacacataaatatacatatacacaaaaatatatatatacaacatttgtgtattacatttgtgtgtatatatagacacacaaatatatatatacaaatatatacacacacaaatatatatatattgtgtatgtgtgtgtgtatatatatatattgcttgtgttagcaggcatttaactttattggactcaaactgtaaactctcttgggcagcagctgaaaatctcaattcagttagctggagtctatgctgcacatagttcagggcttagccagagagatggatagaatttatgcacagaatttgtggtgctttttctttggctctctttcttctgagatttcccccctcattttccagcagctgtggttgctctgattcttagaccagaaaaactgcagttttctttcagcccaaaagctgtacaatgggaaactcaccttgtgccattcccttctttaaaatttcaatctcttttcagaacttgcctgtttttattgtctcctaccctcatgtattttttgtatttttttgagagtttatggttgttattcgttggaatattggttcagtgggtgcttactccaccattaacttaaaatgaaaaaacagcaggggagaggacaggtttagtcttgtgaaacccctgttgagactttggcctcaatagccaagtagccagtagccttacgtaagaagatgaagaagtaaccaaactgttaaacctgctcttgtgaagggctaatgaatactgttgaccacatctttctaaatcgcctttgtaatcatcacgtacatgatggtgattcattcaatacatgttgccgtgttgagaaggctgacatttttcttaccactattgtaatttctccataaagccctggtacttaaaaaatcctgcatgattttgaattgagtggccagtgctaggttaggatttgggtcttttccttgttgaaagacctatttctgagagacttgcctggaattaaattattatcgtgggctcattgaatgtgggtaacaaaatcctgcttattaatgacaaagcaattacgaaagatctcaccaaggctttcctagttcttccactcaagtctgatttagtgctcagctgggcgcttaacgaattcatgcctgttgtgaaagccctaatccaggatttcattgtacctaaatgagtaagagactagttccttttctgttcaagctttaggtttttgttgttgttgttatatagaggcaatcctgtttactgggttccctctttgtaaagttgagaagatgaacagccccagcttctaagggagttgagagttaaaagagaaaaaaaagcacattttaaaagctacctcatacaatgattattgtcattattatttggttctgagaggatacagtcactgtatattcggtgagcaggaaaagtgttggggtctaaacggtgcatctagaagagtctcttctgcctcagtgagagcaaatctctcaggggaaaaagacaagtctcctttggccatagccaattgcccgatacttcatttatgctctcaggagactgtgcattaggttccatagacctgcacagaatagacatgtggcttgaggattggtgaaattgacaacttggctacaataccctaatttatgtcagatacagactgtatggaatttttaaagtgtgctgctcagaaaggagcacaaaaaatttgcctctatacttactggttcctagcaccagtctctctcatggacacatggaagagctgttccaggatcacaggccttggaaagtttgggctttgagttcctggctagtcttacctccctattaatttgcataagaatttctggcccagtaaggagatagaacatagtgagtgcagggacagaagacctagttttcagttttgtttttcctcctcatagtgcctacaagcacgtaatatccctgtatttcgggttctttagggaaaaagcaacagttctcattgaagatcactgactgaaattcagaatatctggcttctgattttgatattgtcattaaatggggacaggccaaacggttttctcagaactttgttttcttcataagtgaaatgaattggttggatttattcagggtttgcaaatttggttgactggttcagtttcacatgtctcaaggaagtagcttctactcagcctcagctgattgttgttctaaggacataatgtggacagatatttctgtttttccagacaagcaaaatgtggatctttctgtgcaagatcttcagattttgaagtatcagcaactaattaaaaaatatgtaaaacactaaggagtccaaataaatatctgtggctcctttgggcccatggcccattagtttataacctctggactagattgggaaagctcttttctaacttcaagattatatctctagctaaaagtagatctaccattcgatccagcaatcccactactgggtatctgcccaaaggaaaagaagtcattatatgaaaaacacacttgtacacgtacgtttatagcagttcacaattgcaaagatgtggaaccaacttaagtgcccatcgactaatgagtggataaagaaattgtggtatgtatacaccatggaatattacttagccattaaaaagaacaaaataatgtcttttgcagcaacttggatggagctggaggccattattctaagtgaagtaacacaggagtggaaaaccaaaaacgatatagtctcacttaatagtgggagctaagttattcccctacattgaaagttattcccctacggggaataactttcatctcctgattcttcaagttgtcgattagtacggaagggcatacagagtgatataatggactttagagactcagaaagaggagggtgggaggggagttgggataaaaaactgcatattaggtacaatgtacactactttggtgatgaatccactaaaatctcagaattcaccactatataattcatccatgtaacaataaaccactggaccctaaaagctattgagataaaaattaaagcaaattgatatgtgcggtaaatataaattatgcatcaggttggttagtataaaagtataaagaaaaaatgtaaagtatattttgggtacattgggttaaataacattattaaaattacccattaaaattttttttaaataaaactaagattatatctctggaaaggattggtaagagggtaacagctgcataatgctttcaagttcagatgctgcacgtgtcccaattcctcagaaatacctgcttagctggctgtcatcctgggctcagaatagcccattcgtagcatattcatagcatattcatgacaatatgctatgaagctcgtaggctgggcccctcagacttggccttgaagacctcaagtatgtaacaagggttagataacttctaagttctcttccagccctaaatttctaagaaggtcatggtagagcctgagattgtaacaaggtcatatgtggtaccagggtgcacctgcctgggttaggaacctgggtggctggatctggttgcaagaggaacaagggtcattttgttagagcagctgactatgtctttgcctagacctctgttaaaatagagtaacttaattcctgacttaattaacaggctgttcaaactcacctgtttatatttagaaactccttttgttgttgttttctttcccaccttttgtttcctggtaaagtttcattcatagaatcacagctttgtttcagctaaactaagagaatagggatttgtgggcataaaagcccagagaaatgaggtgtcagtgtctccttggaggccaaagagtggagatgataacccactctggctcaggtcggacttcccataccgttcaggaaatcaaaagaagtgtgaatgagtacccaccatgatgagtcccatctagtctatttcattattttttaagtgatattcaaaaacactggaatttgttcgcaaacatactgcacaattgattgccacatagtggcaggtcacaccaccaagaatgagaacatcttacaggtaaagtttaaagaacaaggggtttgaaatcggctctaatttcaagttctggcttcacaccttttgagcatcaacaggttctaacaagttatgctctttccagaaactcctgttggtaattcagatgaccagaattctctaagtcagtcattgggaagctgtgcccactgcttgtttttgtaagttttattgaaacataaccacacccattcacttatatattgactgtggccactttgggggctacaacagcacacttgagtagttaccacaaagcctaaatgtatggcctacaaagcctaaaatatttactatctggccttttgcaaaagatgtttagtgacccctgctataagtagtcctgtcttttagattcaaattgataatccaaaaaggcccaacgtcacaaaacactgacagtcatcagagaaaaatttgatagtggtggtagtatattagggcctctgctaatctgtatggtgcgtttgtgaaaattggataaagatgctcctaagacagttgttgtaatctattgatttttaacaaaatcaataaaacttactgccatccaccagaaaattgctcaataaatatacaaaccatcaacatctacaatatgaattgcactccctgtgcaaccacatgtaggagtttcactactgtagtgtgatctggtaaaaagaacactaatttttttagacttaagttctgcttccggctctgaaactgacctgctgataccttgagcaaactacataatgtgcctaggcctcagtttttcttacctttaaaatggaggtagcttctagttgttgttttgggaaataacaggcataaaattgctttgtaaagtctatcagctctgcaaaagaaatctccaatcatgttttggaaaatttctgtagttctggaactataataggtcctgaagagaatgaaatcagtttaaggagcttacagtctaactagaaagttgtgcacatatgaactgcactagaaagttagaatctaacataaaaagttacacacattttaactaattggagcactagtcatactgcttcgcacttactgacctactttgtgtcatacctactaagcaattaacaggtgctatctcatgtataatcttcacaccaaccctatcaggtagatattatccccatcttacagatatggaaaaaataatagctggcatttattcatttactatgttccagacactattctaaagttatttacatattttaattcatttcatcttcacaataccctatgagatatgtactattattctcatttttcagatgaggaaatttgttcacagaatttaaataagtgctttcccaacttttttacatagaaaattctatttatttggcattctgggataaatgaggggatttgggaaatagagctcagtgaaaaattcagtacacctctattgataatttgagacgatttagtagagcatcaggaaaggtgtatgtgatgtggtcacctcaggttgctctctgccaatgggtactaagtgtaaagtatacaaaataacagtatattcaagcctcagggagtcacacaaatagtgtttcaatgtaatctcaaccagtgtaatgttgaagagttatgacaattgctttaaatattgtatcattataaaaaatttacaaccaactgcattttatggtacaccttcaacctatttgttattgggaagctatgggttaaattacaaggcaaattcaggactatgtgtctctgaagtctgttcttccagcctgtaaacagtcttgcccttctgcagtgaaaagccaaactgcatgacccagactccatttatccttacagtactgattctttgaagtttgatcatccagactcactttaagggtaacttttttgttaaccatggtctttaatcttgtccccttaccccattctcaatcagttttgaatctagcatctcatacttctttctactcactctctacccatatccacaacaggaaataggtgggcaggtgggccaagtgaaaattctttgaattgatagcagactgcccctgggctctggagtcgtctgcttggtcacactctccctgtggacttctgcttatctgcatccactggaaggtgagccctgaaagagtgtctattcccagctcagccagttgtgtttacacagagacactaaattatagtaagtggctacttaagctatcattttcccagcccctaagtgcaggaggaaatccatgtgtgattctatgcaccttctgtgcttaacaagatacatctcagagcagaaacagtttccctgtctgtgcttcagagaacccactgtctcatgcaggttaatattctgtggctgaatttgacactggaattattgatgtacatgagagcacagtgttctaatatgaagtctggtattgcttgtgttttacccaattatggcttgtctaattccaagcccacttgcatctgaatttcactccaggcttctgcagggtagagaatgctgaaggaagtagaaggaatacacagatggtatttttttcattgctttgtctggctagctgaatggctggtgtgccggtggtgatatgtggcaggacatctggggcaaggttagtgacccattaaggtgtcctgagctctgattagagagaacttggagccagcagagctgtcaacaatcagtttctttttgattaagatgctgcctcttaaccccctggaggccattttacccaccttcaggaaaagatagaattaaagccttaggtcatcgcttagtagaagccccaggagctgactagaccagaaagggcctctcagcctctctcagcagctgttccattatcaggttcctctactgacaggtaagctcatcctctgtcatacagagctcctaagctaaaatggctctcccaggagccgctactcaaagaagagtgaagatacttaagaaagctcattagtgaattagggaggtcaggaaaaatacgtttatttattagtatggccattttggctgttgcaaggattgtgtgtgtgtgtgtgtgtgtgtgtgtgtgtgtgtgtgtgtaagaaaagagttctcttttgtcgttgagattcagtctgatgtatctcagtaagctttagtctgtgagctcctcagctgcatctccttaaagacaaaaagcataccttattgtattcctagggcatgcacagtgactggcacatagtaagtggttgagaatgtactgtgctgaaataattacagatttaaagatgcagtgtctcagatttgcttcaaagtaatagagtgggaggaggaattgagtgtaagtatagatgaaacaagatggattatgagatgacaactttttaatctgagtgatatgttgtagggatttgttactattttttctagtttcgcgtttgttcaatgttttccacaataaaaagttttttttattaatatctgtattaagtataacaaaatgttgaaggatatggcaaagactggcctagtgctctccaaacagtctcatctttttgctaagcacatagctgggttgcattttgtagtcaggccacgtaattaaagttctggccaatagaatgtggacagaactgatgtaagcctcttccaagtgtgaccattattctgaatgatcctctaagcattctctcttcacttgcctccggtctggatgtaggaaatcagtgaaaagcttcaagctcctaggcaatgaaagagcctagatgcctgaatgatttcatggagcagaaccatcactctcttctactgatgaatctataatagactataaggtgactgaaataagcctttgttgttgttgttgttgtcgtaagtacagtattgaattgcccataatcttgcaaaccaggttttcagcctacatatttcagacatgggaggagactctcagtagttatttgacgttttagagaatccagagctataattaaatacctctgaagatgatgataataacaaaactagcatcttttgaatagccactatatgtcaggcactgttttaagtgctttctatgtattaactaatttcactctcacaacaaccctatgagggagaaactagtattgttctaattttatagaggaagaaactgggagactaaataacttgcctaagtcaaacaaattgtaagcggcaaagtccagattcagatccaggaagtttgcctcccaagctctgcctccaccagcccacaatacttcctcagtattttggactttgccataggagttgagtcctggcataaagcaat

SEQ ID NO: 1865 - DNA, 3974 bp, Homo sapiens
ggccgccgactgagctggcacgggccggtccattcccggcgctgtagggagcacagcattctctggaggcgagtctcctcccgggatccaggatccgctcgcgccccgctcagcctccggccttcaggcggtagagggcggcctacgcctgtgtgcgagccggagccggcgtgcgcagccgctgccctgctggaactgtgccgtcccgctgtggcccgcggctctgctaggcggtggatgctgctgctacgctctccaccggcgcagcgaggaagggggcggggagaatccctggcacatgccagggtcgccgtaggtggcagcggccggcgcatgcgcgccctctcccagaagccaggaacgccgaggggcgcgctcccccattcgcgcgcgcacgccggcgctggccgaggcttccccgcctgcgctcgttgtcagagccgctccggcgcgtgcgcgcgttatctccggccgacccgagcagccggttccctcctctccaggccccctccccatcccacccccgccgcctggccccagccgacccgtcccttcgtctccccgcggaatggggccggcactgctcagggtcgcgcgccctggacccagctcgctctcggtctcgcgctgtcagcgactgcccggctcgcgccgcctcgcgctctgcctcagtcagtggcgccgaaggctccgttaagcggcggcggcggttcctgtttccgtttcttcctctccgttcggtcgggagtagcatcctccactcagccacccttcccactcccccatcgtggggcagctgcggctgagggctgtggctttggcagctgcgacggggagcggcggagaccgcctctgctcccgcctggggtaagggggcgttttgggagccgggccccgcgcgcctcggggtcttgggctgggctgcgcgcgggatctgaggaggctccgcggctgtccctgctcgttcacccgggcctgttgctgcaactgctgccggttaaccagcggctctcggaaaagtggggagggagcccccgggacgctctggcggatgccttggcgcagccccgggggcgcgggcagagggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacagcagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttgagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaattttgtaaagtttctagaattttatatcattggatgatatgttgatcagccttatgtggaagaactgtgataaaaagaggagctttttagtttttcagcttat

SEQ ID NO: 1866 - protein, 575 aa, Homo sapiens
MRPWTGSWRWIMLILFAWGTLLFYIGGHLVRDNDHPDHSSRELSKILAKLERLKQQNEDLRRMAESLRIPEGPIDQGPAIGRVRVLEEQLVKAKEQIENYKKQTRNGLGKDHEILRRRIENGAKELWFFLQSELKKLKNLEGNELQRHADEFLLDLGHHERSIMTDLYYLSQTDGAGDWREKEAKDLTELVQRRITYLQNPKDCSKAKKLVCNINKGCGYGCQLHHVVYCFMIAYGTQRTLILESQNWRYATGGWETVFRPVSETCTDRSGISTGHWSGEVKDKNVQVVELPIVDSLHPRPPYLPLAVPEDLADRLVRVHGDPAVWWVSQFVKYLIRPQPWLEKEIEEATKKLGFKHPVIGVHVRRTDKVGTEAAFHPIEEYMVHVEEHFQLLARRMQVDKKRVYLATDDPSLLKEAKTKYPNYEFISDNSISWSAGLHNRYTENSLRGVILDIHFLSQADFLVCTFSSQVCRVAYEIMQTLHPDASANFHSLDDIYYFGGQNAHNQIAIYAHQPRTADEIPMEPGDIIGVAGNHWDGYSKGVNRKLGRTGLYPSYKVREKIETVKYPTYPEAEK

SEQ ID NO: 1867 - DNA, 71132 bp, Mus musculus
  misc_feature (1)...(71132): n = A,T,C or G
cggttctgtttctgcttctctaccatgaagccctgctaggcaactgtggtctgaaggatcttccctagtttgagttcttagcacttatccattcaacaaatatttagagagtgactttttggaatgtttggtgagtgactcttcatgaggctctaagcacttgctggagcattaaatatttaaattgagcagggcattcttttttttttttcttttactcttagggagccaggactattctcatctgctcctccagggagaagaggtgtgtggaaatggccacgcgtgagtaggggagaaaaatgacaattcaaaaagctgcaatccatcaataattgtacgacttgaagacccagttaacatcctcctttccagttttcatctttgtaaaaccattctctgtgcttgagtgctttgcctgtgtgcgcgccatgtgcattcctagtgcccatagagaccagtcaagtatgtcatttcccctgaagttacaggaggtgccatagtgggggatgggaacggaatctgggtcctctggagaagtcaatgctctcaaccaccaagccatctatctctacagcccctccagggtgtgtgtgtgtgtgttatctactttgtaagactcctttctcacacacatgaaaattttattaaataaaatatttgtttaaacactattttccctttcccatcctcttgtaggcagagtggcttctatcaagagaatctatccagactcacgcatgtatttcccagtttactgaccctcccaggaattgaacatgttagaccctcctataaacttgactgcgttaggggatttacttccggatctccgtccccaggactgtctggatgctccttgaacagtaccatctcatccctttcccaagaccttaaatgtgcacagtgtctccctttacaatgtagtcacagccccttgcaaatcactggatgtccaaaactaaaacacaggaggcttttccctccacggtcttcacttcaaggataaacagatggcacctgcccaaggtcatgtagctgcctcgctattttttcaaattgctccagtttgcctaatattaaacttcaaattaaaatgaaacaaaaatggtctggtggggcacattggcacacgcctgtaatcccaagacttgggcagttgaggcagcgagataatgagaggccagtatggcctacccagtaagatcttgcttcaaaaccacaaatgagcaaataaacaatgaagtactgactcttgttacacaaatcacatcaatgcctgtcttggaaatacagtttggtagttaccatggctgaaatatggaagccattgctatgacaggcttaaaaacatgtaaaagaggttaaggtccttgggggtggtggcggcaggtaacaaaaagacatagcataggtcagcccttgcccaagaatggcaggcagcacccgcctttactcctttagtctttggaaactgggtatccagtcaccagggtcctagatatagccagtttcacaaggcaagcgcaaactagctggttccgcatgacttcccgagcctgcggaagccccactaggagacctcccctttcggaattctaataacaatggccaggaacttcttcttacaaagatgaacacagtcttcattaaggccagcagagcaatcgaaagagttcttccatcgctagccataaggttccggggtgtgagtgtgtgcgtagcggcgacagtggacgtaagctggtccccgtggccaaataggggaacagcagatccatctgaaccgggaattggcgcagcccgtaggaccaaacggcgcggacaaaagacagagggctccgcagcccgctcggactgtccgaacgcacgctgggtctcaccttcgggagccacccaatgaggtctcagccaccctcaggagacggacagccgcggcgggccaatgggaggatgggttggctgtggaggcgggcccatcctggaggccccgcccccgggtccgcagggctggggcggagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccgccccccccgccccttgtgcccctccagatctggaagggttttggagagcaggtggttactgtcaccagtaaccttagttccctaatcaaggacccggcggaccttttctgtttcttgtctccgcctcttaaaggtatttgtctagagaggagtggaggtgcctcccgcctgcctgggcaggttcacaagtcccggaagcgtgtgtgaactcaggagtcaggtgcctttgaaatctcgtgttggtttcttgggttctcgtactgtatttcaaagttgtaccctgaggaatcttgccgaatattatgttaggaaaggtgtgtacaaggggagggggcaaagttatgagtggagaaataattagagggagaaagtatgtctgtccctcgtgggagttcaggatcagcaggtacagtggctaagtccttgtcccatacagccatactgttcacacaacacattttttttttccaccctagatccttgcctatatttggcattggccaaatctcaggggccaggaccagggttccctcccagggcctttctccctgtgtcctggttttcaccaatttcccaggaaccgttccatgttcctagcaaaacccacccactctctctctctctctctctctctctctctttctttctttcttcctttctttctctttctttctttcgagttaaattgccattgtaatttcttaatcacttgtatattcttgattggtttagaagatggcagtctctctaagtgcagtttatagcgtttaagaatttccataattccagttagaaggcattcttacatatatggtagcagtttgttccttgtcttatgtacttgatttaaaaaagagaagccattacaaagggctaactttgagtgtttagttttaaattttcatctatgatagttatctgttacttatttttacatgaacaattattttaatgaataattacattactttaagatgattttgaaatagaatggcagcttcttgttttcttcttttccctttggccttttgactgtcaagcgattcaggtctttagttttccttagacatatcccctttcattcagtttcttgtttatacattttgatgtttataatgcccaaaaatggcaggcaagttgttttagattgcttttgagtgctacagatttttggcaatgctggtaagacagagaccaatgaaggggcccaacatggtgtttggaattagtgctggagatgagcttgaccatatgttgaaagacatgaataatctgatatattaggaaacacagtgtgttggtttgtttagttttggttttctgagacagagtttctctgcctagtactggctgtcctggaactcgctctgtagaccatgctggcctcaaactcagagatgtacctccttctctgccttctgagcgctgggattaaaggcgtgcaccactacctggctacagcatcctccagctgagagtgggtggagttcagtgatgctgttttagggacagctaacatgagaatgtacaagttacgtgacgttcatgaacaacagcctgtgtggtttcctcagcgtcttgtgctcctggctgtcacagcagtcaggagccaacatgacttaggttaaaagaacctttccacggagtgccagacatgtcaacagtgtgcttcattcagagatgaatccctgtaatgtggccaggacttacctgtcatatgtcagtgcatagggtggattcctgaatctggatcccagatgggaggaccttgtgcttgtggaaggaattcacttgaggagcttggcgtggaaagctctggtgagggttctaccttcagcttacttgtgactggcctgcttgagagctcatgaagctccagtccaaagctctttcctcagtagttgctgagtggtggctactaagtatcaaggatggaaggagtaaagggaggctaggagtgaggctagtcaaggaaccataacatcacagtggtgctttgagaaggcaggagtgtctcacctgcttgctcttcccaccagttgagtttgtgtcactcagaaaacaaagatgattgacaagcttgtcccccgggatcaggagtagaaaagcctgatgacaggaacacgtccccagagctgcccttttgaacttcccctctggggcttacagcctgtggtaggttcagaactgtgaatggaatacctaagtctagtcaagcagggagagtcaggcttggttttatggtattgttttcacgtgaaacttttgcttcaagctttattcagaatagaaggggaaattaatctttggtcaaagaaaaaaatattctcatgatacctaagctattttacattctacttttaacccccacctggtgtaggtaccaggggttggctgtccatggatgacaaatctatataacctgggtgccctctcatctctcaaactttgtaatacaaggtgaaaaatataaagtcctagttagtcacccatggagatacataactcttaacatgtttcatctactctagtgttagtctatttgcaacacagaattaaggccacttaatttacatttgtttttcctgaattccctacaaatgtaaggatgtatttttagatatgtctaaggcttgtgtgtttatgtgtttgtgcatatatatatgtatatatatatatatatgaatggtgtgtgtacatgtgtttgtgcatattcatatatatatatgaatggtatgttcatatattatgcttttatatatatattatatggtatgtgtacatatgtttgttcatattcatatatatgaatggtatatgtacatgtgtttgtgctttttcatatatatgaatggtgtgtgtgtacatgtgcttgtaatatccatatatagatgaatggtatgtgtgtatgtgttgtacttattcacatatatatgcatggtgtgtgtatgtgtgtgtacattgtctgtacagatgcatgcgtgcatggaggatgctgggtgtcctctaatgatctctgccctgtcaccttgtgaaggtctcgcactgaatctggagattttcagcaaggccccagtgatcctcccatctctgttccctaccctagcactgaggttacaggtcttttggccatgtcagacttttcctgtgggtgctggggctctaaaatcaggtcctcaggcatgcacagcaagctctcttacccctgaaccatctccctagactaggtactttattaatctactttactttttgaaacaggaactcagtgcatcccaagctgccgttgaacttgtaatgctcctgcatctagctcctgagtgctgggcttacagctgagtatcacacgcctgggtctttatataacactttgaaatgaacaaagtaaatcattgccgtgcccccaagtcctcaggatggtcctggcatataactctatgccccaagcatacagtctgcaggaaataatgtcttcactccaacatgatattcctggaaatagcctaccacagaaacattttcagaaaatgtgctgcatgcaagttgacctgattcttgcttaaaaccaggtcttttttggagcagagaaggacaggagagctgcatgctttctgctttgcggctgaaggtctagtccctgtaagtccatccaaaggacttcttagcagggaaagaaaaagaaagttgttgctcccccttccaggttgttctgtctatggtaaagctgttttgccggccggcttagttatgtttcttaacttagcaggaaaaagctgagatcatagcttctacactgaaagtcaccactttcccttctgctccaagcctttgtctctggacagctgctgctgaaggagctgtccttttcagcaccgagaccagagtccttgcagagccttctataacctcaggcagttaggtaaacattggaaccctactgtgtgttgaccactatgcttcagagctgagaaacagaaagtgagtataagaaatattatagttaaataattcaaagacttagtcaaagaaatagagtgaccaaaacaattaattgaagaggcacggagcttttcatttgtgtaagggctggtagaaaacagtaaaaagaacattccttgcctccaaagaccaagtagacctgtatttttcaaaggggtttctaattcctctttactgtgggcatgtttcctcattcatgtggatgacatcaggcaaaagttagtaattagtcaggattcatttttaggactcagaaacattgaagctattttaagtaagaaatggattcagcacaggaaattgggtgcttacagacttgttggcttggagaagaggctcttatgaggagcgttctgggcaatgcagagctgagccaccaagaagttggcattgttctcacagaggaggcccagcttttggagccgctgttgaagatggcagcttcaggaacatcctgttttgtctgcaggctggagaataggctgcacagctacagagctggtgactggacagtgccatgccactgcagacagccatacttgccaggagaggcagccagaaaatagtttccatctctattttgcaaatctgtgtgtccttttgccataagggatcctgggatttgtggtttcgtagttctcaagcctctctggtactaaaaggtgaggtgctagaagggtgggtgctattggggtgggtgctgattgctgtcctacagcttctcccaggtccttggctttttaggaggctcctccccctccaagagacaataacacccccccaggccatctttatttcatgatatcagggactagagccaggactttgcaaatactaagcgcgtacctttcctgctgccctttgagctgcactgcatcctccagggcttacatagccttatgggactttgggagtcaagatggactctgcttcttgtgtacatgaagacagttcacctgaattttcctgagcgtttctttggtacagatcgacagtcccgttgtgaaatacaaacaaaggccagtcctggagaagattggaagtgctgtaatcaagcaagaacaaaaatgtgactcccatcaggggctaaatgaagagcagggtgtgatggggctggcccagaaggaagaacagccatccagtttgttcttgccaaaatctagaaatacatctttgttttcttaggtttgcttgcctgcttgcctgcctgtctgcctgcctgccttcctgcctgcctgcctgccttccttccttccttccttccttccttccttccttccattcttcctttccctgatagtgtgactctctcttccagaagtcctacccactccttttaaacagatctaaatttgtttatgccttactgaggtatattccttttgctggtcacccactaaatattaggcacagcgagcacagtggtggcggcagacagaatctccgttctgtggttgtcatggtgtcacaggtgataggcagtgaatgagtgatggatagcctctgtgagtcttggagttagctgctaaggcgtttgatgggagcttgccctcatttggtcttgaggttaggagaagtttctgtatggaattggctttaaatctaatcagtcaaaggggaacagagagcagggctttaggagagacacatgaatcagcactgtgctcttaacatcctgtctagcctgagagctagaatcactggtagccactgtcgtctctctgtgagtggtttttgcaaatgctgctgagagtataccagatacctcaggctcagattcttgctctcagcagcagagtgaaggctgaggtgactgtcagggcacctgaggcactgaggtacactggagtgagatgttccccacaagactcctttcctctacttctcgggaaccaggtcctggtagaaccaagttctgggagcctttcacattgactaagtaagttctttccatgttaggtacctctgaggcggtgcaggcctggatcactgtaagggcctccttagcggttctttcttttgagatggtgtctccttttagaccaggatgctctcaaacttgctttggaacttaggttgaccttgaacttatgattctcctgtctctgtctccttcctttggggggttgagttgcctttcacgggagtcacatgtcagatacgctgcgtatcagctagttgcattgcaattcatagcaacagcaaaattacagttatgaagtagcagtgaaaatagtcttatgattggcggttagtctgcattaaagggtcatagcattgggaaggccgagaatcactgctctggactttctttccattatatcctgtatggctgtcagagtaggtgtcctttctaaaccacacaactccccttctaaagggtacataaatggcctctcttgcttatagggtaactttaagcccttcagaattgctcacaagttattaccacctggtcacaagtctcatctcttatcccgtgcatgcagtccagcggctgtgggcttcctgatgtccttcaggtgtcatgtgccctgacgcccatgtcacttctcacaccgtctctctgcctagattgtccttcaccccatccctttcattgtcagataagattcccctctattcttctctagggcccttctcacatgtctgttctccacttatcgcccctccgccccccatcctgctgagggagttagtactgatccactgatcatatttctgtggacgctgtttgcacaccagactgtagctgctgtgtgtgcttcccctgggttgttgtttcttaccaccaagaacaaataaacctaagaaattttcaaaaaagattgtcctagtattccctagaattcaaatggggtagccttggtacaagattctaggataatccaattaggatctactttatagactcatggagtgtctgctacttgctaatcactaagaataatgcacatgaagttaaccacagtctctacttctgtggagtttactttagtagtggggagccagggaggtcccgtttacctaccatggcttgtctgcccatccgggggaagcatgctcagttttatggtgttcccagtagattgctgatatgctgctctgttttcttctttcagtgttagagattgattttgcggagctaaccctggaggagatcatcggcattgggggctttgggaaagtttatcgtgctttctgggcgggcgatgaggtggccgtgaaggcagctcgtcacgaccctgatgaggacatcagccagaccatagagaacgttcgccaagaggccaagctctttgccatgctgaagcacccgaacatcattgcgctcagaggggtgtgcctgaaggaacccaacctctgcttggtcatggagtttgctcgtggagggcctctgaacagagtattgtctgggaagaggattcccccggacatcctggtgaactgggccgtgcagatcgccagagggatgaactatctacatgatgaggcgatcgtacccatcatccaccgagaccttaagtccagcaacagtacgtatagcgagctgggctgggctgtgaagaacagccatagcccctggctgaggctttggtaggggtagtcatggattcccggtggagccttgcatcaatgcgtttgaccattgttgagtggcgacgtggggaaagaggaatgagacacttgagcggtcggggtaactgtgaactgcataagtgggcagagtcatcagtgtatgagtctgatagatttatttcctacgtgtgggaaatgtatgtgtaatcaccaaaagcagacaccccttttctggagcagtggagaaggtaggcctctcgttttacccccacacctcggctcactggagacagagcactgggagaagggctgtgtgcttaactgggaccccatggagagcatgacctgcctagtgctttagacctcctgttagctcagggctgctattaatgaattctataactagtgtgtaattgcagggaatggagaagtaactgtgtattaaatacatggaatccataaactgggctgtaaagtcggtgttaggtataattaaatggtgagttggtagagacttctcgccttacacgtgggcagaacagctagggatatacttcctggtgctctcgctggtccaaactaactgcagagaggacccaagtgattaaaggtgtgtgtttaagattattttgaggaccctgagagaagggtatttcaggtgaaggacgtgggtttgtgtgtgtgtgtgtgtgtgtgtgtgcgcgtgcgtgcgtgtgtgtgtgtgtgtgtgcgtgcgtgcgcgtgtgcgtgtgtgtgtgcgtgtgtgtgtgtgtgtgagtgtgtgcgtgcgtgcgtgcgtgcgtgcgtgtgtgtgtgtgtgtgcgtgtgtgacttacgccttggggctactctctgtatctgtctactttgagtccagaagttcttcagattttgactttcatctgagtggttcctaacatggcgtatttttctgtgggtgctgttgtgagtccactttccaaaatgcatttgtaattgtctatgtagactttttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctccctccttctcttctccttccttccttcctcccttcccctctctctctctctctctctctctctccccctccctctctctctctctctctctctttctttctttcttgagacagggtttctcttctctgtgtagccccgactgtcctaggacttgctttgtagcccagattgacctcaagatcagcctgcctctcccttcagtgtgctggcattaaaggtgtatgtaccactgctcagctgaggacaggtgtgtcatttgacctattctaccagacatttaagaagcatgtgtacgtgtgtgtgtgtatatatgtgtgtgtgtgtgtatatatatgtatatatatatagagatagatagatatagagagagagactttgcaattgctttaaaatggcctttatttcctttatccttttggtctgtactctcttcccccttaataatagaaaactttcttttctgagaatatgaacaattaggtatagatttcaatggtgagtatgaaagatttgatttatacgaggtaaaaatctcatttctccctctttgctgtgattttatgtttttatcatcccttctccaaaattttgttctttaaatgcatcaaccaaattgaaacttttgatgattgatttcggcccagaggttggttgctttgcgtggcgggataagaggcagcagatgcattgggagaaagtgtgatgtagagactgagttctctttaacttctcttacatccttaccattctgcgagagccaggcagggcacagtagtgctataaaatttgtcccatggagaaatctgggccaggatggtggaagtgtaaaagcttacaaattttttggtcaagtttaaactttgaccatgatctgaagctagacgtataaggttttaccttctacacagttactgttgtgaatacagcctcctgggaaggagaccttgccttgctaataagtcaggctgtttgcatgagagggcaggagactgcatgtctgctttccagaagccagggtactggttctgtctgtccttgaaagtggagagctctcagggtttctcttctctgtgtagtattttaaaggactttgtcaaggtataacgtggtatctccctgtcggtgctgatgtcggtataggctgaagatcttagacgtgagcaggaattgtgtgtgtgtggtgtttgcctgggattgtgatggcatcatgagccgatggcaacatcattgtcccccccaacccccaactgcagtcctttcagaaataggatgccaccatttggctcattgccgccatcttgggaattgtgaccgtttgttctgtagacatgggggcactcttctgttttcttttgctaagggttacagagggttgggtttttggtcatgctcacatgaggtcagaataccaaaaagtgtatgttagccgagtttgatctactcaagaacagactatggctgtctgtgtgggagccgtcacattgttaggaagtctcaggagaaggtggctgactaggatgttttgctctcttggtcacctgtttcagtcatttgccatcactggcagtgggatgtgtctggggtagagtattctttgctagtatgtagttggcattgggtgtaggttgggctctgaatgacagcaactgagagacaccctcacttgcctttgaaaagaagtctgaggattccagggcagctgcacagtgcgtgcagagctccaggctcctatttcttattggtaccattccagcacctggcttccatcctctctggctgctctggtccaagatagccatgaagggcatccattatttgatccagatacaggcccgaaggaggaggaaaggcggaagcacaaaaaatctgcctccctcagctgagtccatgcccagtagcttcccagaggcccttgttaaacccactttcttacgttaattggccagaatgtgctagctgaagaaggggcttggaaatagaaaggttgcccactaataatcaggctctgttagcacagatgagcataggttattgaagcagcatccagcagccttcactatggagatgttgtatcggaaacaccccttatcttagctgtttagtatcatgtcaaggaagttagccgggccctgagatgggagacagacatcttttcaagttaatgacttgtgcttctagtacttgtaaaaagccactggctataaccgtgggtctgtgtcactggggaagaccagctacttgttaccagaggtaccggagaatggtgatctgttaatggtgtcctgtcttttggggtaggtagatgggttcgaggattttgtgtggtaggtgatttggcatgaaggcattcagcaaaatcacagtcgactggttccataaaaagtaagctagagggtgtggctggtaaggtggtccagcaggtagtgacacctggtacaacacttgatgatctgagttcaagtcctgggacccacatggtgaagggagagaaatgactcccagagagacagacagatacacacacacacacacacacacacacacacacacacacacacacagagagagagagagagagagagagagatcgagagagagaggagagagaaacagagagacagacacagagatacaaatgaacacaggattggggctgtgtgcatggactttgagttgcaagagaagaagccagtcaaattacacaatgtaaacagggctgacagtatgaggagcttgataagtatttcaaagtccctacatacatacacacacagacacacacacacacacacacactcctgtgttcatgtgtgtttcatactgcttctcttagcgttcaaaagctcaggaagctgaagagttttcttacagcatgggaactcaacagctgtcttctccgtggcctcaccctggagtggacctgggctagacattagtcaaaatctctgcctgaatttgtgtaggactttctatggctgagagtttgctggctgatccactatacttgactccagcattttcctatatttctgataggtaacattcgtacctgtagatggagcaggtaaggctcaggcaccctggacaggttcagtgtggcctcacacttgcctgtaagaggatggggactaaatgcctggtgatggtggcacatgcctttaatcccagcacttggggggcagaagcaagtggatctctgagttcaaggccagcctagtttactagagagagttccaggacagccaaggctacacagagaaactgtgtcttgaaaaaaaacaatatcaaacaaagcagaattcctgtagctgagtaaataagaaaccacactctcttgggagtggctatggggtgcagcaaagtgtcgtgtgccgaggcctcgtcttcctggagaggtgggcaggtaccccttgtataggggatttgcctcaagaatgtatatatacatgcaggcaagatagcttagcatgtaaatgttcttgtgacccaagcctaacctgagttctaccatgtgaaggtaggaaaaaaaggagctgactctgtgcactttgtccatgcatagggggtatgcacacgtgtgtgcacatacatatacacatatggaatacatactaatacataataaatcttaaacaaagcaaaagagcacatccacactgaggtgcctcagtgccactgcgcacatgtgcctggggacctctctctgttcctctcattggggttcattgctacactgaacgccctttcaaggagtcagaaaataccagatttttatgattttactgggaaaaagtatacaaatagtaagaaaacttggacttgtcttttggtcacagggaattgtattgaagtttagctagtcgctaccaggcatattccagggtattgtgtttggttgatgggaggtactttctgcagccaaactaggtatgtaatcaaataaagccacgtgaagcgagtggcacgccaggtgaacatgactgtgcagaagaaagaagtgtggccagtggcccagtccttcctgactctctcctccacagagctgcctgcttccctgcttcccatccatccacccttctccctctctccctcctcttttgctttggtagctctggagactgaacccaggaccttgggtagtactttaccactgagcctcacctgtaggccccggctttcttcgggtgtcagggatatattagtaagctggaacacaggcttaggctctgccctcaaggagttccctgtgggggcagagagaaggaccttgattaaaccaaactcacacagaagtttaaagtcaaagctagtgggtgacaagaagggcggtgggtacaatgagaaagatgatccagacgcatgcctcaacaggggctttgtgggatttcctgggcaccttttcctcaggaaagtgatctgaggaggaaagagcagttgactagaaagtggggggtgggtgggtgtgagaaggttctggaaggagagacccccatacccatgagaggttgtagcttgggaagttgagtggtgccattggcaatccctttggattctttagtccttaactgtgaccaacagagctgaggccaatggggcctcagtggggacattgaactcttgggaccctcgccctctagaaccctgcttgttttccttttctggttcattcttcagaggcttctttgcaggtttcacagagagcagggagtagttttaggtgttgggcatcagttaggcactagtaaagcctgcactggaggtggggtggaaggtggccttgtgaggaggatggtggaagggatttctgggcatctattggagactctgatttcaggggacttttaaaactctttcccttgcctctctgtctttagatttaagccactactgccttgagtggtaaagatactatttccatcccatccctatattctttataagtagaacaagcagtaactaatagtgaccgccattttctaatgacctatgggcttgtcgtcgctcaaagtcaagattgattataaaaaaggagcctgcccctttctctcctttccttcacatttcctgggtaatttccaatccgtaacttggtgctccagtgtattctctctgtgatgtagttagttcactgttgcttgtggacacaaagccatgagatcatctgtctggtgcaatcagaaaaatagagcctcttccataggcccagggattacatggagcctccagtgggactctagaagtgattttcctgtagaactatactctgttcttcccactaagttaggattgttaacctaggaccgatttactttggaacctgtgtagttttaggccgagaaggtttaggttttattaatacaagtatcacagaaggtcacaagtgatcattattagagagaccttaaagttggcatctgttttagaggtggcctgggacagtggaggaaatgtgagtgctagtagcatccttgagctaacaggccaggtaagtgttgttgaatgcatcttgccatgtacctggagacctcaaactcctctgtaacctgagaggtttggccgagatagtgtctgaagtccttcccaggattagagtgaatgtcagtgttgtgggagcaggtagtgactatgtggcttaccagcattcacacagcagtctgcagtgtgcccaggtttgcccgtttcaggactccttagcagggtctgggtcccctttgctgaatagtttaatagataaacagttgacaggagcccccatctgctcctctgtccccattgctgctcaggctgtgacagatggccttgctgaggccgaagatgttctcgtcacatgaatcatggtgggatttacaacagaccaaggacagttgtcatcctaaaagcaggacgcagtgagttgactgccacttctgtccttggagcaaagcaagggccgtcggtagctcaggttagctttgctgtgacttacatttgcctcttgcactctgagtcaactctggccttccctgacccagctcaggatcatacacatgttttaatgtgtttttctgtatttttcatcaccataagttctggaggacctggggccctgtgcggggcactgtgggagtaacaggagttagatgtattataaactgatgtgtggcttccttccttttcttgccttcccaggttttactttctttgtgggagatggaggttcagatggaaagaccagtggcttgggagtccgatagatttggaattatcttgattaaattttttttttttttttttttttttttttttttttgtcagcttgacacaagtcagggctgtctgggaatttcaatttagaaaatgcctccaacagattggcccttaggcacatctgtgggcattttcttaattaatgactggtgttctaggtgccaggcctcggcaggcggtcccgggttatgtaggaaagcaggctgagtaagctgaatgtagaacaagccggtaagcgctgcttctccgtggtctcagcctcagcccctgccttcaggtccctgctttgagttcctgctcgatgttctcttgaggatggactgcagcatgaatgtgtagcaaacataagtactgatgcggtccaggaatcttacctctaaactgtgggcaatgtagaagacagtagcgatgtggaatatgatggctgaacccagcacgggcaccatgctcagtaaagtgtttttttcccccaagaagtaggagaaactcgcctccacctgtgctccttttaggctgacccagcctgtagttggacccaggacatagttttgcatcatataaccacaagaaggtttgttttctcagaagccgcaggaagtgctagttctcactgcctcctggtgatggtgcaaggtcctcttggggaagggcccatgattcttgtttcttctggactcagccttaacctgagttcttggtcactcaggtcttgtctgttaggacctttggtttatggagcgggatggctggccactttctggctctgctggaccctcatctgattattacattcactccaggacaaaggcagggtctttgctgctgtagtctactgctgaggtccaagagaaggcctattttcacatctggcactcccacctattttcacatctggcagtcccgtatagagcgggttctacagtctctgaagacttggaaatagccagggtggctgaagctctgttgctttcattatttttgtggtcttattctggaagggaagggtagtgtgtttggctgttttccttccatgtgtgtgacagctctgtgtcatacagtcctccccaagtctgtgtgtggcacagtatctacaggctcctccagtagtgttcgtagttgtgagcactgcagagtccagtcctgtgtgttttcccctgtgtgctccacacagggacattcttcaaatttgctgtttttcttagagccccgtcttacactgtgaacccccttttcctgtggagatgactcacatgagctgtagctgagtctgactttgtattccctctggctctgctagctgaggaccttgtacggaggacgtagcctgtgtggctttgtttttgcaaatgtggaatagggctaattataacatcacctgtgtgattgtactgggtggaggtgaggatgagctagggctgcctagtgagtttatggagtgcctgacacccagtgagctctgcctcgcctcccgtggaccatcaggcctgcccctcagctgtggcctctgcttcccagcagctggatctcacttcctgcaggtgcctttggaattctgtcttggtctttgactttcctgttctttggtgtgctctctccaagacagcacaaaaattgacaagcaaagaaatcagtcactatccctcctaaaccccaagtttacttctaagaaataaattggagtcaaattttccatctctttttgataaactttttttttttggtttttcgagacagggtttctctttatagccctggctgtcctggaactcactttgtagaccaggctggcctcgaactcagaaatctgcctacctctgcctcccgagtgctgggattaaaggcgtgagccaccatgcccggcctgataaactttttaaatgaaaatgtaagtaagaattttagtaggatttgtttttgttttttgttttttgtttttgtttttgttttttcgagacagggtttctctgtgtatccctggctgtcctggaactcactttgtagaccaggctggccttgaactcagaaatctgcctgcccctgcctcccgagtgctggaattaaaggcatgcgccaccacgcccggctaggatttgttttatcatctttgttattttcttcttttaagaatttctaaatccgaattcttgacaacaaatgcattcccccttccctagtattgtgtatattgtgtagcagctggcacacagctgtcctgctgtttagcatcatctatccagtgtccttaagaaatcttactcctacctctttccctagttcctttctagctttgtctgtctgtctgtctgtctgctgtctgtctgtctccctccctctctttctccccctttttctcccttcctttctcgccctccccctatagtctctgtagtcctggctagcctggaacttactatgtttcaggctagcccagtcacaggcatcccccagcctctgcctcctgagtgctgggattaaaggcttgccactgtgcctggcttgaacctttcataaacttttcgggagcctgggacgctgaggaatgtgtttcttggattgccttgtgtagtcataagccttagtgctcacctcttgtcttgcccacagggcaaggttgttcacacatcccttagggccttctgggtagcagggcacggtacctccaatgactaatcctgagaaccttcatctgtgagactttgtgatgtcttgcaagtgaacgtgccataacgcaatgaaacagccaaaaatgtccataggaatccagagggcagaccctactgtctgcatctttacatgaggttctcctgttcctgtgtgtatgtctcatctcctgtcaaatcataggacacttgctatctgaatattcagtttctggtttctgcatcctgttaattttaggaagaagaagaagaaaaggactatgggtaggggaaatagtgataattcttagttttcagtcattcttctgtttattgatatgagtagtttatagagcctgatggtggtgatcagaagatgagtgacttgccaaggtcattcaggtggcagttttcagtctcatggtgttactttagattttctaattaattgattaattaaatgtgtgtgtttgtgtgtgtgccttgcctgcacacgtagctgcctgcagaggtcagagaagttgttggagtaaccgatgtctgtgagccttggcgtgggtacgggaactatacctgagacctctgcaagagcaacaggtgcttttcccactgagcatccctccagccccgtcctttcagtcctgttgtgctgtctggggcacagctaggtccaaagtgttgctgctgacagtggaaagagggtccatgccccactgaaagtgtaaggcctcataaggccaaggtcggcttggggaatgaagtgtctgtgtccttggttgtgaacacaaagctcgttgctttctttactgagctctgtggaaggtcaaatgttcattgctcttgtgggcagtatgatgcttatgaagaaaggttttaattgttcaggcagtagactcctggctacctatacacagggacaggaatgcaggggcagaggagtaattgtctctcagctgttggctcagttgtataaagagctgcttcccctcttaagtgccatagacggcctgcgcttccaattacagttaataataaggccagtttgcctttccccctgcacagctgctggcgaaagggaaaagatacaacacattgagagggcggcagtggaactcctgctgcagaggcaggttttccccagagatgttcccttcagatagtgtgacattatttcgattctccttagcttaccaggcagacagacgatattaagcaggatagtctggagacgggggtgaagaataactatattttgtatttggttctttaggattttaccagaacagttaggtgtggtggcacatgcatgaaatctcagtacttaagaggtaaaggcaggagttcaagaccatcctcagcttcctagtgagttctaggtcagcctggactacatgagaccacatctcaaagcaacagtaacaataaaacctaaacaaacaaacaaacaaacaaaaaacattcttatttgaaacagtatcgacctgagatacttcacactaagacagctggtagtttcctcattttagatcagagaaaactgaggttcactggctttgaatactttgcctaagagcatacagcgagataatggcaaagcctgagtctggagctcttacctgcctggatagagttcctctatgctctggagcaaggcgtaataggaggctgtgtaggcgtagaacacacttctgacccagaatccagtgtgatgtagtttgacctgggccttaaaacctagtcttggggcctctgtggtgttgtttgttcttacattaggaactacaggagtgcccctctcctccccagagacttctgtcactttcagatcatggtcccaaaatacaaaccctcacatccccttctgcccaggccccttgcccctggcccctccaaaagcacaataatgaatctcagttttgattttgtttatatttcttctggaccaaagttgctcgtacaaatggctctccaaaagctaggctaacgtttctatgttatgtcacttctgtccttactctactgggctcttgttttcacttgagtttctgtggatttttatttttatttaaaccaagaaggtatagctaggtttcagataattgtttatggaattaaaaaaacaataaccggaaaagaaaatgtaaactctgagctgagtttggccacccttgttagagactggggtcattcagacgtctgcggtggggaggcagcctcctgggagcagtgtcttctcaggccagtgtggctgtgcttcagagaggagagccaatggagtgtgccctgcggtgcccactcacatgtttggtttaatgctgtgagagaaaactttgacttcagcattcattcctaatgcttccatttggactgttgctggtgagacagcaccctgctgtcagcagagacatcctcagctgacagccgaggctcatggggagaatcttggcctcgatgctctgcaacttttgaacttctgtggtggaaggaaaagactgggaacagagactagaatcctgtgaaattggcgtggcagaggctctgcgtgtgtaagtgtaagcatccatgtctgggctttgaacttagggcctctcaggtgctgtgtccatagccagccctggagacagtctttcaaggactttgagctggcagtggaggacactgagtggggtttaaagggagcatcggaagccatgtttctctggatgctgaggaaaaatgagagtcagacaaacttaatttaaaatgccttccctttcctcctgagtggacacagctctgccctggggttcttgcgtgtgagtttttagtttaggtgagactaggttatacgagccatgaatctgtccaactgtaggctccttacaagctttttggtgctgtatttggtgtgcagttggagaagaggctgactttcctgaagagtaaagttcagcctctgaagaataaagtttttcttgggggaagggggacagtcatccacttttattttccagctaattacatagctaattacatgtattcatcagcagtttcctaatgtattttatcccccacccatcactatgcagattcatatatttttttttaattttgtgccccactgattttaaccaggactgtgtgtgtggccatccactaggagctatgcctcactggtcggtacacagctgaaggcagtaaatgcccgtatcccagaatctgttcttagccagtcgttcatccttaaggggctaagctttttgagctcctcgtggacccacacctgcctgtcagtgagcccagtctggtgcagaccggatgacacaaccgcagctggtgtcagttcgtgattgcacatgttgtggcttacccagaagatagagtcttactgtccttctccatgtcttccgttctttagattctgtgtgccctctcttctgcagtgttccctagccttagaagggatggcatagctgtgctgcttaggcctgggcagtcagcactgcctgctgcgctccatctttgcagtcactgtaaatcttctggagagaagagttccctgattaaggctgagagcagcacttgtctgcgagcataaacaaatagctagagggcagctcttgttggtttgctttttactgggtttataaatccaagcttgggtttatagcccacagccaggccttaagtccagccagagagggattggttacactgagaacgcctgttgccagtgttgttgagttgtgtatgctttgctgtcagtttgctaccgtggtttgtaaggttcacagctggtccgactgctgataccttttctctctcagcaactgctgatagcttctgccaccatgacagccagcagggagaagcttccgtgtcttccagctggacttctttattcttaatctcaaggtgaatagtgtccgagggaatggagtctaactgtctagtctggtgggtaaccaagaagggtggcaggagcctctaagacttctttagccgtacctggaactgaaatttttgtttaattatcaatggcttctagatgcagcattattaatagagcctttcagggtatctatatgtgcctgtttgtgtatgtatcttttaaaattgggtcataagatactacattttactaaattaaataaaaattcatctgctgaagagaccctgatatagctgtctcgtatgaggctatgccagtgcctggcaaatacagaagtgaatgctcacagtcatctataggatggaacacagggccccaatggaggagctagagaaagcacccaaggagctgaagggaactgcaaccctataggtggaacaacaatatgaactaaccagtaccccggagttcttgactctagctgcatatgtatcagaagatggcctagtcagccatcattgggaagagaggccccttggtattacaaactttatatgccccagtacaggggaacgccagggccaagaagtgggagtgggtaggtaggggagcagggtgggggagaggttttgggggactttcgggatagcatttgaaatgtaaataaagaaaatatctaataaaaaaaatcatcattccctgctccctgttctcccttcagcttctctcacgctccacctcaaagtttttgccttatacatatgtgtacacacgtatgtatacgcccataaatatataaataaagccttctgagtctgtatagtgttgcttgcatgtgtatttcagggacagcttggtattggataaccaactgggggcttatcctggggaaaatccatattctctctctctccctcccccatttccctcttctccttccctccccctcccccttcctcctctcccttacacacacacacacacacacacacacacgcacacacacacacacacgcacacacactcgcgcacacgcggagcagtcactggttgcctgtagttcttttgtttggaatgggagcctgtgagatttctgctttccacattggcatgtccattggtggtgtccttgtttgggtcttgtttaggcagccatattacttagatattaaaggtacagcttccctgttatttctaggaggcatagtctcacagcagatttcttggtcctctggctcttaaaatcttcccctttttcctagacatcctgagctgtaggtgccagtgttgtgttgtgttgtagttgcatcactggggctgggcaccccatggtcagttagttgttctctctgctttgagcagttatggctttctgaagtgctttctctccatattactgtaaagaaaaccttcttgatgactgctgggagctttccttgcctgtgagcatgggatagatatgcagactgcagttacacatcgtgctgggttggtaaagtggtaacaggagtttctcctcaaagatccatgaccttactagccctgggtagtaaaccggatttctagtaccaggctaaaccggatttctagtatcaggcataacatatttcccttttgttgagtgggccttaagtccagttaacttctgttgcttgctgccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctccctccttcctttttttccttccttccttccttcctttgttatttttgtgaccttcatccatgattcatccccttaccaataagagaaatattttaagactcctctcttcacctgggagttcattatggacagggagtgaggcattagaacccttccttagcagtttgttaggcctagtgcattcccacaggagtaaaacacagaccgtccttcctctgccccggacactccacctaaagaatccatatggttctgagtttgcccaaccacacaagttggacattctggttacttatggtatgtctccaataaggaagcagattgctcctctggagctgagctaagccaaaacactcaatgcctcctgacctgcccacatccagggactgcctcttgagaaacagggcttgccatggagatgtcatggagattccacagcataatgtgaaggacagtgagtgagaaaagactgaaactggcctccttgctcttggacagagaagataaggagaattcataggaacacttactctgtatctcacatccttccacagccattaaagacacatagtggttcagaatggtacctcccaatgtttcgagcctttgggcctccttgcccccaaggtctgtggtatctgtggtatatggtgccgcttctgcggccttcagatcctttctcttctccatatcctgggtgttgtgcaggtgacagcctggagcgtttgcattgtgcatgagttatggttcttaaccagtttgattacctggcaagttttaatgaacatggggtgtgcttgctattgtgttgctgttgtaggaatttcagtgtgtcacctgtcttctgcatagcgtaggcattccttccatcccactcttttagtcctctggaggccgactgtgtaaacacactcagacaaccagaactatgtggcacagtacaaaacagtttgctaaagatatatggctttagagatggcagaaggagagttcagagcaaggccttgatgggacaagtaggtctttgcaaactatggggtaagatttaggaggtattggtaatagggtgggtaggtaacagggaaggggacttgccccatcagtggtagggctgtgttctttgatgttatgctgcaaaacaggaaattcccaaacaggaaatattgagcgagaacatattcttccacatagataagtcttttatgtagacaacttgtcttcgtgtagcccgtttcagtgctgtggggtctcaattaagtagtctggccttgagcaaagctctcgatctctgaactctttttttttttgttttttttttttttttgtttttctgtaatgaggacaaccctactattgtggctgtaagctattaacgtagtacctggcaccaagctaatgccgctttcctacactacagatcgtgtttctaagagcacccgcttctctagtggcagcagctagaactaaactttccagttgccatccactgttttcattcctgctgccagccagaatgagagcctttcattatgctggcgggaacttgggtcaggaatctgtaaaggctcaggaggatgtcttatccctacttcttggtggcctaggctttagccgcagagactcagagtgaggccacaggtagagaaactgtttcctgtcagtctggtgcctgggccaggaggctttgaaggctaggatcatggcgtggccctctcagggccctccaccttctgtggtagctcaaggctgccagcaaaagtactcagaacaaggtaggaactgcactgtcttttctgtacagaacttagaagctgtacagaaccatttcttcaaactccatagttatgaggagcctcaggcccaaggagagtccagcctgcagcagaaatgctgaaatcatcctgcagaaaagcacaggtggtggggggctcatgtgagcacgaaccatgcattcttctgtgctcaccaaggaagcagagcttagagttgctggggagtctgtgcagcagccacacaccgtgtcatcgtgccaggaaagaggaacgtgctgacaaaaccagcaagggtccagtttgcttcctctttcatagttattcttatcctgtttatagctgggtgtgccagggccgaagaatcaggctggccctgctcagtccgagctcagaaagtgggagaaggaagcagggcaggaaggtgtgtgagctgattcttcacccatccctgccctccattaagacagcggctgttggaagccctgcttctgtttcccactagtgatgcttgtatccagctgggctcagggctcaagccccagctgagttatctggacttaatttacacaaaatagcaatggctgtagatgtctaaactgacatcttttggaccagttatattttgggatgagagagggagaggagacgtgctgggagacttgagctgggagctggcactaccttttctgtttggatcacaagcagctttttctcagcaagggtgggagcgatgggaagggcttcagaggccagggagatgaaagtaaagtccccatgggaagctgggactggccaggccccttttcaaggctgatgaatttcgacctataaatacatcagttccctatcttgtctcctcttgagaggagaggggggagggagagcaagagaggagccaccaaccaagagaggcaacctggggccaagaggccaagagggctgcatagccaaaatggctggcttacacagggtcagtagggaatgagagatgggtcagtcttgtcttgaagcctagggtctgaagaactgatgggagaagattctggaagtcaagatggaggaggtcctggattgatgatgtatgtttgatccttagctgtgtgaggcttgcaggttgcacattctcattgtgtgagtgaccttctcgtggaagaagacggctttcagggtcctaggatcctctgcgttgttccatcttatgcttgcctttgtcagcatctcaggtttggcagccagtacaacactgatgttccgatggtttgcatgcatttgacagtagagcaggtcatgtagagtttgcaggatctggcataccactcacagccaacctcagacctctctaatggcttcaccgctggtgtgagagccttgtttgacctgcccaccagcactgttgttcttattcaagctaatgtcttgccttgaccctactgcttttagtgcatacttgtcctgaatagcgcctggatgactggagaaatgtctgccagcaagcgttcaccactgcacctggacagattgtccttatgagacttacaatgaacctaggtagaaaaggctgacaccaaaagtattctactagtttgcttttaggctaagatccctagagttccgatagaaggagatctgccctgaggagcagaatcagggtcagtaataacttcggtagtgtcttagtcagggtttctattcctgcacaaacatcatgaccaagaggcaagttggggaggaaagggtttattcggcttacacttccatgctgctgttcatcaccaaaggaagtcaggactggaactcaagcaggtcaggtagcaggagctgatgcagaggccatggagggatgttctttactggcttgcctcacctggcttgctcagcctgctctcttatagaacccaagactaccagcccagagatggccccacccacaaggggcctttcccccttgatcactaattgagaaaatgccttacagttggatctcatggaggcatttcctcaactgaagctcctttctctgtgataactccagctgtgtcaagttgacacaaaactagccagtacaggtagtttctctgatacttttcttcctttctaaatgcaggttttctttctttaccacatcaatgagaatcacctgtcacctggacagtgctatgcagaaagctatctgtaggggtggtgtgtccagcaggggtggtgtgtgtgtccagcaggggtggtgtgttctgtgggggtggtgtatgtatccagcaggggtggtgtgtctcacaggattggtgtgtgtgtccagtgtgggtactgtgtgtgtccagcaggggtatagtgtgtgcccagcagggttgcaagcaccagtttgtttagattcgaaacttcaggattagaggaggtttctgcccagttttatataatctgagactatcccatgccaagaggatggtcccagtgctgtacatagacagagggtattgtagagacataactgctcggtattgacctgtgtgggaggagcactgtagggtgctaggggagcacggcctgaggcgccagagtgacattccaggcctggctctcagatgtggaaaagatactttactttgagtcccagctttctcatgggtgaaatggtgatgctatgcagcttgcagggatgccaaaaagagtgatccagcactacgtacaggaagctgtgtagtgtccctgggatactgaaggtgtgcaagaaatagtagccactgcgattattatgtgacttaacacttgatggtaatataactacatgtagaaatgtgatgagttagacagtatggataaacatagagaaaacctgtcacctggactccattacacagagatctcgtgttagcatttagctatatgtctttcagatgcttttcctgtgacagaagacagacagacagaatagtcaaaatttaaattgaactttattttttgcataccactgttttataatgtagttataattagtattaaattgccgactatattgtgtgtgtgtgtctgtctgttttcatttgtatatgtggatgcacatgcttgtcgtggtgcacgtgtgtgtcagaggataacctcgggtgtcagtcttcgccttccacattatttgagatagagtctcttgtttttctactgtatgggccaggtgagatggctgtgagcttggggtcctcctggctctgcctcccatcttcccataggagccctggggttacacatgctcgggctctgtgtctccccttggcatgagttctccggattcagactcagaccctcttaatttcatggcaagtacattcacccacaagccacctccccagcccctactacatcttttggacatattttttattgttgctgtattggggttgaaattagggccttgtgcacagtaaacaagtgctgtatctatccccaataaaagaattttaagtagcacgtgatgatctaaattaaagaaacaaagcaggtcactgatgcttaggtatctgtttcacatcaatagcataattaattaaatgtaaagcttaatatcgcaaagtctctttaaggcaaaacagaactgtaggcaggcacagtggcatgcacctgtattctcagctgcttgggagtctgaggcaggaggatttcaagagctgaggagttaaaggctagctagtgttccctggttgacagtaaatagccttctccaaaaaggacgaaggagactgagcatatcaattcatgtctgtaatcccagtacttcagaggcaggaacagaaggatctggaggtcaaggccgtccttggctcatagtgtgagttagaggccagccaggggcacactgggttcctgtttaaaccaaaaccaaaaccaaaccacaccacacacacaaacagaaggaaagttagaaagaaccaaagcacatatgtggcttatacgagatagcgaaggtctctggctttctcctgctggttaaacatctttatgaattctagtttagtttccttttcaactcccagggcttagcatggtgcctgattcatttgtattttcagtatacagactttttcatgcaaaaaggtttataccaaaacttattatagattgtgacataatgctttaaaaatatacactgcagcatatgtttcaggttggttcacttcacggcagcacgggggggggggggggtggctcttgcacatctctgtactaagatcttgtgttccaggatgttgcttttgtttagacgtggagctttaatccacatacacagtggtttgaatgtgaaatgcctctcacaggctcgtgtgttagaacattcagtcttcagctggggtgcggatactggaccacagggctagggctagagacgtatatcctagtcctggttcctgcctactaggggtgggtaaacatcaagggccaaaggccctcagctgcataccagtgttagttaacaccgaatagttaactggctatctttggaccgactgcattatgctgtaagtcgccatacccttctggaactgtgtatcagtggatcctgttactctgcagggagagaggacactgagatgacagcagtgggtcatagatgttcaggcttttcctgtcattactcccggccttccagcataggctgccagaccactggtgcctcagtgcatttctgctttggtttcagtttggcttctttcactgacagtgctgactctaacccttcaacccttacttagagctcactctcatctgttagtgctgctaaagttggaggcctagggacacccgttgatgggaaaaggcctgagtagacaggtcactgcctcaggggctgtgatgcgctgctcaatggctgtatgtctgtagaaagcacggctagttctcctgtttttcacgtgtgcataggtgctggtgtattgatggattgtgaactctgcttacctgttctcttaggggctgggcatggtgtcacacatggttaatcccagcaatctggagacgaggcaagcagagctctatatgagttccaggccagcctgatctacagagtgagctccaagatgcccagggctacactgaaaaaccctgtctctaaaaaccaaaaccaaaaccaacaactacaaaagagtgccctattgcggctgcacactgtagcatggtaacctggagcctggactgaggacttggttatatctggcttctgcttttcctgtagaccagcctgtgtgaatcccaggctccatatttgaaagtcggcttagtgatacacctgcctttctgtttgttgagaggattaaagatgatgatgagtgtaaatcactcagtgcagaacctggcactgaggccccggaacccttagctgtgactgctttctctaagtcagtgtacactctaagttaagtagcatcataaagacatttttctaaattgtctagaaaggacatagtttatataaaaaattagaaaccactagtatagcttctcggggactagtggagggccctagaacaagtatttgcagctcagtgcctgaggagatttaaaagaaacatttcatgatcccttgattgtgtttgactcagtcaagacatgctttcatcaagtaccctgtggtccatgcaggagaggccattccacttcagctttgctccatctgagcccccgggaaattattgcatcaagtactcccggctttgtacttattatctgtttgcctgtccgttccaagaaggggccgatccttagtgcccaaagactccattttctccacccctccacaggtgaatgcttatggggaagcctagctttgctggctatgcaggtggaacttggtgagactctgctgacaggagctcagccagggcctcctgctgctatctccctgctttgttcaggcagcaccacacctctgctggagcctggagtcagggagtctaggcagtgaatcattgcccagtaagcaagtctggtctctcttggccatgcctaaagggttagagtgggcagagggccaggaccgggaggggctgggggatgtgtcctggctgtgccgtgtgcctggtagtgggccctgaccaggctctcttgttgctgagtcagtgccaacaggtccctccacgttagcagctgctctgtgggtacccatggcttctgggtgtggctggggctctagcttacccctcttcttcccttggagacattgtggtgcaggaatgaaatgtctcaaatgtcagcttgggtgccctaaaggctgcagaggtgagggcatgggcgttttgcttctctccggcatagagtcctcacccacgcccaccacacccgcacccccaactcatctttacccttgagtttgggttttacctttcttacctcaagacagttggcagagcttgcctgagtcctggaagactgatgaagctttcagggaattacagactttgagaatgtcaggtagagaaatggagttgtagagaggatatcacagggggcactaggacccacatcctggctcatgcctggtgctgttttcttttttctgccttgctaagactcagagattgttctcctgtgggtagaagaggcattgatgctgtggtgtgtcctcctccctccttctctttcgtcctgtccctccctatgcctccctgtccctccttcccccctctctccctccttctccctctctctccctccctcttcccttcttcctcttcctatggaagacatatgcccacatgaggagaatggcatcatggatcctcttctgcctcgtcaggtcccagcccacagctctccttcctctgtaactggatcattcccaccatttattttgaaggaaatcaccaacaccctatcactgtccgtgtaaatatttcagtgtgtttcagtatttaaaacttgagcagtgcacctctgaactcaagcatagctttgtgctgaatcacagcagatgagcctgactcagcaaagtaccctagagactataaagcacgggctgaaaaagcccttcaggaaaaaagaaagtggcagaaaagaaacaagaacagaagcagctgctgcccaggatcttgtacttcttacccccaaaacaaaggaaaagatgaggaggagcttttagaacttagaaaactatggcagggagtaaacaacctgcactgggtcagaagactcagccaggaagctcagcaaggaagaacaaagagtaggaaagagcaagtgaggaaagagaaggggctgcagccgctgtggagagggctcagagcctgcaggagcctgtcaggaggacggaaggccaagcttgatccccaggaactacgtggaaggagctggaacctttaacttgttcttgcatgctgtagcatgagtacatctacacacacgtgcacacaaatgcacacacatacacacacaaacacacacactgagcacatctacacacacacacacacacacacacacacagataaatacaaattttttttaagctggagaactagcccatgaagcccattataaagtaataggtcatagacctttgggctttggggcgtgaggcctgagtgtcgtatgtaggtgctaagagcagggtttgaaaagttgtggctcagtttcagggctgtaatgtgaagacttatttcctcttgatcctctgcagtgagcatcatgccatccttactgtggtaggctggggtggatcctctgacgtagagaacctgaataattatttttcttccttaggtggattctgtcaggtattatggccacaggatgcttaagtaactggtgcaggcatgcaggctgaatctccagattaccccttctgtagcccacagtccatattgcaccggtacatcaatcactggggaacccctggccgaggtctaaaatgaacattttaaaaatatagtcaggaaaatgcacaggtacacctcagtcaataactggccaggcacgagggagttcttgccaagagcctggcccctgtgcaaggttcctggaccaagatgtcatggattctagaagggaatgagggttttattctccaggggtcggattccgcatcattctagaaaagatgatagacactcatacaccccagcagggagtgcttagacgtacaagcggttggattgtgtgcagttgggtttagctgctgaagaagaactagcaatggggcagcagagagggagagctaattagctgtagcactgaggaaacggagttgagcctgaaagccagaatgtctttcaggctcgggatcacatagcacggagatggagaacaaggctgtggctgagagatgtggactctgctcccttcccctttacatctcctttgacgtggacgaaacagggagtgtcatctttctacttcttagagacaactaaaggactcagaaagatgatgtcagcgagcagccaagttcagttacacagtgtttgatcctaactgagcagctgtcctgctatgtagtgtacagtaggaatgtattacagtggaatagtattagccatgaagaggaacatggtactaacaaacgttataatgtggcaaccctgaaaacactgaggaagtgaggcagacatcatactgtagctttctatttcgtgaagtcttcaccatggggtcacagcagattgggcctgggaggagagaagaatggggggatatttgcttaaaggttacaggacttccttgtgggtgatgaaaatggcccggaacaggttgtttcatatttcatctcaactaacagccctgtacaggaaagctttcacgagccctgctgctgggaagaccagtgcttcagaacactatgacctgctactgcctgctcaggtagtgactggtttcagattatagtccctctctgttgatgagagtcggtctctaggtcatggagtacacaaagggcaaggtcagctgagtctgaggtgggtgggacagtggcgagcagatgagactggcctgtagctagctgtatacccaatgctgacagagggtttgtggctgattcttaccccatcaatcttgcatctcgtttaagcatccagatcaactaatacgaaacatctggttgcaccctatcccagccacctagggctttgggagactgatctcacacagtgtatattcaggaagggggagggggatttccttagtgtcacttgcctaactctttgaatgtctgctgtcctgttgttttgcctcagaaagtctggaagggtttttgttgttgtgggtttgtttgtttatttgtttttgtcactaaagaagaagggtttgttttttttttccttctcctgttttgtatctgcgtaggcacctgggtgggggaagccaggatggggagggatgtgtctggagtagagagtgtggaggaggagggagggttcatccattaggtctagggtggggttgtttgctttctagactccaactctgaagctgccggtaatcctggggcacactgctgtttttctaagaagcacataggacctggagctccttgggccactccccttcagtatgtgacagttcagtggatgggagtagaagtggagagaagggtgtggctgtgtcatggatgaagcacctgctctctcactgcagaaggtctttactgtcagggtctgcaatgtaaggcatcttaggtaggtaagtgcaaggagagcgggaaggctctaggttgtcttggcacacaggactaagagttaacttgtattgtttttactggtttcccgggcccaactgaatcacttttataatttaattgctacactgtctgtagacgtttcttcctcacaggggcgaagaggaaacctttcttcttgctctgaagtctgtctcactaacacaaattcaggcaaggctgtgtcgggctatagaggctatgcccagctatagaggctatgcccggctatagaggctatgcccagctatagaggctatgcccggctatagaggctatgctcacataaccggctacagaggctatgctcacacaaagcctttcgaaccatcccactttggataaggaggtgtgtcttgcctttatctggacagcttcttagtcccccactcagcagagttctgtggtttacagtatggcatcttagtcagcaagatttgggggtgatttttagcctgattatctcttaccaggttacatggctggaaccaccatatgggtgttggggccaccgtgactaggaaagccagtgctttggagtcatccctgcaccaactccttttccttgaccatgctcactgaggatgtcatgagtgtgtgcatgtgtgtgtctctgatcccccaaactccagtttgccagacatttatcaactggttaggggacttgcctgaattatgacaaaaatcttaagagcccaaaagacaggctttcttaagaatgtcagtggatctgggcgtggtggcacacacctttaatcccaacacttgggaggcagaggcaggcctctgtgagttccaggctagtctggtttaggagttaagcccagccagagagaccctatctcaaaaaacaaaacaacacaaaataaagcaaaagaatgtcagtggtgtccaacccacagcatgtggcctcatgcgtctaaggtagctatgaatgtgtgtagatgctatcagtgtcgtggtgtcacaaggtgggtaggatgtgcctgtaagaagtcacagagctggctagacactgaacattttgatgatccagcctgcatctccagtccctgtgatctgtgggtgcgtataacctaggtgtgctttgatgcagggagctcgggtggctgctcctcaggagggcgtgcatgtctcacagatcctctgtcactctgcagtagcttcctggggtccagccctgctctgtgcaggtcgagtaccctgtatcccgcatgtgtggggccagcagagtttcacctttatagatttggcctctgaatagtttttggatagggatgctgagcctgaaatgtctaccttgaaatgcattggagggacttgagatgatgctaacaaagagatgctgcagaataaacatgttgggggctaaaattgtgtttctgccatcactgcacagtggcagcacctgcaggagatggcagtggacatgaggccctgtgactaatgcttatctggtttcttctgtattgttttcttcgctcagtattgatcctgcagaaagtggagaatggagacctgagtaacaagattctgaagatcaccgactttgggctggcgcgggaatggcaccggaccaccaagatgagtgcggcgggaacatacgcttggatggcacctgaagtcatccgtgcttccatgttttccaaaggcagcgatgtgtggaggtaaggtgcagcctccaagttccaggtctgttttgtctgcacatttcaagtcttggagttgaggttacaggacccaaagcactccaattagatctgtgtggcctctcagagcaatctactgacttccgtgttgctaggggatgctgtgctcattgcacgtagtagatggctcctcaggaaagctctgcagattctgggaccacctggtacttccatctctgacctgcaggatgaggaatcactcttcatcaagcagcagcttgatggttcagaggttgggtttcaggggccgctgctgcccccctgggaggactcgcccagtgtcccccctgtaaactcctgagctaacagggaccctctgtgctgtctttctgctgattatttggaaatcatcctttccagttactcttttactcagggctctgtgtgctgggtatttatcaggaaaggggatagatgagtcctcagaaggccgtaggaactttgaaggtacagactagacatggccagccatctctactagcaagtatcagtccaagaggtcacaaggacatagatctaaaaaaaaatcatgttgctattgaaggaagatgagccactataggatagactttgtcctggctgaagggcaacagtgacaccttcacatacagaagaaagatcatcattgcccctcagtctagggtcagagtgagctgcgtgtgtgtgtgtgtgtgtgtgtgtgtgtgtgtgtgtgtgtgagagagagagagagagagagagagagagagagagagagattgtgtgtgtgtgagagaaagtgtgtgtgagagtgtgtgtgtctgagagagagagagagagagaaagagagagaatgtgtgtgtgagagggagagagaatgtgtgtgagagggagagagagaatgtgtgagagagagagaatgtgtgtgtgagagagagtgagtgtgtgtgtgagagagagagattgtgtgtgtgagagagagagtgtgtgagagtgtgtgtgtctgagagagagagagagaatgtgtgtgtgtgtgagagagagattgtgtgtttgtgtgagagagaaagagagagagaatgtgtgtgagtgagagagtgtgtgtgtgtgtgtgagagagagagagtgtgtgtgtgtgtgagagagagtgtatgcttctgtatttgtgtactacctttaaggtaacttccttgagatactagtcacatatcataaagtacaccctttacaatatgtaagtcagtgctttttagactctataaaactgactttaggattggaatgtggatcagtgggtagattacctgcccagtgtacacaggaccctagatgcagaaaattaggtatgatggtgtgggtatataatcctggtattctagaggaagaggcagggggatcagaggttcagctggccaaagccagcctggtatgcatgagaccgtatctcataaaaacaaaaacaaaacccaactaaaaccaaatgtcagtaaattagtgagtgacttgaatgtcgttcaccacatttactggcttcctgcactgctgtaacacatttccacacaccagaggcttgaaagcgatagagctttattctttcatagctctgggggccaaaagtatgagataggtacagcagggcctcatgctagagattctagaggagccccagtccacatgtggattctgaattctagaacgttggcaggtatctttagggccatcattgaaccccctgcaaccactatttctaaaggacgtttgtaacctcagagaaagtccatgccttctgcttgtcactctcccagcctgaccttctctgcctctggagcagctgctcattgccaccatgtcagtggaaccacacgatgcctgttcctctgtcactcacaccttacatttaacagaatggttacaggtccatccatgttgtagcttcattagaaattcattctttttatggctttttagtattccatgattctaaagtcaggtgggccatgcttattcagtcagtcattcaccatgatagatagtgagtggctttcactttggggaatgttatgaacaaggctgccgtggacatggacacacagattcttttgtgaccatactttttccatttacccgggcatgtaccttaattgcatgaagtcaagcaactaagtatatgtgtaactttttgaggtcctagaaaactgtcacagatgctccgtgtaaattccattggtctaagactaactccgctacttccatgtaaccacttggtgctgctgtttcagttacgctgacctcatctgtgagggagggtttcactgtgctgccaatctgaattttctgaatgactgttcatcatgaattgcatgtctccccaggagatgtgttgtgtctatgcaactcttttgccaattaaaaactagattatctcttgttatttttgagttttaaaatatttcaatatcacatatttttctactctgtgtttttttgataactctcagtagtattctttgaactcctcatgtttcttggcttcttcttatcacctgacttttggtgttataagaatgcatgacctcagccaaggctgtgaagagtcttagctgtgtttccttctaagaattttgtaatattgattcttacctttgggtttctgatccatgctgatttgattttccatgtggtgtgaagcagagaccaaactttatattttcatgtctgttcatttgtattggtactatgcattgactgttctcttcccattgaaacactcggtcatctctgccagaaacagctcatgaggaatgcaagggtttattccgggttcacagttctctgctaacatgtctatgtccgcacataaggcaatatcaccctttcttgattaaaatgcagctttgtagtaagttttaacattaggatatgagagtcctccagttttgcctttttaaaattgttttggtcattctgagttcactgccattttttataagtcttaacatcattttgctagttttgcaaaataagcaactgagatttttttttcttgttttaaaactggcttcaggggttggggatttagctcagtggtagagcacttgcctagcaagcgcaaggccctgggtttggtcctcagctctggagaaaaaaaaaagataaaactggtttcaaacagctcaggctggcttcagagtacacattcaggccaggatgctttgacctcctggtcctcctgctttcgtgtctgccaccatctgggataacgcctgagattttcagaagaactatggttactctttgaattattggagtgcggacattgtagtatctgggttttccaatccataaatgtgagacactcccattctctaatttccttcagaaccgctttgaactgtgtccacttgcatctcatatgttagtgcagaatgaagtgctactggggagtgcgttttcctccgtgtaaagtatttggcctgacaggcagctgctatagatctcaatgttgtaccacacactagtgaggctaatgccaattaggccttgtttgatgtattaattcacctggtatcacaaggaggccaattgatggggacacttaccaaaagaactgtatttctgcttcaaggagtagtcgaggcagcccaagctggcaggatggctttgcccatgagactcaggttcttcaaggtccctccctgtccttgtcccagtgctttaacgtgagctgcggtgagttctgcattacagtctgcaggaaaggagaccaggcctcttcaagcccacacgctggccttggctttggagacagtctgcacgtttacacagctcctctgtccacttgcttattgtccacttggccctgaagagacaccaaatgtgactttagctactgtgtgtccaactaaaattctctcggagaaagtgattggaagagatacccctgccgcacccctcagtcacagccattgggagctcttggttcctttacctctcctcagaggatggcatgtttactgtcctgtctcgcttctctcaggttctgttctttgcttctgcggtgataggatgtgtccagaccttaccagcttccatgcctgttcttagtaggaagggatgtgaacacctaatttagggcactgcaggggcttttcttcagtgggggaatagacaaaactctttcaacttttaccctgttactgaataccctattacaagtgtaaggttagtgttttgttttaaaatcacagctattaaaaactatttgtaggagctgtagtgagaggcagctgatgaaatctctcagttccctaacagggagagcttattgttagagtctaccagtgtcttagtgagggtcactattgctgatgacataccatgaccaaagcaacttggggaggaaagggtttatttggcttaaattcccacatcactgttcatcactgaaggaagtcaggacaggaactcaaacagggcaggaacctggaggcaggagctgatgcagaggacatggggggggggtgctgcttcctggcctggcttgctcagtctgctttcttaaagaacccaggaccacccactcaaggatggcactacccacgatgggctgggcccccctgtcagtcactaattaagaaatgtcctacagcttacttacggctggatctcatggaggcattgtgtcagttcaggctccctcctctcaaatgactctagcttgtgtcaagttgacacaaaactgtccagcacagttagtgactctctagcttcgattgttccctgggaggctggagagagacgctcagtgactaagagtacatattgcttttgtggaggacccaactttagtttgcagcatcaacactgggcaacttacaactgccaggaactctaactgggtccgatgctgccctgcgcctccccctgtagttaaacagattaattataaatccttttaaataataaaattgttcctaggatgtaagccccttgtccctagttggttggtgactgcttggaaacgtactgtgcctgcctgtcccagcattcttagctccttgctgtgagagtttcttaaagacgtggcttactaactcctttatatggggttcacccagctccattaaagcatactttggttccagaagatctctcatctttcctggagggaaatacccattcatgactattagtacaacacttctacactgggaacccacagacagctttgctcctgtgctttggggagcctcttttcgaaggattggctcaccacagctcagacccagcagggcttccagagagggcagacacctgactaggggcttgcagaaggctggccctaagctggtctgttattcctttacaacactaagtgccaattattgaacctttaccgtgtgccatgcacaggcctcggtcctcctcttcctctcctttctcctcttcctcctcttcttcttcctcctcctcaactcttaagcctcaggtggagtgatcacagatggaccagcaagtcccgtgtggcccagcttccctcactgatgctctgaagctagagccctgactcctccctcttgcaggtggcctgagacatcttcatgggcctagtgggaaaccattagagaagggatgccaggacagaaacagagcactacttagggctgagatcatcattgcctagatggaggacagggtctgtgggaccactaggttttgttacccgtatagaaatgggcattgtacagaaggcagttgactgaggatgggagcggctctaacccaggagtctggctaggggtgccgagggctctttgagttgcttggtaaaaacttccaagtgtgactgctgtctaggtaggtcacaatcaaggtctggtagaagtacagtttctctttatttcccagcctgtcctgttcctccttcatccacactttccctgctgggcgtggaagccaaagccacagcctgcatatgctaggcagatgctttaccacggacccacatcctcaatctagtagtgtaattcttggcagtgttcagggatgacgggagcacgctcagtgtagcctatgggagcatctgactgcgcgtgcactcactcccacagtggccaaccactcacgtgcctttttcctgtgagtttcaggcatgagtgctgtagttacatcctttccacccctctcccccccacacccctcccccccaagcccctcccactccctctcaaatttatgacctcctttaaaatgattactgtcttatacacactgcctactgcgttcattagcgttgctaatacgtacacgtgcttaggactgaccactgggactggagaaccgacctggggactcagagctgaagaaaaccagttttccctccttcggcagacactggctgcagctcttcgtccaggagtggggcccagaaggtcctcgtctacttaggcacagcaactggtgtcattgtgcacgtcttgtttaggcaaccgtcttgttgggacttcacaggggtggcttcccagccgtgtctagaacacactgtctaataggggttcctcatcctttgacttaaaacgtttctgtctccttcttcacagttccctctaagtcttaggtgcagggctgtatgggatgcacgtggggctggaccttccacagttgctactctgcattttgaccagatctctgtaatagtctccatctgttgcaaaaacaagattctttgatgaaaggtgagcgctgcagtcatccgtctctggacacctattaacctgagcaagaagccctgagaatgtgaggattaaaagccatattactctgattccccctcttcagaatccagcaaccacagtgcatggcagtcaaggctcaggaggccctggcagggttaccagctatcagtgttctcaccagctaccagctaatttctagctcctagagagataaaacaagtcctaaagctggcgtgccctctcacgattcataaagaaagtgacggcatctagatgccttaagagagtaaagccaggatggctggattacccccaggggccatctgtaggcccccacgcccagtgccctggcacataggctggtgcattgtttgcaggcgtgcagggcgattaggagtgtacttgagagcaggctgctcactcgtctgtgtgtgctggcccttaggctctgagctccaattcctctttcccatagtggtcaggaattaactcaaagaccactggctttcccactctggtctgcttagggttctttgtgctctaatacgtctgtcgtggctcattctgtagcctagtcttgtcttttctgtgtctctcactaatttctgtgtggaagatctgtcctttaccctgttttccagtgtctggagcttggggtttatatagaccaccaaacccatccaagtcttcacttcctgtacttgccaagacttgctcacacttgcctgcatcctcgtgtggattcgggatgatggaaagtgctgtactccctgcacattcaaagtatcctgaaagggtctgggtgtggtgataaggcccttgtagctggacactgctgagggtgttacaataagtttgaggtctttgtggcaagaccctcttccttctggatgattggagcttgtgttttcttggcctaacttattcctggaaggacagagtgctgtgtggtcgttcctggttttgattgcagacccatagactaattcttcattaggctttgtgcttcatgttccctgtctcggaggacatgaagaattgtttttatgaacctggtaggtagggacacagaagttctcagagcttgtgtgctgttcttctctgctgacgtagtctgccctgtggaacttcccccacagagctagacagaggcctctgtgaaagtcccacttgtgccatctagagtcagacatttatttaacctagcagacacttaaatcttttgcaggagtgaaatccatgttgagtggtgctcactgatttttctaaagccaaaaaaaaaaatgtatctgtgacaaaagtagtctagaaatagattctatttcggagagtctcttctacatgtttatctcattcacagtagcagtcagtcatggtggtgcgtgcctggaatcctagctctggggaggcgaagacagggggattaggaggttcaggccaaggctaagctacagagtgaggccttgttttaaaacaataaaggtgctgtggccactgagtgcttattttctctcctaaagactcattggatttcatgacaacttctgagactaacggtgttgctctctacagaggagggattagaggctcagagcaatgtagcgatttgcccatggattcatatgcaaggcatgatggggcaggcgtgacaccagatgtgcctggctccagagccttgcttttgcctagtaggcgttgcggcttccctttatatcaatgtgtctatttcactcgtttttctatagtttgtagggattgtgggatgtctggaaaaaccttagtagctactttggtgaggaagtgtctgttatttcttacagactttctgtcctctttctctctccagctacggtgtactgctttgggagctgttgactggcgaggtgcccttccggggcattgatggcttagcagtggcttacggtgtggccatgaacaaactcgcccttcctatcccctctacatgtccagagccttttgccaaactcatggaaggtaagtaactcctgggccgaggaaagctggtggctgttaacctttacccagcacttggaagacgtgagatcagctgcaggaagaggagatgagtattagccaccgggggaagagttgagagagctgttggtagacagtggccacaccctgctaaagcaggttcctttttgcagtgactatagaaattagtaactgaaacctgctatctcacattccagaattgtcttatgtattacaaaataagctacagtggcagttcttcccagacctgagtgtcttgtgtgtaggactgaaggttgtttggggagaaagggactctaacatcaccgagtcgaaaacatgattttgtgagaaatgcaaagctaggcaaagtgatgaaggaaagggcctactgtgtggtggtaactggtaggctcactcctcctgcctctccctgatgctctcctctttgtcttctcccattgaggtgtggggatggtagcttgtgttcatgtaggaatttggggcacagtcacccatggtccacttgaaccgtacgtacatacgtcgtaagctggtagcagtggcaagcataggaaattttgttcttatgcatgctcaagggtgtacagggcagtgtgtctgacttctggtttccccttttcatgttatcatggtggatggtatgctttcctgcgggggttccctaaattcagggctctattttctaggagaaattgaggctttttttctgatgaggagggtattcagtacgaaatgaagcttccgtttgcctctgcctaccccactcttcctcttcttattttcaattcagactgctggaatcccgacccccactcgcgcccatctttcacgagtatcctggaccagctaacgactatagaggagtccggtttctttgagatgcccaaggactccttccactgcctgcaggacgactggaaacatgagattcaggagatgtttgaccaactcagggccaaagaaaaggtagagaggaggggacggcaggccttgtcttggcagggatgcttcactggagcgtctggactcagggtaccaaccactgacaccagtaccttcttggggtctgcttgatggtccacaccacaggataggaacctgaaactgacattttcatgattttgtggaaagcgttctaagctcagatcatctggcgatgccagcatctcttggcttgctggagtctgcttttgagtttggtagtcattcccccagtggccctccctgtttctgtggtatgaccctagcaatcagtgtccacacagatgaaaccaattatatacagttttatgccctgcgatgtctggacagagccaaatctggggacctgagagatggacatatagtcttggggagttaatagtgtgtgatagccaggcatggtggcacatgcatgtactctcagccctcagaaggctgagggaggagggttgcaagtttgagatcagggctataaaggatttcaagactagctgggctatagtgtgaaacnnnnnnnnnnnnnnnnnnnnttctctcacagctgagggccaagggcgtccaccttcttggagctaggaagggggaagtaggactagcctgggccactggattctaagcccttttcctcaatgcctttgttgtcccctacacaaatggtttaaaaataatttctgaatctaattaagagagattagtctcctttggagcacagtgatcctgagctgttgggaggtcactgacggcccgtagtgactggggtggcagagtggggaggctgacagtgggtggatctctgggggtccctctgggagaaccattgaccgttgatatcattccattactgctactcttccacggaggacctccaccgtggctggcttttgtcaagattgctcagtcaccaactcccggccaccgttctttacagtcataatgcaatttataaattacacaagccagtaggaaaaatgaagattggatcttgtcaataagtagttagagtcaacccccttccccaggtatagttttgctttctgtggcttgacttaaccactgtcaaccacagtctgaaaatattaaatgaaacattgaagacgtgaacagagtcatgctttaaatggcatgctgttctaagtatcgtgagactgtcttgctctgtccttcctagggacagtcattctcctcacactggcacattacccaagccacatagtattgatcttgggtttctcatctgctattgtgataaggcaactttgtgtttaggtaacccttattttatttaataaatattccaaaggacaagagtagtaatgctggtgactttagtgcaatatattgttgttgttattattattatcattgtactatacatatgaatatactatatattaatctcttgtagcgcctaacatagattcaattttatggtggaggtattttagaggaagacacataatacacgcagagttcagaggaatccatggtttcaaacattccctgttggtcttgacgtactgtacaaggataaggaggcactgctgttgtaggaagagtcagcctctgtagttgtcgtcacagaatggctgtgttacactttcctctcagagctctccaggtcgcctcctttctgcactgagacccacccttctctctaccgtccccctgtctgtaggagctccgaacctgggaagaggagctgacccgggctgcgctccagcagaagaaccaggaggagctgctccggcgtagggagcaggagctggcggagcgggagatcgacatcctggagcgagagctcaatatcatcatccaccagctgtgccaggaaaagccccgggtgaagaaacgcaagggcaagttcaggaagagccggctgaagctcaaggacggcaaccgcatcagcctcccctccggtcagtggcagagcgagcaagcgcgagagcgcgcaggaccaggagctggtgtggcgggggttggcaggagttagactgtgcttggaaacacagaccacggctcctgaagtaaagcatgttgggctgtgccatcttgctcagtggctgccaggcctttcggggaacgtccattggggaaggatgtgcgccattggggtgaaggggttctcaggtgttcctagatgagaaatcttaatcctgaaaaggaacttgccatctcaagtttcttctcatggttctcagtgcatttaatattaggttaacaagtaaacgttcctaatataagatttacgtacagcctctcagaagcacagtggccccataaaagtacattttcagtactgttacctggggaaatgtaaagagataagaaaccatccgttagaaccttggtggagtataatgtgcccaagggggcatgtgagtatctctatagattaaaaaaaattgtttgtgttctaaatctataaggccttgggaagcaagcttattagaatttaaggaaataaagaatgaggtagtcagagtggcttgggatgatggcttagacaccaacaagagaattaagccatcgaatcggagaatgtgtttatggatgtgtgctcagctgtccttgtcacatttgatgtggttggttttttttgtttgtttgtttgttttgtttattgcaagtcgtatggtatctttgcgtacatgtggagcacctagactgtaccaggacatttctatgcactaacaacagatgcgaagctctggtcccatttgcagggagaggttagtgtagtgggggagggcccagtgtctctgacagatgaggaggagactgaaactcagaactcaagagctgaacattccatgttcttcatgctgtattaaaactaccattatggtgtgtaagacgtgggtcagttccccatttctgttgaatccttgtgttcccatcatgatctgattcttaatacaactgcaatttgtgaggagcattgaacactctttatttggtacataaaaggacatgcatggtgatagatcatctattcttattcctagaataatccacaaagtgacatgcactagaaagcagcacttaaggttgtaattgcactacctgtgtccattacatagagagtgctatgaagatcactatctgtgtgttcatcttgtcatgtgaccattctggagaaaacaggagatgaaggcctacccctcaggccttccaggagacatcagatttcttaaatgagtttggctgtgtggtaatcctgacgcacacgtgtttgtctctccaagcagatttccagcacaagttcacggtgcaggcctccccgaccatggataaaaggaagagtctgatcagcaaccggtcgagtcctcctgcaagccccaccatcatccctcgccttcgagccatccagtgtgagacagtagtttccaaaactgaggccagacatcccagggactcttgtcccctgctctgctcagccactgacgaatccaggcttgttccagctgtaacttctgccaccttccccaaccatgtttgcacacatggatatacatttgcagagcctcagccttcctgttcctcgtcccgttgttcacttctatgctgtttcctccacctttcccacacagtcagacagcagcatgggggtggggtggggggtggatatgggaaactctttagggacttgcaaagcaatttggaagctggagtgatagcgatatagatttgtgtctgcctgaggacctccatactgtctgccctcctgggcaccaccactttccttccatctgtatttcccaggctgaggctttccaaagcctaggtcttaagaaaactagtcaaagttttagtgtaggccaaaacctggactagtgttattttttactatagcaattgctctaaataaattgtgtgtgtgtgtgtgtgtgtgtgtgtgtgtgtgtggtgtgtgtgtggtgtggtgtgtgtgtgtgtgtgtgtgtgtgtgtgtgtgtgtgtggtgtgtgtgtgtgtggtgtgtgtggtgtggtgtgtgtgtgtggggggggtgtggtctgtctgcggttttttggagatactttatcttactcaacctttgctattcacagtgacacctggtgaaagcagtaaaacctggggccggagctcagttgttccaaaagaggaaggggaggaggaggagaagagggccccaaagaagaagggccggacatggggaccaggaacacttgggcagaaagagctcacatcaggagatgaagggtaagaggcagatgatgtaactgtctctctcactcacagactgacacaacattttaaagtatgataggaaatacttttgtttctcttgtttattttaatatgtttggaaaagtatacaggtttattgttttattttctaagatgggctgggctagcccaagctgtgttcaagctctctgtcttcctgcctccacctcctgagtgccgggactacagatggatcacactgctacttctaagctcttcctgacccttctagagagttgtccagtctcctgatcctgggtttccttgtagtcaggaattgtcaagctctttctataaaaggccagatgacattttaggcttctgggtcttcatggtgacaaagaaataaaaaagctgtcccagattctgcgtgacacataagtgaaggagcacatgtggctgtgttcctctcaaacctcacaaagacaagcggcaggtgggatcggattcagtctgctggtttgcgctcctgcaggtgttctcaaagcagcaagtagcccaaataggatggggatgcaggaggctgggctgagtgggctaagacctgaggcttccccataaactgtctgttcagaggaaggggaggaagagcagggtccaaaagggctttatcctgaagcagaggctggcacaggacctcagctctggcactgccctgggatgtactgtgccctactggactgccttgctactccccaactaaccacatgttaatgcccttctaggcaacaggtgccttaggtgtgctgcatcctcacttgtaggctggaggcctgggaagcaaattctttgcatctctgtttttcataggccagggctcctgatggcacagagagggtcttggacaagaactcagctccacaggtagctgtagagctcatgttttctcagctacaaaatgggcataagactagtacctagcttaagggttagctgagttccttttgtgaagtgcatcaattagctggctcatggtgaacacacctaattaccatgctgggatgatggttcgctgccttccacgtcatctacttaatcctctaagagtgagcatcacggtttgtatttcttctagagtacttcctgctcttctgagtgtgaggatagcaatcgcagcatcatttccagtgacttcctgttgctcactgaatggggcctccaaacctgtactaacattttatgttcaaactctccattcttcatgtctgagctcaaggggaaaaaataacaattagatttattaaaaaaaagaatggatgtatactaactgtcaagtaaggctttgaaagcctaagttgctttaaatagaaaatgtagacttgtaggacaagctgtctgccgtgtgagtacagcacttacgtccttggggtcacaggcttacagagctcaggagaggagatcggataagaacttgcagtctgcccttcatggcctggctctgaggaacccagtcaccctgagtcactggctacctctgacattagtataaattctaaggttaaccaggctcgtggtggtgtctgctaattaaatttttcactccattttcagtgagtgtgcacagtagtttttcttccttcctgcaggtccttcctctcctcagagaggactctaatgattttgctgcttctgcttcacttaaaggttcttgtgtttgtcttgatagtaaattaaccttcttcttctactacgagagagtgttaactttgtacttttctttcttcttacatagatctgtccttgcagacttttgagacaattaagaagcacatgccttggtttttcattattcccaactctcactgaagaaatgaaagtgtattctaacaagcttgagtcccgctgcctttgatgtcagaaatgttagcgatatctccatcataatgttattaattgtagtgcctgttgactgaagacaattgtaacagcaaagcccttgaattcagtaaagtgaattccccctccccattcatctaacagtacatgtctgtagggaacagcagctcactgatggcagcttgggtgtttttgactcacagccccttgcagttaccctggggctgtccggggacctttgtcccttacactggaagagcctaggcctgaaacagctccaacatggagtaggtttgctgattggacgggcagagcacagctggccacctcgctggtccagcctgggcagtttgagtatgggagagggtgagctggctgtggtctccactacatattgctgactctctttattcattgaagctccccccagagacgggaaaaagctaatggcttaagtaccccatcagagtctccacacttccacttggggtgagtctggtcttgacccatccacagctgtgttggtagcaactgcccttccattttcctgttctcattcctcattgctgcaagtgacgagctggttatttttgtaagagcagcgcaccttgggaaaactgctctgttgtctcacccaggttgctggactgctccttgcacactgtgcctggagaaggccttgtgctatgcacgcttgagcctggctttgattggctaacctgggcttcgtcaggcccagtactagaggagctataccatcacagtgtagtggggaagtcccaggctgtggtgttggccgcttctctccagctctgtgttgttgttttgttgtagttgttgtttgtttgtttgtttgtttttgagacagggtttctctgtatagccctggctgtcctggaactcactttgtagaccaggctggccttgaactcagaaatccacctgcctctgcctcccgagtgctgggattaaaggcgtgtgccaccaccgcccagctttagctctgtgttttgtgcttcagttcaccagtgtttctgcccgcacagttctgaggcctaggagaaagttgagccttctctctcccgctgtggcttcagaccctgagagagtaggctttgatgtatgggtctttggcattaaaaaccaagagtcctctctggctgatgggttttcagtgccaccatatcaagcagatttttcaatgctcccttttactgccctctaggggcaaggcccgtgcttccagaaccagatcccactttgtaaggaaaaggaagggggtccatctgtctctggagaattgctaagtttgccgaatgagttgatggcagggagttgaaatcaagccgctgtcttttgtctccatgcccagacaaactgcggcttgagtaccacatggtgtgtcccccatatgggtctgtcccacatgcactggctggatgcagctttcttgcttgattttttttttttttccttttgaagagtgaatggctttggaagcttaagcatgcgaaatagaagcttggaaggagaagctgagaaacattatgagtggagtggccggggccatttctgctggttcatctgccccatgcttgccttgcactgcaggtgtttgcattgaaatccttgtgatgttctgagtgtgttgtttggtttctgtggggtgattgcctttccattaagaatggctcagacacggccttccacaagctcagcccttactccttctgtctgcttgcccacccgctcactcactctttccatgattccatagcatgtgaggggctcggtgaaaccaccacttttcatctcctagagcatgtgcacttgtctgtgaactaggagggctcaggaagagttgtctgacccccgaggttttcagtgtgattaaggagacagacactttctgaacgcccatgaaaaaggccgtaagggaaatagccagtgctaacgagtctcctcctccttccttcagcctcaagtccctggtagatggatacaagcagtggtcatccagtgcccccaacctggggaagggcccaaggagtagccccgccctacctgggttcaccagccttatggagataggtaagtagagcattggttttctcctggtttccttagagaattcttggctagacttccagtgttgtttaaggattccagtactacttactatccatagggtttgtctcatctttgtcctctactctgtcgtctccattttaccaggttttctaaaccccagtttccatgtattgtagccatggaacctgtcttttgcctctggccccaagaatccaacaataatgtccctaggacagtgtgcaaggatgagggcttgaactgggcatacttcccctttccgagcctttcgggtgttactctggtaacactgtgggggctgagctctctggatgcttttctttgtagatttccaagtcataacaggccttcaaacatgaagaggattctgatttcttctgaagaccaaccttaagacattttgcaaagaattgtgctagaaatccaaagcctttctagttttaaggtgcaaaaatattagcaatgtttctggttctaggaactcattgtgcctgttcttgtaggagtccgaatgaggtaaaggcgctgcacagttgcacagtggtagtacacttgcctaacagctgtgaggttggtgcagcattttatacacactcggcagagtccctaagagggagacagcaaagtagctgatactccttttttgcaagtagagaaatgggctctggaatgccggtgaatttcccatgttggtctcagttgggtgtacagaaaacagttcccatgggctcagtgcccagtttcatgtcctgcttttctgacactgagctggaagaaggaccagactcttcactccattttctctgccatttctcctgtttgcacagaggatgaggatagcgaaggcccaggaagcggagagaatcatcaacagcattcacccaaccagtcctacctctgtatcccgtttcctcgtggagaggatggggatggcccctctagtgatggagttcatgaggaacctaccccagtcaactcagctaccagtacccctcagctgacgccaaccaacagcctcaagcgcggtgggacccaccaccggcgctgtgaggtggctctgctcggatgtggagctgttctggcagccacaggcctagggtttgacttgctggaagctggcaagtgccagctgcttcccccagaggaacctgagccaccagcccgggaggagaagaagaggcgtgaaggtcttttccaaagggccagccgccctcgtcggagtaccagccccccctcccgaaagctcttcaagaaggaagagccaatgacgttgctaggagacccctctgcctccttgacactgctgtctctctcctccatctctgaatgcaactctacccgctccctactgcgctctgacagtgatgagatcgtggtgtatgaaatgccagtcagcccagttgaagctccacccctaacccaatgtacccacaaccccctggttaatgtccgagtggagcgcttcaagagagaccccaaccagtccttgactcccacccatgtcaccctcacagcccccacgcagcctagtggtcacaggcggactccttctgatggggctcttaagccaacagcagcccctgcagtactaggcagcaggagcccctccagcaatggaatgagtcccagtcctggaacaggtgagttctggccacttccccttttctctttgcttcttttatggcccccaggagtaaagatgtttgtaggtggctcattttctctccttttacttctggattcgaataagctccagttcttcttctcttgttcaaccatgcaagaaatatgatatggaattggcagggtgtccagagctggctggcttctctctgccctgtactatggtcatcttctcctgactgatgaaaggagtcgggctgcttaggaagagacagaagagacagacaagggcatcaatgacatgctgaaaccctgctctggggcagggcggaggttccccatccgagggcagctgtcaagcttcttgttccctaaagattctgcagccacagtgaaggagtcttcaccacacccagggagggtgttttctgccacatacttgggcccctgccattatagcattagttcagacacacacctaaggtcagctgccacccatccgtcacgttctctgtcactaattcctgagtcacacctgccccttcacagctggagacatgtctagtaggtggctatccacatgtataagcttgcctctagcagttgaccccagaaactcttgtgaatgtgcaatttctacttcggacttccctgtcaccaatccttgctccctaaaaggccggaggctggctaagaaacatccgctacttagaacatggagagaagcagagatgctcgcgcccttttggcgagattgagattgccgtgtgtgcaacagttgtctcacacctttgtgggagtcttccccctgtaggcctgtctcttacatggtctgtgacctgtctgggaatagagatggcaggaatcgtttcctgccacatggctattatgtagatgaacactgaacaacagtcatccccttaaatcaagggtcagcaaactgttttaggaaaggacaagatggtgaatactttgggatctttctttctttctttctttctttctttctttctttctttctttctttctttctttctttcttccttccttccttccttccttccttccttccttcctccctttctttcttcctcccctnnnnnnnnnnnnnnnnnnnnctctctctctctctctctctctctcccccctgtgtgtgtctctctctgtgtatctgtgtttgtctgtctctgtctctcttctctctaactactcagctatactgctgggagatacaaagcagctacagagtgtatcaaaaatgtgtctcagtaaaactttatttacaaacataagggaccaccttaaggatcctttcccaacatctgctttaaattagttactattacttcacccaaggccactttgtttctattcactgctatatccccagcacctccctgcacactacttgacacagtgtgagttctgtaaacatttgtcccacgtgcctaggcatatggaagtatggggaaggtcgtgtctcagctggaaataatggtgccatcatctgatgtctttcccattgtctctctgaccaggcatgttgaaaactcccagtcccagccgagacccaggtgaatttccccgtctccctgaccccaatgtggtctttcccccaactccaaggcgctggaacacccagcgagactctaccttagagagacccaagaccctggagtttctgcctcgaccgcgtccttctgccaaccggcagcgactggacccttggtggtttgtgtctcccagccatgcccgcagcgcctccccagctaacagctccagcacagaaacacccagcaacctggactcctgctttgccagcagcagcagcactgtggaagagcggcctggacttccagccctgctccctttacaggcaggaccactgctccctgctgaacggacacttttggacctggatgctgaggggcagagccaggatagcactgtgcccctatgcagagctgagctgaatgcacacgggccttccccatatgagatccaacaggagttctggtcttagtataaaaaaggccagggtgggcaagggagaagacggaggaggccgagggagctggctggcacagcccggtctcaggccccctgggatccagacctcctccttgcactgagaatgcactttgaagatggaaggggtgggagcagggccacttcggagggtctcctgccctgcaggattttttctccatgttcactagaggggctgtgtcagctctgactgtatagagaggggtgtgcacatatgtccccaccctccggtcttcctttccttttagggtgacactacagagtcattcagccaaatccgtctactgcctctcctcctcagccagccatagctgtcctgggttccctttgtcagccctgagtcctacctgttcacacatctgtactgatgttctgtgatctgacttatcgtccactcttcccacaactcagtgtcacctttggtatttgatgagtgtctcgtgtcctaagtcgtcccgtgccagctgatggggataggctggccttatgaaggccagagggcttgacagatcaggtactgcctacctgtgcaaatctcagtgggaactgagagttcagaggaggaggagaggagaggaggcagtcaggaacggtttagtcaggctgcgtggggaggtagagtcaggccttggtttggtttgggtttaagttttagaaacaaaggcagaaatcagcacctatggcgtggcgtgggttcagatcatgcttacaccagatttgaatataagcagattcatctcaggactatctgtttgaaagacacactcactgaccccagttctgaagtcaggaacaatgcctgcatttctctgtcttgttgagcttccattcctccctccggttcctgggctttaggtcatatgtgattcgcagagacacctgaattatgtcaatagcatatggggctgggtcctggaccatgaggtatggaactatgggggatttcttcattggactgtccattttgtgatgtccctgaagtaaacggaacccttagtaatgtttgggtgccgtgaggcagtagcatgatacagttcctgaggcgctcacaccatctctgtctctatacacagagagcctttgtgttgggtcctgcaccatgagctgggtagcaagagaccagagaggctagtgctgacgtatttaatatttgtttcttaaacttgaatatggagcttcaaagtgttttcacccattttctttgctgtccattccctctgagcccccggtgttgtgggtgacagtaacaacttggttgaggttacagtccccagtggtgttggagtctgtctactggctctcttgtgtttgccgcctggatgcccagagggttagagcggtcggtactcatggtgcaggtgacagatttcatcagtgctgtttctctgtgaagaacatatgagatgacgttggttcccacaagttctttatgagttcatttgccctttgtctccaccctgcacccccagtttcagacaggggatcggtgctgaccatgtcagccagagttttgctataatatctgatcttccctcttggttctgtgaagtgagaatggaagaggttaactttgccccccatactctaacccctcagattgaagaggggagctcgtgaaccccattgtcccagccaacccagtgatgatgctccactgctccatctgcacaccttgcctgcattaaagctttagggtaggctgcagctggctccagcctgtgctccagccccaagcagggcttgactgtagccatctctccaggaaaggcatagttacagatgcagtgtacactgagtggctgctacaggccattgagtgacaggtgggatctagcccatctccacccaacattccgacagaggaaggccttgctaaagagatgatcgtacctgagagacatgtatactgctgcagtgagttagcgtgggttagtgtggggggaggggtcttgttgagctccgacaaacctgtgcagtgctggcccactgcctgccactcttccgtgcgagcgagcctagagatggggcaagtgttaagaagttaccatttgtgtgacataggttcccatatctgtggtcatggttaggacgaggcttggtagctgtgaatatacccacttaagtgacagtagcttccccctttcacttccctttcctcaaagacatggctgtctgctcggaacatgtgtccgctaccttcaggctgctagcaggattggatactgctcttttctgtgagtcttctcatgccttcacttgccagtgcttatccttagagacccaggctgttgctgggaactgaggagatgcctccatcgccacttccagctatttccgggaagctgtcgtggatgctcttcacgtggtgttctttgacatccctgtgaccttgtaggcatcataataacgatcacctacatttgaacaactcagaacagggatgttttcccttctgaccttaaaagaaaagtgacattattttcctcacattcaatacacttgtctcaaaaacaggaagacagacagacagacagatgctgtttggatggttgtgtctggccagagctctgagcccggcccgcctcctcggttcctcttttcttgcatgactcttgtcctgtgtcttgatccctctcaggtttccttctaaaagcctttatcatacacttcccttgcaagggcattgagacattgtggctccctgccagctcgagggccagctccttcccctgcacgatgaatgtgctgaagctgacagcatggctcaccatctttgcctcagggcatcttgccttagttttatcctttggcttctggaagatgagtgatgtggaattggttgaacatgattaatgggcacccaggccaggcgcatgctctcccaccacttcatgtagcccaggtgactacatgatcatttcctaactccctcccccacttaacctggtcagctggatgtccttaccattggtgtcttactgaggaaacgggggctgggtggcctctggtttttgaggatcatccctagggtcataacttgctaggaatcgaaatcaggtcagttctggaataattgttaggaaaagggtccctaggcatggaacatcatgtgacaaagggtaatactcctaatagaatccctttaccctcaggctgttgctcagggacacaagactttgcagggtgtctagacccaaccctggctccatgctgttgccccatgagaaggaccattcttaactcatgaagttcatgtcttctgtgcattctcttctttcctctgctaccccaccccaacccccatagctgcatctcccacttgctaagcaagggcctaccaatatcaagctctgaacagagtaaagaacaatgggccctgaaggctgtggctgtgagtggacacctccggatgtaagtgtccaggggtgctccaccacgggtgcagagcccccgacttttaatcatgtttatttgatcatgtgcctttggatgggtgtgtaattgcgagatccgacaggtcagaagcacacatgtctgcctctagaaggcctgggaaagaggcatgtcctagtgttggtgaagtactgaacttcctctaaggacttgtgtagactggaattgaggtagaggtaagagtggccctcagggagttgtggtggcaagaacctggcgacttcacctgtccattttcaagccgaagtttgccgatgtgtgaccctcagaaggcctcccgtgagctgggggtgatgtccacttctctgcttaaggccctaactttaaaacctaccatcttagctaggttccggggtgcattcctagaagcccagctacacaggaggctgaggcagggcaattgctttagcctggggtgtgatgtcagtctggggcaacataacaaggtcctgtctcttaaatgtgtggagccagagccccagctccaacacagatggcttcaccttgcaacactgcttcccttggtggagaaaagtgagaatgtgaaagatgaaaagtgaggtcaaaggctaaagttgcctattccatatggctcagtcatatagcacttgtccttggcttgacctgagaatgacttcctgttatgacacagttgttgaaaacacatttctagatggcaaaacagtattttcctagttcaaaaattgcaataaaatccgcatatagaaggagaaagacccttctccttggactctcccctggcatggatacctggaggctcaccatctctggtacttagttggagggcaggaaccaggagctggaatcttgtttgattaagggtagtcaatccatatctaattagccaaacccagacccggcttcctggttaggtctgcaggccaagtgtgtttcttttattttttttcatgagctgcttctaggtattcccacccactgccttctctgtccgtttctggttgcggaccctggaggcacctgggcctccctaagctgctggagaagcgctggactgactgcagagttcggggttctcctgagctctgcactcaggtccttgatttctttgctgcctttgtccctgcatcctctccaagtctcaagatgggaaagagaagatcctgggattgagagtactgacctgagctgggagcgactttggaaacaggcctgccctgccctgccctgccctgctctgactgacccgctaactgctctccggggcatttgggttgtcaggtgtgaatgtagcagcaagatggcatcccaggatggaaataagaacacagacttagtgttcagagagcagcctttcctaccagggcaggaggggagaagccctcaggtcagaatggctgtaagggaaaccctgacatgtgaagacccctgagaagtgatacagcatgctttgtactcgctcaagaccaaatttcaaaagttctgtgttgccctcgctcctgccatctttcacaccaccatacctacacagacaaccttagggctgagcaccgaccatgccatggatgtttttattaattttggcattttagaaagttatattgaagtatggtttagcctttgattactaattttttttttgacctcccattgacatttgtatccaatgcaagtgccttcccagcctggtatgggataggccctgcctaacgtctgcaggggctccagatggagctgtgctgtttgacatagggctttgtgttttatcctcatcaccacctcataccacaagttctaagtgctgcttgtcaccccctgggagccctggcattcagagacgacagggcagcaccctattcctatccttggccctgtagctagggtgacgtgtcctgccttcatgttctctggctgccttttaggctctcagaagcattccaggagaaagtggtcctatagagagaagcctggagattctcaactttaaattctctgcgaattctagaagtaaacggacctcattcatccgtcccgggtctcaggactcttctgcttccctgtgtgctaagctttgcannnnnnnnnnnnnnnnnnnnnnnnnnnnnnnnnnnnnnnnnnnnnnnnnnnnnnnnnnnnnnnnnnnnnnnnnnnnnnnnnnnnncaaaccttcacactatcccctagggtcaggctccctgccatttcctgccttcatggtcacatcactcacgccatttattctacctccagttccaaggccatgtctgctatggcttttatttattatttttattatcattgttactttggacagggtctcatgtaacccagacaggcttcaaacttgctatatagctaaggatgaccttggatgatcctccacttcccagatgctaagattataggcgtatagtttagtttattcctgtcggaataagataagggtttatcctggcccagatgtggagctgaacgacagattttaagaaaagttactatatcttccacataagaaggttctgtccagaaatttatgtgcatatattttgtgactccttatacactactccccagagttggtgggtattacctgcacccaagaatgtgtggacagacttgggggtgttcgtactgcgtgcctagagtcacagacctggtaagcaagttgctgatctctctgctctagcctgtgagcacattcttagaccacggttgaaaagccttaaggtgaaattcatccatctcgggtccatgtaggttctgaaatcaccgctttcccaaggagttgtgtcctctggctgacctgtgatctccccgagcccagcagacttcatcattgcagagggtagcgttctccttcacctttctcagttcggcagggattccaacctcactggatgacggtctgccctgtagctcccctcctcccagcaccgagaaggtcctgggtctctgccgtccgacttggagcttcctgatacagctcctccactctcctccattcctagtccttggaggttggaagcctgtttcagctcctgtcttctagggagatcagaatgttgtccttttgtcgccgtgagccttggcacccagctagcaaagcaggaaggtgttgaactcactaatgctctgcttcccctggtccctcctgtatttcaccttagtccacagccaggcctccacagacagcggtctgaggctctgttcaaggtctcaaggagaggcactggacaggctctagttttctgaaaaagttgtctttggggctttctcctgttaggtcccttgagtctagaaggtacagtgaaagttgttttattgttcagtatttaactacaagcgtccttccctgcaccagtgtctcctctgtgtcctgagtccctccttgagcccctatttgctttggaatttaaattattgtgtattgtcggaaatatttaaaggcttttggaaaagtcctgaaggaagcgtattaccaggttctttcctttggccttttctcttcatgtctttcaaggtactgtacattgttgacgggatgccaagcgggctgggttcagtggctaagcctcccactattatagtgtcatgctgatctcagcctggtccccacaccagagctctcagagacttgaataaaactgtcatactggttactcccggttccttgtggtggtcctatgtagcttgtcctaacccattctcatgttaattaaaccagaaatccaagtagccaggctgtacccagagaagtgttacctataggaaaagagtatggagagatgagattgtgtagaaaaaaaaaagccaagggtgagaggcctctgagggtccttgagactctaagctgatggcgggactattaaaaaaggggatagagagggatggtgtttgctctgcaggggcaggggaagagctcgctcacacgggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcttttcatattaatctctttgtttcctttgttcctttttttttttttttttttttttttgaggttgagtgtgtagcccacgctgcttcagacgcctgcccccacccacctctttcagtgatgggattacaagcacgccatgcttgaactaagctctgcttcaccccaggctcaaaagtctagtgttatcattgattgaactgtgatataaccactaagattattctagactaatagaggaaatagggaagtgtccacgagaagttagaaggcagggtataaaaaccaccaaggacaaaagccaggtgtggtaatgcatgttcataatcccaggaaatggggtggggtcgggaggcttagacaggaggtgcacaagttggaggccaatctgagctacatggcaaaactctgtctcaaataagtgaaacagaaacattaaaaaatggtcccaatttatatacatgtacatacatccatatatccattcagatcttttaaaaatacacttttataggcatatcagaaagactgggaaagaaccaattatgatatttgtggaaaggtaacgtgggtaattttagaatgctgttagggttttctcaacttttttttacaataaatataggctattttatgttcaacagagcaattacaaagaaaatagctctctttaagccctcaccattcttactctctagccctccttctctcttctctctttcctttttcctccctctctccacatggtcatggccagcctctctctctcccttctctctttctccctgcctttctacagtaaagctctaaaaccattaaaaaaaatagcttggagataattttcctgataatttcccagatattccagagagccagaccgtcaaggcttcatcttgtcttgtgtagtaagctactgagttagaagtcacagcccatgggaggcaaggagcgcccccatactgacggaatccctcctctccttcttttagtccttcctcccaaagtagagatggctaaaatgtaagtcaccagcaaactgtaagcaggacctagagagcagagaaagttctagaaggggaggggaggtactggacaagtctagagacctcggctgggtaggaatgtcagggcctggatggacctacaaccagctcttaacaacagacctaagcacacagccctccagagctcagctgggctgggcccacctctaccacaccctgtttacctgactatggaatgtgtttcattcaagaatgatgtctaatcctatgagccctcagtccctgcccgatctagtccaaccagctgaagttggagaacacgttttggcacaggggcgtgaggtggtatgcagggtagatgtcattggctctgacaagtcctcctctgccacccaatcagaggaacctgttgtaggaggcactgggcactcctttggaagagaggagtgggacataacatcagccccaggaaacatgggacaggtcgtatctaatggcatgacacccaaagtctgtaggaatggatctgtatttgtgacctatggggctttcccaacccaccttccccagttcccaccacaaattttctgtccctagcccttttcccatgtctaaaacttacttatgttttttttttctggcccccactagctctggccatatttcatatatgtgtgtacactgtcactgtcttcagacacaccagaagagggcatcaaatccccattacagatggttgtaagccaccatgtggtggctgggaattgaactcaggacctctgaaagagcagtcggtgctctgaaccactgagccatctctccagcccttacatatgcttctcataacttgattttcttgcttgagactatctgatgtgcatgtgtgtgtttgggtgcagatggaatccagagactcttgttca

SEQ ID NO: 1868 - DNA, 2849 bp, Mus musculus
tgttagagattgattttgcggagctaaccctggaggagatcatcggcattgggggctttgggaaagtttatcgtgctttctgggcgggcgatgaggtggccgtgaaggcagctcgtcacgaccctgatgaggacatcagccagaccatagagaacgttcgccaagaggccaagctctttgccatgctgaagcacccgaacatcattgcgctcagaggggtgtgcctgaaggaacccaacctctgcttggtcatggagtttgctcgtggagggcctctgaacagagtattgtctgggaagaggattcccccggacatcctggtgaactgggccgtgcagatcgccagagggatgaactatctacatgatgaggcgatcgtacccatcatccaccgagaccttaagtccagcaacatattgatcctgcagaaagtggagaatggagacctgagtaacaagattctgaagatcaccgactttgggctggcgcgggaatggcaccggaccaccaagatgagtgcggcgggaacatacgcttggatggcacctgaagtcatccgtgcttccatgttttccaaaggcagcgatgtgtggagctacggtgtactgctttgggagctgttgactggcgaggtgcccttccggggcattgatggcttagcagtggcttacggtgtggccatgaacaaactcgcccttcctatcccctctacatgtccagagccttttgccaaactcatggaagactgctggaatcccgacccccactcgcgcccatctttcacgagtatcctggaccagctaacgactatagaggagtccggtttctttgagatgcccaaggactccttccactgcctgcaggacgactggaaacatgagattcaggagatgtttgaccaactcagggccaaagaaaaggagctccgaacctgggaagaggagctgacccgggctgcgctccagcagaagaaccaggaggagctgctccggcgtagggagcaggagctggcggagcgggagatcgacatcctggagcgagagctcaatatcatcatccaccagctgtgccaggaaaagccccgggtgaagaaacgcaagggcaagttcaggaagagccggctgaagctcaaggacggcaaccgcatcagcctcccctccgatttccagcacaagttcacggtgcaggcctccccgaccatggataaaaggaagagtctgatcagcaaccggtcgagtcctcctgcaagccccaccatcatccctcgccttcgagccatccagttgacacctggtgaaagcagtaaaacctggggccggagctcagttgttccaaaagaggaaggggaggaggaggagaagagggccccaaagaagaagggccggacatggggaccaggaacacttgggcagaaagagctcacatcaggagatgaaggcctcaagtccctggtagatggatacaagcagtggtcatccagtgcccccaacctggggaagggcccaaggagtagccccgccctacctgggttcaccagccttatggagatagaggatgaggatagcgaaggcccaggaagcggagagaatcatcaacagcattcacccaaccagtcctacctctgtatcccgtttcctcgtggagaggatggggatggcccctctagtgatggagttcatgaggaacctaccccagtcaactcagctaccagtacccctcagctgacgccaaccaacagcctcaagcgcggtgggacccaccaccggcgctgtgaggtggctctgctcggatgtggagctgttctggcagccacaggcctagggtttgacttgctggaagctggcaagtgccagctgcttcccccagaggaacctgagccaccagcccgggaggagaagaagaggcgtgaaggtcttttccaaagggccagccgccctcgtcggagtaccagccccccctcccgaaagctcttcaagaaggaagagccaatgacgttgctaggagacccctctgcctccttgacactgctgtctctctcctccatctctgaatgcaactctacccgctccctactgcgctctgacagtgatgagatcgtggtgtatgaaatgccagtcagcccagttgaagctccacccctaacccaatgtacccacaaccccctggttaatgtccgagtggagcgcttcaagagagaccccaaccagtccttgactcccacccatgtcaccctcacagcccccacgcagcctagtggtcacaggcggactccttctgatggggctcttaagccaacagcagcccctgcagtactaggcagcaggagcccctccagcaatggaatgagtcccagtcctggaacaggcatgttgaaaactcccagtcccagccgagacccaggtgaatttccccgtctccctgaccccaatgtggtctttcccccaactccaaggcgctggaacacccagcgagactctaccttagagagacccaagaccctggagtttctgcctcgaccgcgtccttctgccaaccggcagcgactggacccttggtggtttgtgtctcccagccatgcccgcagcgcctccccagctaacagctccagcacagaaacacccagcaacctggactcctgctttgccagcagcagcagcactgtggaagagcggcctggacttccagccctgctccctttacaggcaggaccactgctccctgctgaacggacacttttggacctggatgctgaggggcagagccaggatagcactgtgcccctatgcagagctgagctgaatgcacacgggccttccccatatgagatccaacaggagttctggtcttag

SEQ ID NO: 1869 - protein, 948 aa, Mus musculus
LEIDFAELTLEEIIGIGGFGKVYRAFWAGDEVAVKAARHDPDEDISQTIENVRQEAKLFAMLKHPNIIALRGVCLKEPNLCLVMEFARGGPLNRVLSGKRIPPDILVNWAVQIARGMNYLHDEAIVPIIHRDLKSSNILILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTSILDQLTTIEESGFFEMPKDSFHCLQDDWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLISNRSSPPASPTIIPRLRAIQLTPGESSKTWGRSSVVPKEEGEEEEKRAPKKKGRTWGPGTLGQKELTSGDEGLKSLVDGYKQWSSSAPNLGKGPRSSPALPGFTSLMEIEDEDSEGPGSGENHQQHSPNQSYLCIPFPRGEDGDGPSSDGVHEEPTPVNSATSTPQLTPTNSLKRGGTHHRRCEVALLGCGAVLAATGLGFDLLEAGKCQLLPPEEPEPPAREEKKRREGLFQRASRPRRSTSPPSRKLFKKEEPMTLLGDPSASLTLLSLSSISECNSTRSLLRSDSDEIVVYEMPVSPVEAPPLTQCTHNPLVNVRVERFKRDPNQSLTPTHVTLTAPTQPSGHRRTPSDGALKPTAAPAVLGSRSPSSNGMSPSPGTGMLKTPSPSRDPGEFPRLPDPNVVFPPTPRRWNTQRDSTLERPKTLEFLPRPRPSANRQRLDPWWFVSPSHARSASPANSSSTETPSNLDSCFASSSSTVEERPGLPALLPLQAGPLLPAERTLLDLDAEGQSQDSTVPLCRAELNAHGPSPYEIQQEFWS

SEQ ID NO: 1870 - DNA, 98634 bp, Homo sapiens
caaagtcctcctttgacctgaaggaccccatgtgaacaggccaccctacctcttatagctcttactacccttgagtttgctatcttttcatgaatacacaggcattttcctgtcttagggcctttgcactaccatgcagtttgcctgaatgctcttcccctgtatctgtatgactggtttcctaaattctttcaggtgtttttactcaaaagtcaccttgttggccgggtgccatggctcacacctgtaatcccagcactttgggagaccaaggcaggtggatcacctgaggtcaggagttcaggaccagcctggccaacaaggtgaaaccctgtctctactaaaaatacaaaaattagctgggcatggtggcatgtgcctgtagtctcagctacgtggtggctgaggaaggaaaatcacttgaactggcaggcagaggttgcagtgagctgagatcatgacattgcactgcagcctgggccacagagtgagactctatctcaaaaaaaaaaaaaaaaaagtcaccagtcaccttatcaaggaggttttctctggccactcagaaaagtagcccctcctaacatttcgtatcccccttcccttttatttcttctttgcatttacccctctctaatctggtattatatattttagttgcttactttgtttcccccattagaacatgagctttatgaagggaagagatgaagggatttttgcaggaagggatttttgtttgctgtgttcactattttatctctagtgccttgaatggtgcctgacatgtagtagacacgtgtataaatatttggtgaataaacgaatgagtagaataaaaaacgaaggaccccaaattagcgcagaccttttagcaagtcacttatcctctctacacttcagtttctttgaatgtgaaattgagttttgcataagacagctccgtttccctccagctatgtgcagacatccctgagttaacttgaaaagctgggagcacaaagggtgaagatttgggttcaagccccagtaacatcacttgcctgagtcttagtttccacacttagttagcccacacaacaaattgaaagggctccacccagcgaccgcgaaggttattctagttcttaactagaaaaagcgtaattataaaaggaagaaggcgccatacccctcaataccacacggcggcgcaatggtccacctttgtctctaagagggcactgctgtgccaagtccgttatgaaacagccaccactaccgtgcaatgtgttattcagacaactgtgacggttgctcattcctcagatcttattggtttgtttaaataacaaaaatatttaaattgttactgttttagataagaaggcacaactctcaaaaccaaaacagagagcttacgtttgagttcagtcttgccaacgtgatttaaagaccaaggtttgccgggcgctgtggctcacgcctgtaatcccagcactttgggaggccgaggcgggcagatcagctgaggtcaagagttcgagaccacatggtgaaaccccgtctctactaaaaatagaaaaattagctgggtgtggtgggtgggcgcctgtaattccagccactcgggaggttgaggcaggacaatcgcttgaacctgggaaggcggaggttgcagtgagcggagatggcgccactgcactccagcctgggtgacagtgtgagcctccgtctcaataaataaataaatacagaccaaaacgtttgaaaagctaaagtctaaatccgtgtcaggtaaggggtgccacagccatgctaacttagtccacatatgtgtctgcacataaccaagaatttccctccatgaggtatgaggggtgaggagtaaagggactgtttggattccaagacttttgtttgcttggaagaagccgttaaagcgtctagcaaataaaaaagactgtgaacctaagcaagccgttaagtaacaggagtcattgtcattattgttacttattagtagtgtcatcctcagcttctgttttccttcctccaccatctctccaactaacaataatgattttagtttgaattttgtatttaaaaagataaaagtgattttgtagttctttattacaattacacaaatatcacatggttatttttgctgtaggaaaaagaaaagtaaaatgaaggtgacatagtttggccgtctgtccccgccccaatctcttgttgaattgtaatccccaatgtgggaggtggggcctggtgggaggcgattggatcatgggggcggatttttcatgcatggtttagcactatccccttggtgctgtcttcaggatagtgagttctcatgagatgtgattgtttaaaagggtgtggcacctcccccgttactctctctcttgttactgctttcgccatgtgacgtacctgctcctcgttgctttatgccaggattggaagcttcctgaggcctccctaaaatcagatgctgccatgcttcatgtaaaacttgaagaatcgcaagccaattaaacctctttcctttataaattaccttttctcaggtatttcttttttatttttatttttattttttttgagacagagtcttggtctgttacccaggctatctcagctcactgcaacctccgcctcctgggttcaaacgattctcctgcctcagcctccccagcagctggaactacaggcacgcaccaccttacctggctaatttttgtatttttagtagagacggggtttcaccatgttggccaggctggtctcgaactcctgacctcaggtgatccacccgccttggcctcccaaagtgccgggattataggcgtgagccaccgcgcctggccaggtatttcttcatagcaatgcaagaacagcctgacacagaaggcactaaaaattacccatgctccaccacttagctcagaaatagctgttaagatttttatattatccacccaacacatttgtaattatattttataaggatttttactactctttcatttatcattatactgtacacatttccacatcattaaaatttttcataattatcaacaataacatgtttttttataacctgtttaaaattgacaaaaagtgtatatatttatagtatacaacatgatgttttgacatatgtatgcactgtggcgtggttaaatcaagctaattaccatatgcttttcacatacttatttttttgtgtggtgagaacacttaaaatctactaccttagcaattttaaagtataaaatatattgttaactatattgaccatggtgtacaatagatctcttgaacttattccttttttctaactggtaaccatcattttcctctttttctatgagttcaacttttttagattccacaagatctgttccataagagagtgagagttcatgtgatatttgtccttctttgtctaacgtactattctaattagaaaatcagaatattttaatggtagaaaatattaaatagtataggacaaagaaaaaaaatcactcctaatctcataatctagattggtgataattgctgttcaccttttgatatatttctttcaataatattaatgcatatatatttttcacaagattaggaatgtattatatatatagttctcttaatttttcaaatttatttaaaaattatttgaaaattacaacagatagatttcttttttttttccacttaacatgattattttcccagtcatttcatgttcttcaaaaaccccgatgataggaataattttctctttcctgaaatctctcttcttgtgattggatctgtttgaggtcctggacggaaaggcttggacgaagtccttgcagactcagcatggttgtaagcagtataatttcagagggctgtcccatgggctcactctgcaaccaggctggatgaagcagaaatgatttgaccttcactccttaattaaaggctctgatcattgttaaaatgcaacttgctctccagagatgcaacattctaaacagccaccccccccatagtttattgcttttctgaactgaggttttcctaaaagaggaaagatttcttacctttttggtggttcaagctacattaactcataattcctcatagaggaattaaatactatcaactgtaataacatttacaatttattaagcacttattattatgtattaggcactgccaggaggacctcttacttcatctaaccttcacagcaaccccattttatacaatctcatgttaccaacaatgaaacagaggctcagagaggtgaaaggcctcccacagtcatgacaagttgatcaagacttgtctgggtctgactccacaggtctgttccatcagccctgccacatatctgcccaaaccatttgcctaaaatcatatttaatgcaaatggagtttatgaaacaggaactagggcttctttcctgaaatggtacacatgagaggtgaaagtggtgggctggctcttttagaaaaggtcaaaggggccaggcacggtggctcaaacctgtaatcccagcatttgaagagatggaggcaggaggatcacttgaggccaagagtttgaagccagcctgggcaacacagtgagtccttatctctaccaaaaattaacaaaatttgccaggtgtggtggcacgcacctgtagtcccagctactcaggatgctgaggcaggaggacccactgagtccaggagtttgaggctgccatgtgatcagtgagctatgatcgtgccactgctctccagcctgggtgacacagtgagaccttgtttctttaaaaaaaaaaaaaaaaaaaggtaaaagtctgcttgagggattttttttttttacatcaaagtactaattttaaatatttcccaaaagaatcaaggaaagggtgacattcattaactaagtcacggtttaggctcaaataataccagtaactacatgctagattatgtgttaagcacataacatatataagataggtacaattatccctaatttccaggtgagggatctggggcacagcagggttaacttgcctaatggcacacagtaagcatagattcaaactcagtcagaagccaagaccccaaattcttcaatagtctatgatgcctgccctctttcttcccttccctcctttctttccttccttttctcccctccctgcttccttcctgtttttctctttttcgtcctttctttctttccctctcctcctgccctccctccttccttcaccccttcctctcctctcctttctgttcctttttttttttttgagagagagggtctcgttttgttacccaggctagagtgcagtggagcaatctcagctcactacagcctcaacatctctgctcaagcgatcctcccatctcagcctcccaaaagctaggaccacaggcaccaccatgcctggctaatttttctattttgtagagatggggtttcaccatgttgcccaggctggtcttgaactcctcagctcaagtggtccacccatctcggcctcccagaggcctctgttcctttttccttccttccttctctctctttcctttagggaaaaccctgggttcaactttcagtcaagaggcctaggtgtaattaaagagtgtttcttgggggtaatgggcaggtgaaagaaggaaaaaaatatgttgactatttgctgggtgtgagcagcaagctaagagcttctgcatgtcctgtctcatttaatcctgtaaacatccattaaaaccaggtattattattacacctacttaaaattgaggaaactgaggttcaaactggtgtcttgcccaaagtcacagcatttttaaaggacaaagccaggataaaccatgatctgttgacttaagtctaatgccaacttgcatcttgattgctattttctcccttatgctatgcttttcagcgtggtagagaaaatgtttcttttttggggtgacatctgccaatcccctcctcaaaaacttcatagtggtaaaatcttggtaattccacctgactttcaaagtcttttacaatctgcccttcttttatttcatcagttttatttcccatcactccctttttgcattctctcctcttctctggatgaaatttctattattgctacccactacattaatttctatttccacatcttttattctctattaatcaggttgtacatatctttcaatgcccaacttaagcatctcctcatccattctagtcctcagggaaggcagtatttgatcaccccacagccctactcaaaacctttcagtgataatcttttacatgctgaacaaaaccaaggcttcttcgcctgggattcaagtcagccatccagttgcaaagaagtactgagagtcaattatgtgctaagcactctctaggtgctgggagagctgtggagaaccagacagactggttcctacccttatggtggatgcaccagacattaaataattacaaataatcaattacataattactagtgtgaatcaagtgattacagggccctctacagtctggtctcaacctatcttttcagttctttctcatccttctattccatccaaatggtcccctctccatgctttcctacgtctgtggctgtgcctattcccaccctcctttcctgaacacactcttccctgctccaccccattcccctccaggaccagttctggttctgcttcttccatgcaaccctgccagacaagtttagtctgaaagatctaccctcatttgaattcctagcacttacccattcaacaaatattaactgaatgacttgttgaaatgtttgatgaatgattctttatgagattctaaacacatgctatggtattaaaggtttaagttgcacagggaattagttttcctattgagaagaatcaatgatttttctcctctcttcccctcttcccagggagtgggaaggaatccacaaaactaaatagtagaacatacgaaattatggagaagcaaaatgacaataaacttacccaattactcataatccgactacttagagacccactactgacatttttctctttttagtactttttttcctgtttctgttttgctgtgtgtctacagtttgtaaaactttttttccctcaagttaaaaaaaattcttttttttgagacagggtcttgctttgtcaccagattggaatgtggtatagcaaacactgttcactacagccttgacctcctaggttcaagcaatcttcctgcctcagcctctcaaacagctgggactacaggcttgcaccaccatgcctggcaaattttaacattttttgtagagataggggtctcgccatgttgctcaggctggtctccttcctgggctcaagtgatcctcctgcctcagcctcccaaactgctgagatttcaggcacgagccaccatacccagtcctaagttaaaattttatcaagacaattattttcttatggcctttaaaaaaacacaatatacctccatccccactcccttgctctctgctgcttgacagtggaatggttttgtctaaaacaaaacctagataatttactcagactcatccatatcttttccagttcatggatcctatgtataataagaatctgagcattgttttaggtctttacttaaacagaaatcctttttcaagacctactctggatgctttttagaacaagcctcatctctcttcttcaagacctcaaatgtgtgctatgactatacagtgtagtcatattgatgagcgaaccacagaatgttcaaactatgaggacacaggatatcttccagttcactccccctcactttaagagtacagtgttaggacacctgcctgaagtcatgcagctgcctagttatctttccaaattgccccgctgtctttagtttgtgtaataataaaccccaaactaaaattcaacaaaagcactcacccttgctaaataaatcatgtctattcctaccactgaaggggaaaaggtaacaaagtttggtagaagttgggctagatccttcagcactggcttatttagaaatttcagaggactaggtgaggtggctaaggcctgtaatcctagcactttgggaggccgaggcaggtggatgacttcagcccagagttcaagacgagcctgtacttccagctactcgggagggtgaggtgggaggatggcttgagcctaggatgttgaggctgcagtgagccgagattgcgccactgcactctggcctggacaacaaactgagaccctggaagaaaagaaaagaaaagaaaggaaaagaaaagaaaagaaaagaaaagagaaaaaaagatcagagaacctttcttactggaagtcaacgttgccacgacaggattaaagcaagaagaaacattatgggcctcctatctcgtccttaatgttcaaaacgcagggtatagcaaagcatataggaagaggtcgtcctcactcgtgaactcagcatcgggttctacgtttattctgctttggttcttcttaatctgacctctatagacttcgccacgatccaaggtgtaattccaacaggcaaaagaagtctaaggattgtcgaaaaggtggctcccttcagacagaccaagcccaattcatggcagcgttcccagccccagtttgaagctcagtaaggtggtctcttgcctttctgaattctgaaaaaagagtggtattggaatctcttcttaccggaacccaggagagggcgagctgtggtgcagtcctcataaaggggagaactgtagttttcagagttctaatgaacatcccaatgggcctaaaaggcttcaataagagatgaaaggttccgggtgagagtgggcgtgggcgaagctgatccctctaggtcggactaaggcagagccagatccaagagggagaatccaactgtaaaagggatctggggaagaaagagctctgttgggggtgcagccggatgaagaacaccggtgctgctcagtgcagcccctacccatccatggcaaacaaaggcagctgcctcccttccagccttttagtttgaatgaaggctcagtattaccttttaggatccacccttcccttctcacgcacccaatgaggccggagcctcttcctgccgggaggtgctgaactctcccaggaaacggacaggtgccgcgagccaatggagggagctgcggcgggccagtgggcgggaagagtgggtcgacctgggtttgagaatgacagagcccgcaatgggggagggcacggtgcgacggcggcgcagggggtgagagggacctgcgagacggccagctaggctgccccaaccacggcggaggaaccggggactgggcggccgcagccaatgggaaggcagcgggcgcggggcggggcgggcgtggggcggagccccctggggtccgcagggctggggcggagccaggcccgcgtcaggtggtcccggcgagctggcggtgcggggggcggggcacggcacggcgcggagaggagagcggcggccggctggcagcggcgggcaccggctgcgcgagcaggtaccggcggcagaggtgacgaggccgcccccgggggggcgagcgggcaggcggggactcggcccgctgcgcccctaggctgcgcgaagagctcgcgctcggcgctcttctcgtaccgcggtaacagcgccggcgagccggctctcccagccctgccagcccgggccctacctgcggccgccgtcgttgggggggggtcctcccagctctgcggaggcgcatgaacaataggcggcggcggctcctgcgggcggcggcggccccgcaccctatggatcggccgctccatggagccctccagagcgcttctcggctgcctagcgagcgccgccgctgccgccccgccgggggaggatggagcaggggccggggccgaggaggaggaggaggaggaggaggaggcggcggcggcggtgggccccggggagctgggctgcgacgcgccgctgccctactggacggccgtgttcgagtacgaggcggcgggcgaggacgagctgaccctgcggctgggcgacgtggtggaggtgctgtccaaggactcgcaggtgtccggcgacgagggctggtggaccgggcagctgaaccagcgggtgggcatcttccccagcaactacgtgaccccgcgcagcgccttctccagccgctgccagcccggcggcgaggaccccagttgctacccgcccattcagtgtaaggcgaaggcggggccgggcggggagggggaatgacggaggcctggggggcggtcggggaaggggggagcactgcgcgagggctgggatgagggcggggggtggggaggacgattgacctgggtgtgggtggcgcgcgcttaggctgcccgggcttcgcttgctggataagctcgagacgcctcaggccctgcccgcacttcagacgcttgggcttcttcaccttcagttggccacctcagcagtggctcccgatttccacatcctgaagtcccagtctgagaatttgccagtttcccagtcccttctcttacccaccccccccgccgccccccattcccaatctggaagtgtttatggcaagatggtggttagtgtcctagccttagtccccaaatcagggaccttgccaccacctcttctaacgcctgtccccgcctcctaaaggcatttgctttcaaagagatgggggtgtctccgcagggctgagctggctcacaagtcccggaagcatgtgtgaactcaaggctcagttgcctgtaaaatgtcgggttgatttcttggatcctatttcttatatctcagaagttgtacctttaggagtctcactgattaatgtgctaagagggatgtgtgtgttgagagtgggggtgagacaagtgatgattagagaggaaaaagtatgtcgttcccccatgggagatcaggattgcaaggtacagtggctgaatcccagtcctttgacagtgaggctgtttgggaaatacattttcttctttcttctcattctagatccttgcctatatttggaactggtcaaatctcagggggaccatgctcaggggtccctcccagggcctttctcccagtgtcctggtttccgtcaattttccaggagccccttatttcataccctataatgaaatcttctttttttttcaagggagttaaattgccatcacaatcccttaatcatactagtttatttcagaaaaaaacatgtaaatatctctttagtgcagtttacactattttgtatttgagagtttccataatctcttatctgttaaaaaggtattgttaatatgtattaattactgtttattccttattttgtatactttcatcttagttgattttttaaaacgtcattagcaaggaccaactttaaatatttaaatattaagatttcctttgtaacagttacgtttttggctctgtaagttattttttaccccagcaattgtgttactttaatcttgagtttttttgtttttttgagacagtctcgttgtctcccaggttggagttcagtggtgcaatctcagctcactgcaacctctgcctcccgggttcaagcaattctcctgcctcagcctcctgagtagctgggattacaggcgcccgccaccatgcctggctaatttttgcatttttagtagagatgaggttcaccatattggccaaactggtctcgaactcctgacctcaagtgatccgcacgcctcggccttccaaagtgttggattacaggcgtgagccaccgtgtctggcctatctttagatgttttttaaaaactagcacataatatcaaaatcatagcctcttcgcttgtttttctgctcttctttttctgttggtgttttgactatcaaatcgatgttcaaatctttaggttccccctctccctctcattcagtttaaaacttcatttttcttcattttgatctttaaaatgcctggaggtagcaaattactttaaattgtttccagatactacatctttttgggactagtttggtagccttaaggctaagcatcctggcatagtgttttgaaagtgttgaaaatgaacttggtcatatattggaagaaatatgaatagcctggcatgttagaaaacagtgtcattttaaacataagtcagattttgattctgtgggtgaagttttgtgattttgttttcagggacagctaatgtcaaagcagaagagctaggtgaggttcgtgatcaggaactcggtttcttcaatatcttgtgctctggctgctagagcagtcaagagtcagtatgacttaggctgaaaaactgtccacagagctaggcatggcaacagcgtgctactttttcatttggtggccaggacttatcttcattgtcatacaagttatcttggatagagtggattcctaaatctggaacccagatgttgagaaagtaggaagtaacttgttctaatggaaagaattaacttgaagaatatggcatttgaaagacctgacacgttcttttatttggcctcactaggagttctgatcttgactagaattaatttttgataattcagaaaatttagtttcagtcaaaaactaattattgagtacctagtgagtgatagatactgtacactgtgttaagtaccaggacataaagaagtgataagatcagaagttgcttataagttacatgagggagattaagtatgtaaatataaaacttcagtgcagtgccttggttcatcagagggtgaacatgggcggtcattgaagtctatgtgctctaccagatcagtttgtgtcactcggaaagtgaagacgattgacaaaccttgtctccgaagacttggaatgaaattgagccactgacacttcatcgccagagttacccttttgaacttctcctctgagcatgtgttgtgacgttgcattctggaccatgaatagaagacattaagtcaagcaatactgttcagctttagtttcatattattgcttcttaaagtgaaaatttagcttcaaactttatttaaaagctttttttgtttttttaatttttagagacaggttttcactctgtcgcccaggctgaagtgcagtggcataatcatagctcattgcaaccttgaactcctgggctcaagagatcctcccaccccagcctcccaaagaagctgggaccagaggcgcatgccaccatgcccagccaattatttttatttacttttttaacagaggtgaggtcttgctttgttgcccaggctggtttcaaactcttggcttcaatcattcctcccacctcagccttccagagtgttgggattataggcataagccactgtatctggcctcaaactttattcaaaacagaaggggaaattactaaatattatgacaaagaaaacatataaaaatgatattataaatcattttacattcatataatgctttaatcctctccattgtaggtacttgttagagtttagctgtctatggatgacaagtataaataacccaggagctcatccatcgtctttattttagtgaaagatgaaaaatgtacagttccaaactcattatcttgggagatgcaatcctaggtattatatgaaagtttctctaacaagagagttgtttcagttttcaaacagggcatacattaaggttattagtttatgttttttattatctacatccactagaaatagaaggacatattttcagatgtacctaagatttttgagtgaagtatataacattcacttactcaaaacccaccaaaatatgcctaaacattcagtttccaagcatacgattgagagggaataacatcttgactttaaaaatggaagaactaaggatttattcctgatattcctggaaatatccttccacagaaactgaaaaatgtgctgaatgcagcttgacctgattcttacttaaaaccaggtcttgactggagcagggaagggaaggagagccccacatactctgctgcagctgaaggtctagttccttcgttcctatccacagggactgagcagggaaggaaaaagaaggtccttcctccctcccttctttctgggttctgtcttttatctgcttgaaagttgtgttctatacttttcttggagtcaggtcataatatttgcttaactaaatagcaagaacctgagatttttatgttctactcaaagagaggttattgctttcccttccctgcagaggtttttagaggagctgtcctttcagcaccctagtactgaatcatgtcttttaaacctccctgcatttattttttcaatccctcctgcatttaaatgaatatttaacacctactgtgtgtttacaactatgcttaagactggaggaaagaagggagggtacaagagaaagtacaatagttaaaattcccttaaggagaattcagatactcagttgaggaaataagaaaacagatacaaatttgttaagtaatcacacatcttttcatatgtgtaaaagctgctagaaaaacatgaatgttcctccctccatgaccaggaagactcttaacatgtatttctccaagagagtttctaatctttctttataacataggcatatttttctcattcatatagatgacatcaggcacaagttagtaatcagtctggattcattctggggctcagaaactctcaagctattttgagcaagaaagagatttagcacaggaaattctgtgcttgcagaattgttggaagggctgagagaagaggctctcagctggacctatgtgaacaactcccagaacatagcagaactggcccaccaggtcagctgctacttctctaattgggaacatacagaatcaggagctgccattgaagctgttggcttcaaaaacaccctgttgtgtctgcagcccagagattaggcaaccacttggctatgaaacattcctctccacatctacagacttagtgattggacaccaacatgctgatgcaaaaaatccctgcagcaagaacatggtcttcatctcacttctgcctttcaaatattgtgcatctaattggcagaatttaatctgcattcagaactttagctgtaaaggagtctgggaaatgtagtttttagcttcctagcctctgtagtactgaaatttgtgctagaaggattatggaatggatgccgattgctagtctacaatgttctgccatgacattcattcttcaggaagattgctggataaggtgataacctctttaaacagttggaattttgaggtcaggatgggctatactttttgtatatctaaagactatccactaacatccacctaagagtttcctttgtgcagactgccagttgcattacaaaatacagatgggctaacctcagatgggatagaggtgctataattaagcaagaacagattttttagcaccaccagcatctgagtggagaacggaggcgttacagggctggctgagtaaggaagggaatagtcagcagtggcagttcctcttttggtcttgccaaaagttcagaaatgtatctttgttttcttagttttttttttttcagtgaagtgtgattattttctgtatttgtttcagaaggtctagttccagttcagtttttttttttttttttttttttttaagatctgaatttggtttatttcctcctgagatagtgtgttagtccattcctgcattgctatgaaggaatacctgaggctgggtaatttataaagaaaaaaagtttaactggctcacggttctgcagcctgtacgggaagcatggcaccagcatctgcttggctctggtgaggcctcagggagcttttattcatggcggaaggtgaagtgggagcaggcatgtcacgtggtgggagccaggagcaagagagaaaaaccagataggtgtcacactcttttaaacaaccagatcttgtgtgaattcgagcaagaactcactcattactgtgaggagggtgccaagccattcatgggggatcggccctcatgacccaaacacctcccaccaggccccaccgccagcactggggcttacatttcaacatgaaaatcagagggttcaaatatccaaaccatatcaagtagattttttttccattttatttcaaggatctcttggttacctacaaaatgtttggcatggcaagtgcagtggtgaatagggcagacagaatctctgcccttgtgggtctcataatctggcctggacaataggcattgaacaagtaattaagtaattataatcttgatgcctcttgtggaatggaaactgccatggaagtgtttgataggggcctgacctcatttggtcttggtgatggagaagttccactatgaaactgatatttaagacctgaggtatgagtatgaatcagccaggtaaagacaaaagaaaaaagaagatagagaacagggtttcatgcaagaaacaaaacacactttgctcatatagcacttagcaccacatgtagctcgctttataatcactggcagctattattatctacccatgaaagcctttccacacacaacaaaatatataatcaagtaccttaggttcaaattctggatttgggaaggagaatgattggttgggatactgggtgggatactgggatcatcagggcttgaactgaggcacagatgactgctggagtaagatatctcttatgaggctcctttcccatgtttcagtctccaggtccaggtagaaccaagttctgaaagtctcccaaattgactgcgtactccctatattcactgctgctgaggttcagacctctgagctgcaaggcctccttagggggtccttttgctgttgggtctgtgtcctccaggttagtttccagtggctgccagagttgatttcctttctaaattacaggtctaacaacattccttttctgaaagatacatgactcctcttgtttacaatgtgatgttcaagcccctcagaatggctttaaagacatttcctggcctggttaccctcaacaaggctttgagcctcgtctccaatcctgatgcacatgacctggccacagcagactccctggaggtcctaatataccgtatacttcgtactccatgttcttggctcctgtccttccgtctgcctgattgtccttccctgccctgatttccttcatcgcctgagatctctcccactcactctttagggccaatttcaaatgttgccttccctgagaatcctttccccactcacccccttagtgctctgtgctgctgtgggagctagtgattttcctaagcctctaatcatacttctgcagaagctcttctcatcctatggtttggttgttgggtgtctgccttggcactgagttgggtgcttctcaccactgagtacacagtaaagctgagtaagtctcaaagaaaggatctcggccaggtgcagtggctcatgcctgtaatcccagcactttgggaggccgaggctggaggattgcttgagctcaggcattcaagaccagcctgggcaacatggcaaaaccccatctctatatttaaatgtattttaaaggaagaaagaaaagaaaaaaaaggacctctcccatattccctttagtgacaatagttggttttggtacaggattctgcatgattttccaggtgggattttttttcatgaatgtttatagaatgcctaccatgtggtgactgtcactaaggaaaatgcaaaggaaaataagttgattgcagttcctgcccttatggaatttgctttataatggggagacagaaaggcccagtaaacagacaacttgccgtgtttacccactcaggtaaatgaaaggttaaatacgatgttttcaagatgtttttgacttgcttctttttttcttccctttctcagtgttagaaattgattttgcggagctcaccttggaagagattattggcatcgggggctttgggaaggtctatcgtgctttctggataggggatgaggttgctgtgaaagcagctcgccacgaccctgatgaggacatcagccagaccatagagaatgttcgccaagaggccaagctcttcgccatgctgaagcaccccaacatcattgccctaagaggggtatgtctgaaggagcccaacctctgcttggtcatggagtttgctcgtggaggacctttgaatagagtgttatctgggaaaaggattcccccagacatcctggtgaattgggctgtgcagattgccagagggatgaactacttacatgatgaggcaattgttcccatcatccaccgcgaccttaagtccagcaacagtgagtatgaagagatggggctggaggggctcagagcagttgcagttgtatcccacgacgtcagtaggagtggacttctaatggaaccttagagggcagtgaaactccttgcttaaacacattccatccttgaatggagatgtaggaggtgagatgagtgccaagaaagattggtttaggaagagaggaaagaggcgcctgaggagtttgggataattttgagcttttttttttagcagtctagagtggccttccctactatttttccacatatcagaatgtgtaattctgatatgctgtgcacaaaacttgtgggaagtgtgaatattatcacaaaagggattttcctctttgtggaacaagaggtagagcaagcctttattatctgtttgaatgtttacctaaacacctcaacttgagatacccatcacagaagggactgtaagaagagaatgctattctttaaactgtgagctgattcaggtggtgatgtccatttggagagcatgacttcctggtaatatcaccaacctcctggtagcccaagggtggtattaattaaatgccataattacctagtgtttaatagcagggaactgagaagtaactctttattaaatatccagaatccataaactggatttaaagcaagtgttaaatattaaatggtgagttggtagaagctccagtccttcacgttggctgactcagcagggctaggaatacgcttcttttctgtggtagtttgtgctctctcttgcctaaactgggtggtaaagaggacacaattgcataatggtatgtacttaaaatcacttggagcatcctgtcccagagaggagggcatttgagttgaaggactttgggtgggggaagcatgggcccccagggacttcactctctttgcatccttcagctttgagcctggaaatccttcagactttgttttgctccaggctgttccagatgtggtttatttttctgttgatactatggtgaatctgtttactttaaaaactacattttaaggccaggcgcggtggctcacgcctgtaatcccagcactttgggaggccaaggcgggcagatcatgaggtcaggagatcgagaccatcctggctaacacggtgaaaccccgtctccactaaaaatacaaaaaattagccggacatggtggcgggagcctgtagtcccagctactcgggaggctgaggcaggagaatggtgtgaacccgggaggtggagcttgcagtgagccgagattgtgcctctgcactccagcctgggtgacagagcgagactccatctcaaaaaaacaaacaaaaaaactacattttaaaattatgtaagtagtggcggggtgcagtggctcatgtctgtaatcccagcactttggggaagctgaggcttgagggggaagaggattgcttgagcccaggagtttgagaccagcctgggcaacatagcgagaccccatctcttaaaaaaaattatgtaagtagtaagtgtctattgtagaaaattagaaagtgcagctaaaaagaagaggaagttaacctataatgtttccctttagagagaacaactattacatttggcatatccttcccgacatttttaaagcgtatctggtttatgcatatacaaatatacatttatcttttctacctgtgttcttttcccccttaataatagaaaaactccttcttgtaagggtatggaacattagatatgtattttagatatgatgcatgtgaagtatttaagttacgtaaaaaatctggtttctctttttccctttgccattttcctgtctctttatcatgatgattttcatccccgccccacccccactcaaattctattctttaaataaattaaaacttttgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggtgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaacttttggtgacctcttttcaaagtaatttctacctagagattgcttatattgctggaaaatgtgatggagaagctgaattttctttattttactttttctaatatttttatcatgttgagagaagtaggcaaagtactgtaaagttacataattgaacccatttagaaagttgggctaggataacaaagttgtaaaagttaatagtttacttgatgaagttttgaatttgagtataattttaagctcttcatacacgtttttacctcttatgagatttgtatttaggagtggaggctcttatgcaggaaaagttaccctgttaaggttctgctgtttgtaggagagggcaagagacctgagtgtcattctgttattcaggagacaaaactctggtcctttctttttccttatgtgggttttaggattgccaaggggagccatcaggattgcagaagttgtataatacttaaacattcggcagtattttaaaggacattctcaatacagttgctgcccagtaatgtttatggtccattggactgcatggttggcgctgatgttgatgctagttgtaaatcttacatgtgtggtggggtagcactttgacgtttgtctgtgggtggatgtttgccaaggattgtatacgtctaatatgagcctcgatgataccaccattcttactccattgcaatgtgtacatgacttgaaaatgattgtattttatttatttattttttttagagacagggtctcactttgtcacccgggctggagtgcagtggtgtgatctttgcaaccgccgcctcccaggttcaagtaattctcctgcctcggcctcctgagtagctgggattacaggagactgccaccacacctggctaatttttgtatttttagtagaggtggggtttcgccatgttggccagcctggtctcgaactcctgacctcaggtgatccacctgcctcagtctctcaaagttctgggactacaggcgtgagccagtgcaccaagcctttttttaaaaaattttattattattattattattattttaatagagatgggagtcttgctttgtggcccaggcttaaaattatcttagaagtgttatgccacttctttgcccattgcctccagcttgggagccataacttctttgtattttatagacttgggaacactggtttgttttccttgctttgttaagggttccagagaattggattttggtcattgtcatgtgagggcagaatactaggaattatatgtgttagttgactttgaccattcgagaaaagagtatgtatacacaggagctgtctttgtgggaaagagaaagcagttgatgataaacccctagctgttagaaaggttcagtaaaaagtgtcttattaaaatgttttattatcttggtcatctactttaaaaagtcatttgcagtttactggcagtgaaacgcgtaatggcatatagtatcctatgttgatacagaatctgcattgagtttagattgaccgtacgtagcccgaaaagccaaaccaaataacagcggctaaacaaggtctacactgacttgtctttgaaaagaagcccggaggattttagggcagctccatattgtcatctgggacccaggctcctatttttcactccctcatcccagtacttggcttccatcctcattgtcaccctgtggtccagatggctgctggactgccagttatgaggtccaagtcacaggcctgaaggatgaggggaagcagaagcacagaaaaggtgccccatgtggctgagttggctcccattaatctcccggaagtccagcatggcgtatgtgcttgtgttaattggacagagtgtggtcgcctggccatcactcgctggagaggagacagggagatggaggcttttatgctgggtgtcattgaacccagctgagaatcaggatctgttatcaaggaagggcattgccgctaaggaattggcagctagcagtcttaccatggaatcttaatgcaggacatgcatcggtatgaactgttacctcagatgtctagcatcatacagccaaacaagtttagccaggccctgggacgtgtggctcagacccctggcttaactactggtttatactactttaccacatcacatcattaacttaagcatcacgccctaaaactacttgtaaaaagcctctggctataaaaatggatttatgtgtctcttctccatcaaattggggaaaaccagttacatgatagttagcaaacacgttgttgaaagatggtcttaaatggaaaggttgtccttttgggggcaggtagatgacttcaggattttgtatagtaggtggcttggtgtaacggcattgggcagaagagcagtttaatagtggccattaaaagttatataagtggccaggtgtggtggctcacgcctgtaatcccagcactttgggaggctgagggaggaggatcacccgaggtcgggagttcaagaccagtctggccaacatggtgaaaccccatctctactaaaatacaaaaattagcctggggtggtggtgggcgcctgtaatcccagctactcgggaggctgaggcagaatcatttgaacccgggaggcagagattgcggtgagctaagattgtgccactgcactccagcctgggtgacagagacagactctgttaaaaaaaaaaaagaaaaaagaatgaaaaaagttaaataagtaaagatatcaatattcaagtaatatgaaaaagctttggaaagtaaaaacattgaaagtgaaggtattctcattacttttatattcatattaaataactctttccttctcttagaaaatgcagaaaagggctgggcacagtggcttaagcctgtaatcccagcactttgggaggctgaggtgggcggatctcttgagcctaggagtttgagaccagcctaggcaacacaacaaaatcccatctctgcaaaaaatacaataaaatctagctgggtgtggtggtgcatgcctgtggacccaactacttgggaggctgaggtgggaggatcgcttgagcctggaaagttgaggctgcagtgagcagtgattgtaacattgcactccatcctgggcgacagagtgagactctatctcaaaaaaaataaataaataaaagaaaaagagaggctgggcatggtggctcacgcctgtaatcccagcactttgggaggctgaggtgggcagatcacgaggtcaggagttcgagaccagcctggccatcatagtgaaaccccatctctactaagaacaaacaaaaaaaatagccgaacgtggtggcatgcgcctgtagtcccagctactcaggaagctgaggcaagagaatcacttgaacccgggaggcggaggttgtggtgagccaagattgagccactgcactccagcccgggcaacagagtgagtctctatctcaaaaaaaaaaaaaaaaaaaaaaaaaaaaaaaaggaaaagaaaaagaggctggtcacggtggctcattcttgtaatcctagcacattgggaggccgagacaggtggatcatgaggtcaggagatcgagaccatcctggctaacacagtgaaaccccgtctctactaaaaatacaaaaagctagccgggcatggtggtacgtgcctgtagttcaagctacttgggaggctgaagcaggagaattgtttgaacccaggagacagaagttgcagtgagccgagatcgcatcactgcactccagcctgggtgacagagtgagacaacatcttggaaaaaaaaaagaaaaaagaaaagaaaaagaaaacggaaaaacaggggtaaaaacactgtgtgtttttccagtttttctgtgcatttttgcatgtttatttttacccctagataatagcctaacaaaaatattgcttgtagcatgtgtttctcctccctctgtcagtgtgttgtcagcttgtggccctaatcactacactcttgcctgcacactcctgttggacagctggggtatttcattgttgttctgtgtggcctagtgctttagtttcatataattgggaataacgtcgttctgctcacaaggccacagcatccactttgcattaatgtttgatttatcccctgcctgtaccttctttgggtttcaaccaactcattcttaactttatagctgaaagagcagaggtgagtggtgaactgtatttggtttggggctaggcacacctgtcttcctcttttcagatgtcagcttaaatgatcatgagatctttgctgccttctcttcttctagaggcactttcttctttagccaagctggtctcccctttcctccttgctggcaggggtgccctcgcctcatctctctgcctgtccaacccttccgcagttttctgtgctcagttcaaacctggctgcttctggtagcccatcacatatccttgctgtagtcagtgctaagtcatcatttgatgaatgtgtactacctggtagttcgtagaagaatattggagtgacaagagactagaacccctggtctaatggctgcaagttcaactgccatccagccagggtgagtcagtttaaagcactggtaggcattcataggccataacgaaacaaaacactgtgctggcctgtaagccaacctgccaagttacacaacctggcctctttttttggctatgatttcaggagcatcccttacatctccaaataggttttgtgtctttagctcccagcatagttccaggtgcatagtagggtcctcaataaatgtatagataaaaggaatgaatgaatgaatgaatgaatgaatgaaatatcatgtgaactggtttacttacgtgatcccaaaatgtaaatgttccctttctcttacccatgggtgtcattcagacctcacttgtgtggaattatttatttatttatttattttattttttatttagtagagacagggtctcgccgtgttgcccaggctggtcttgaactcctgggctcaagcaatccacctgctttggtctcccaaactgttggaattacaggcgtgagccaccaggcccggccatatggaatttgcttttcatcctcgttagagtcccctggcccttgatccatcttaattgtctgagcccaaccacctgttttggatgctggagtgtggtgttgtgacagtacattcgttattaatcccaaacgcctctgcctcctcccctcttcacacttttcctgatcaccagccctggctaactcactggcccacgtctccactgtagccagttgccggctgctaggagctgctggagcagaccactgcccggtgctgtcgggtctactcccagtctgttctgtccaacctcagtactccctttgttcccaacttggggactgcctgtcacgctcctcatggtgcctgttccagttttgttgaattgttggattggctgctcctgttggaactggaggtccatgtagcatctccctctccaaattctgttcacttgcaccttgtcctcatctccaaccttctcttggagttcacaaggtcaggaagctgaagacatgctttcaccagtgtgaggatgatagagattttgtcttcccattggcctcagctcagcaggctctaacattctaagccctggagtatacctggaccacacactagccaaagctcctgactggttttcctgtgtgggatttctcatggctggtgagtttgctggctgccagacctgtggcaccctgggacccactggatcccagtctctagtgtcgtcctgcacgcatggtagagcccattctgcctgatggaggaagcagctaaggctcaggcaccctggtcagggatgatgtggcattagacttgcctcgaaaaaggatgaggagtagctgtaaaagcagttttttcctacaagagaatgaaataggcaggaaaacattcccagagtggacctggaaggcagtgaagtatcatctggaaaacccaagtcttggtcctttttgagaggtaagtaaatgactttttgtatgcttcatggaggcctctccaaatgaaatacttctggcattacctggctcaggtacttctgaatttcactccctgtttttttccttagtcaggtcctttggtggtttttgccacatgttccttcttaacagagagttggaggatgatggatgtgttttgaggattttcccaggcaaaagtgtacaagcgctcagagaattggatttatcttttggttgcaggaggctatgccagaggttagctagcagccacctggcgtgtctcagagcatcctgttcagttgatgggtagcgtttcctatgaatacagagatatgttctgcaagccaaaataaatacgtaagtgaataaagctgaaatgaagcaaataaccagccgggtgaacaggactcagcagaagaaaccattgaggccggagatctgacttgcaagtcctgttgcatctttcagttcttgaacgtggtttgggaaccttgcctttcccttttgtcctgtgcctttgtggccatctcctgcacaaagttggttttcttttatgggccagtctaagtcctggtgttaagaatacagcaggaaacaaaaaagacacaggccctcctctccaggagctccctgtggggtcagggggaaagaccttgatcaaaataaagtggcacaaaatgtaaagtcaagactgtggtgagtaccatgagcatggctgataacgggacatgcctcgagaggagtgctggagaattctctgaggaagttttgtttccgacgtgatctgagagaggcaagagtggagacaaagtggaaagggaaggtggggcaaggaggttccaggcagtgaggccagcaggcccagtgccccgtacagtgtggcctcctgggaggcaaattgcgtgcttggattctcttgcctccatcctttcctgtggttggtggagaaggattcgtaaggggaatggatctctttgtgggccacgtgccttcatttcccagcggttgctctagagttctgcctgcctcttcttcctatttcatcaccgtggaggttctctgcagcttactcagtggggcagcaagtagctcaggacaccaggcaacttttaagctctcataatgctgtgctggagttggagcagaagcttgtgctgtatgaagggccttggttggggtttctggaccatgagcttttagttgcagaaaacagccttggtgaggggttgagttcagggcaagaaaggctttgaaaggcgtgtggggtctgatttccagatgagtatttagtctcttcctctttgatctgtttcctctgatttgagccactattgccttgaaagtaagtaatacattttattgtatcttcccttccccacatccctcccaaccaaacctggtaagagctaggtattgaccacagtttgcgggtggtctgtggcaccgtcattgttcaggttcaagatttgtccttcaggatctctgaggagatgagagaagagcctgcctatttctcctttcctcctcatctcttggaaaaatttccattccttaacctggttcttcaccttgtttcgatgatgtagctcagggtcacttatggatggcacacaaagcagtgatgtcagtggtctggttgagtcaggagaaaaatgtagcttctatcccaggtccagggagcccaggtctttactgtggagtccccttcaatacccctgacagcctcttgtagaaccacactttgttcctcttataatgtaaagattaacatagggccagggaaccacgcaaaatggttccatgcaaaatgtggatacattcattttggagggaaaaggtcagggctcttattattgtaagactcagagaaggttatgaatcaatatcattacagataacttaaattgggcatctgtgtaagaggtgttctggtgcagtggaaagaacgtgggccccagggctgtccttgacactgactggccgggtggccttgggcacgtctgtgatctctctggacctcagattcttcatctgcaaaatgaggggtttggacaggtggtctctgaggtcctgcccaggacttaaagcatgaatgtctgtgtatttgggaatgttagtgactacacggtttgtctgcctgtgcatgtcaggctgctatgtgctcaggttccccacttcggggcttgttctggcttgggctgaatctactgaaagggaatctttgctgagtggtttagtggagaaaacagttgacaggagcccacaagtggtccccttcccccactgctgctcagggcatgacagatggccttgctgagagaagatgctctggtcacatgaaccatcctggagattcacaataatccaaggacagccttcctcctagaagcaggacacagttagtcgcctgctactctgtccttggagctaagcaaggggcatcctggtgtctcggagctttgctgctgctttgatttacacttgcttcctgctcacttttttgaaacaacatagggcttttccaggtggggctcaaggtcacttaggcgactttaattgtgtgcctcatatatccccactgacctgcagaataacaggaagaacatgtcccctgtgtgatccactatactgtaagagtgagacatatacattagacatattaaaagctgtgggttgcatgtccctttccctcctaacttccctaaagtttttgctctctataggaaacttgaaggttttgatctgagaagaaaacattttccccttaagattggttttgggaaccaccgtggtctaatggaagaaacaccgccttgggagttagatagacttggatttaagctacttcttgagcacttgacattgggcacgtggccaacctcttggagtcacaggaaatctcatccgtaaaatatgaacaacacagaaatgagcagtactgttttaagatgatatgagctattatgtgtcagtatcacacaggcactgcattcagtaaatggcactgtgctttttttcctttctaaggagtaggagaaacttctttccattccttgttattttagttgcacacaggatatggctgaatttccctttttaaagtggtgcaagaggattttaggcagccctgagtagccctctcctaagccagccaggcatagttttactattcccaccgaaacaggcagatttaattctgctgaagcccctgaaagggattgagccccaccagccccttctaactgtgcaaaagcctcttgtggaaacggcccgtgcgtcttgaaccctctggactcagccttaactcgaagtgcttggtcctctgaaaaatgcagcctcgtcctgtctgttacagcctttggcttgattgaatgggacagctggccagttttatggctctgctggactctcagttgataattaaaatgcttttgccccaggaggaaggcaatatatttatttccctcccttctctgctgcattagtctgcttttttcacatcttctcctggcctccctatgtcaacttagctttcttgttacacagtgtcatttaagactctggagtattcagggtggattgaagagattttattttgagttttgtggtcttgttttggaaggtaaacggagcatgtctggccctttttcatctctgtataagagctttgtttcctacagctactctctaaatctggttgtgtccagcacttagtaggtccttaagaaatgtttatagttttgataatcacagattctagcactgtgtctttcccatacatacctccttcccgcatagacattctccaaacaacaccacacctcttctcctttagagccctcatttaggatgtgaaccctctcttcttttggggatgagcccatgtgaactgtgggtgaaactggatttgagtcttacctggctctgttacttgctagctaaggaccttgagcaaatgatacaccctctgtggcttagcttttgcagatgtaaagcgggaataatgataataccaccgatctcatcttacggggtagaagtgaggattaaataagatcatctaggtgaagttcttaggagtgcctggcacgtaataagcacccagtatattgaccattttaattataattccatctgctacacttattcccttagtatttagatcacaattggtgattatatttttgggtggtatcttttgtcttgtacttgcattttcattgttttagtcatattctttccagttgtactgtagaatttaaaaaattcaaaatgtagtggatacacatgggtaaaaataggacaaaattgaaatacaaagaaaagtctgtctccagaaaaagagagagaaaaaagaaaagtctctgtccttccctcccaaaccctaagtttacttcttagaggcaaatgcgattaagtatctttttgtctctgataactttttttctatgaaaacatagaaatcccaatagaattcttgacagcagaggtgttgctgtttttcatcccttcgtcttcccttgctccccccatctctgtctcccctcacatcatccctagtataggacttcgcatgtagcagcccaggtgtttggtggcaattccaatgtggccaaccaaaaaatcttgttttgtttgtgtgtttttttttgtccctagttcctttctggatggactcaaaacacttttactgaatgagctttgtttgttctcttcaagcctttgcttttatatatctatttcataaacttctcaggggcttgggaccctagaggaaggtgttccttggagtagcttgtaaagtcagaagcccaatgtgtgtctttggaattgcccagctgtgaaggtactgactgtccatccatcccttggagcaggtttgggagtggggcccattgcagcaggtgggcatcaggatgctggcaatgaccgatctttttttttttttttttgagacagagtcttgtactgttgcccgagctggtgtgcagtggtgccatctcggcttgctgcaacctctgcctctgaggttcaagtgattctcctgcctcagcctcccgagtagctaggattacaggtgcccgccaccacacccagctagttttttgtatttttagtagagacggggtttcactatgttggccaggctggtctcaaactcctgaccttgtgatccgcccgtcttggcctcccaaagtgctaggattacaggtgtgagccactgcgcccagccagtgactgatcttatagttaagatctttctctgcaaatccttgtgactgcaagctgatgtggcttatgaggcaatataacaggaaaaagtatcattgaaaaaggaaaaaaaaatagttatgctagattccagtgtgcagatacaactgttttcatctttatatttggctttcctattcttatctatatacctcatctcctcctgctgttttattcacggtgtacatgccatctggacacttaaaatttgtttttgtttctgcattctgttaaccttcagggtccaagaggaaggaggatgccttaatcagtgagtaccaagaaaaaccaaaaaactaaaaataaaaacaataaataagaggaaggagaaaaggactgtgggtagggaaaatagcgatagattttggattctggtcattcttgactttcttttttgcttatagatatgattagagcttactggaaccttacagttgtgaactagagaagctgagtgacttgcctaaggtcatcctgatgctcatgatagtgttccttcttttagcccgacaatggaacactgttactctgccaggctttccagctaggaccaaagtatttcagacaacagtggaaacaggatctgtaccccattcgaggaaccagggggacaatttccttgtaaggtcccaaggtcaaagtttggggtgaagtcagtgtttttcctggttactaacatgaactcggtctttggtatgttatgtagaaggataacagtgttcagtattcttctaggtggtacaatttttaggaagaaaagaataataaaaacattttttatttcttaagcagtagactcctggctccctgtgcttagagataggaatccccgctgagagatagatgggaatcctggagtggattgttaataatctccctgttattggcacagttgtgtgatagagagttgttttcccctctcccctgccttaggagacctacccttactaagtatttggattaaattaataataaaatagcttgctttgcccaaatgcacagcagctagtgacaaggggagatgccacatcacatcccatggatggcaatggaaaatcaactaaggacgtaaaattttcccacataagcttcagatgacttaagattattagtgtaacctgatattatctgatactctccttggcttattattcatggtgacagtaatacatggccctcatttccttcatcccccaaatagtcctagaggtagtagaaagagtatggtagtcccctcttatctgccatttcactctccctgtttttagttactcatagtcaactgtggtccagaaatattacatggaacattctagaaataacgattcataagttttaaattgcacaccattctgagtagcgcaatgaagtctcacgccttcccaccccttcttgtgtgggatgtgaatcacatcctgtccagcatgtccacactgggtgtactacctgcccattagtcatccacatggtctgtcctgacatccaaccattgacattgtcacaactcaatgatcccgggtcatccaaagcagacgatcctctgactacacatcagaaggttgggagtaccaaacactgtgtcactgtgtcacctcgcctatgtcatctaccgcgcacttcatctcatcacgtacccattttttcatctcataacgtcacaagaagggcgaatacagtacaacaagatcttttcagagagagagagaaaccacattaataaaacttttcttatagtatagttgttctattttattgttagtgttaatctcttactgtgcctaatttataaattaaactttatcataggtatgaatgtataggaaaaaacagtatatacagggttctatccatggattggggcatccactggggatcctggaatgtgtcccctgaagataaggagggactcctgtaatcatgctttgtatttggtcctttagaattttatttgaaacagtatctacctgaggtactccaggaagaggtggtagtatccccattttataacagaggaagctgaggctcagggaggtttaacaatgccctgcccaagaacacatagctagagaatgatagggcctggactcaaataccaggctcttgagtgcttgcatggttttctttctgctctgcttgttggaaacagactgcaataggagatccttctctagcaccttgttctgcaggacggaccctgtgactcaccagagtctgggtgcaacagggctagacctggacattaaacctggtcttggggactttgtggggtagatcatccccacatttcgaactacagataggggatcctttatttctccaacccaggacctctggtacctccagacctgatggtcctaaaatgcacaagacctgagagctagtttctcatttctcttttccccagggcccctccaaaagcacaatttgaacctcagccatccttctgtagcctcaggtttgcttcttcttccatctcactcactgtgtctcccaggctggagtacagtggcctccacttcccgggttcgagcagttctcctgcatcagcctcctgagtagctgggattactgacgcctgccaccacacctggctaatttttgtattttcagtagagatggggtttcaacatattggccaggctggtcttgaactcctgtcctcaagtgatctgcccacctcggcctcccaaagttgtgggattacaggcatgagccactgtgctcggcttcagctttgcttcttgttagtgtttgtcctgaaccaaaattgtgcttgcatacagctgtccagaagttgggccatcgcagaagcttccatgttattgggctcttgtacttacttgtgtttgtgttgtggttttgttttttattttattttatttattttagtatttttttttgttttgagacggagttttgctcttgtttcccaggctggagtgcagtggcgcgatctcagcttgctgcagcctccacctcccgggttcaagcgattctcctgcctcagcctctcaagtagctgggattacaggcatgcaccaccatgcccagctagttttgtatttttagtagaggtgcaatttcaccatgttggtcaagctggtctcgaactcctgacttcaggctatctgcctgcctcggcctcccaaagtgctgggattacaggcgtgagccactgcgcctggccgtggtttgtttttgtttaaacaaaagaagtatatatagatttcagatacattcacagatgattgtttatggaatttaaaaaattttaaccagaaaagtaatataaacattcaaaaagggtttggacacgtctgttaattgcagagccctgtgtggttattcagatgccacgtctttcagctctgtgtagtctgggaggtgagcgggcctttctggggtgtttctttgcagctgaatttatggccaaatggaccatgcgtgagcaagagagcagttccattcctcctggaggagcgctgagcatgctttgtggtgcccacttaacacttttagatgaatactatgaaagacaaatttgacttcactgttcattccttgaagctccaatttggattgattgctggtggaataacacctggactatcaatgagtgaagcctcccggctatttccttcgcccacctcacaaagagaatttggattttgctgctcctggaactttagagctttgtgatgggaggaaaggggaggggacaaagagtgaatccttcaggagctcttttgggaggaattttgagcaggaaatgagggagcttctttctataaggacagtggatggaattaaaaaggggtatttgaggaagcgttgctgtggatcatatgaaacctttggatgctcaagaaaaataagagtcagactaatttgaatttactttaggatgccgtcttccttcccaccttaccgttgtttggacacagtactgtcctgggcttctaacatgtgagtctgtggctttatatgcttgactctagttgcatggaccatgaatctggccaattttaggtttcttacaagcattttgatgcttgatttgatgtgtagtatattggtggagagactgggataatgaccttccaggaagagtaaaagtgaccccactgaggaaaaataagatattctaagacttttccttacatgggcattcactgaaggcagagaacacggcatttgagcgttttcccagcagtttctgggtatgcctgttatgcccaccttccaggtagcagggaaggaaggaaaggactggctttcacctggaaactgaggtgtaacatctagagaatttgtatagttttgaattttccctaccatggtgagatcctcaactctgtctcatggggaacaggatttgtagagtaatattcagaggtagactaggaagatgctaggaagtctcatcttccccatgcaatggacatggaggtgggaggaaggaattagaaaagcatccatatcatagactgaaagacagtgagtcagagcaaagctagtcttggcctgaggaggtacttgaggttggttcctccctgctcttacatggagaggttgaaaagtgattcataggaaactttaattggtgtttcatagctttccagggctattaaggacttgtggttcacaatggcaactcccagtgtttcgagcctttgtggttgggacttccttgcctgcaaggtgatgggatgaaggtggtatctgtggtggcttgtaccgcttcctcctctgccctcaaatcctttctcctctgcaatgcctggggtgaagtgcaggtcacagagcctggagtgttttctttttgtatagatcatgattctcaaccgatgtgggtaattttattacccaaatgtcctcataagaaattgacgtgcctgctattgcatacatgctgtaagaaatacggtcaatttattatatacataacatagaggtcacttccactgcattctttccatccttaggagttgtgctatgtaaacacatcctaaacaaccagaacagtgtgatgtagtagggggcagcgtgtcaagatacatgagatggggtctggagaaggcagaattccctgggaggccttgatggaacaattaggcctcaaagaaggggtaggattcaagagttggtaatagggcaggtaggccatagctatgacctcccagggaaggcggcctgccccagctcagacagagccaagtgttcactgatgccatgtcccatcacctgggttctttaggcaattcccagacctggaatgttgactaggaaagccatgctcccaagaagttgagtcttccatgtgaaacagctcctctttctaagtggccagagaacctgggctggtacagttgtgggctggtacagttgtgggctctgaatcaggcagacctggctttgggcaaagtcctcgaccctgagcccatttcctcctctgtaaaatggggataattctagtatttactcatggcattataatgaggattaaatgaagttgtgtgtgtaaacccttagcataatgcctggcacaaagtaaatgctcagtaaaaggtagtttttcctttttaaaaaattcaagagcagcagcagatatgagactagactcacagtgtatcacctactgtttccattactatttcttcagaacaaacgaccccaaacaagaacattttattaagctcatggagacttgggtcaggaatttggaaagagctcattagggatggcttgtcaatgtctggggcctcacctgggaagacttgaaggctaggggaggctgcagatggaggcaggaaccatctgaaggttgttcacacacatggctcagtgcctgagctgggagaagctggaggccaggactgctgatgggagtgcccatgtgcagtctgtccatgagcatggctctcttagggctcttggccttacatagtggctcaaggctgcagacccaagtgttccagtgaacatggggaagctgtagcatcttttctgatctagcttagaagtcgggcattgtcatttcttctgcattctgttaaagtgagtctcaagaccactcagcttcaagtggagaggacacagacccacctctcagtgggaaaagtgtcaagatcacactggggaaaagcacagaggatgggagatgatggaccactttgaaaatgcaaccttccatgcctgctaagggaactctgctagcagagcttggggatacaaggccctggagagcctgtgcggcggctgcaccccatggccacctgccaagaaagaactgctttctgttgacaaaaccatcgagcatctgataggcttcctcttttttggttatttttatctggtatgtagctgggtacttcagaggtatgacggagatctggcagctcttctcagtcagtttgagctgatacgatgagaaaattcaggggaggcaggtgtttaaggagatgttctttagtaaggaaagtggctgcacaaaagcctctggctttctgtttcctgctggtgatatctgcgcctggatgaggtgagggatggagtcccagctgtgttttctgggcttaatttgcacaagatggcaagggctgtaggtgtccaagttgacgccttttgaagcagttatattttaggatgttagagagagctaggtgtcctgcagacacgtgggaggtttggtcagggagatggtgcttattcttctgttttaatcatgagaacctttcactcagcagcatgggagatgtgggaagtgggtacggcctccaagaaagagatgaaagtgaagttcccatagaaagttggggctggttaaaggagtcatttttcaaggctgatgaattgtgctgtgcctacaggaggcctataaatatattagttccctatcatgtctccttctatcctccagcccaacaaggcagcagaagtccacacctcatgctgttaagtcatgcggcaggcatggatgtgggcacattatgaggaaggctggtgctttgggttgtttctccagtgctggtccacatgaatacatctgatttgttcccttgttccccagaacacatatgcacattatggccagccagagttgtttgggagtggcctggttcaaactatcaccctagtatcccaatcttgttaactaaccagcctgtctgaaaactttgcataaggcctgggtgcctgtctgaaggatcaagacactagccagccccaggaagctcatctatccgttctgtctcctctgacgtcattcttaggttgtgccattccctgagttccttgctgcatgcccttggctgacattgcaaagtgcattgcactgatacctgggggcttgccagagatgtcccaaatgaatgcaggactgagccgcgttggcaaggagtggctgttctcagcatgccagaactgtggaattgcatctggtctagttagtagcagtcagtaatatgtgagttggtagctacaactgaaaatgaaggaaccctgtttctaggtgtttgtggctgcagaagcttcagttcctgttggaagggaagagtgggtgggtgaatgttagcctagaggtaggaggagtgggaccactaaaccccgctgaactcactaaatgctagtatattcctgtgagattggtgacatacagggacttagccagagcaagtaagtgatgtgatgtcagagagatttcctaggactcatggaccactctttctccgtgtatgtgaaattaattactctgtctgactgtcccatcctttccatccccagtacttgagtttgtcattcaccattgtcccctggacaattgtaataggttacttactgtggctcactgccagtctgttgctttttcagtttaatttgtctcactgcaaccatagttgttttgctgaaactcaaatcttgtcacaacacttttctgcttaaaaactacttgtgactccagggtcatttccaagttccttggcagggtctgtagtcttccagtcctgccccagcccttcactgcagctccttcttctccctttccacctcatgaaagttctgctccagctacaagggactatttcttagatatgtcaaggcccctcagccctcttggacctggactcacgttattccctctgctgggagtggtctttcttctgatctccccctggaccaaaccctgtcctctcgttacagcacagagagcagttgtttattctgtgagccccttctaaggagccccttcctctgtacattctagtttcaggcatcctccatgttaggtgttcaaacaagatgggtggacggggtagggtaaggcatcatcaagagcatgagagtagccagtggtccccactttaccactttctggctgggtagctcaggggaatatcctcacttctcagccacagcttcttcatctgtaagtagagattaaaacagtacatatccgtaaatagagattaaaacagtacatctgtttttatataagtactgcacgtaaaatgcttagcatggtgcctgccatgtggtaagtgctcagtaaatgctagcaatgatgatgacagtgttataggtgtagacttatatggccagaatgagagaagtttggcctggtgcagtggctcatgcctgtaacccctgcactttgggaggccgaggacggtggatcacctgaggtcaggagtttgagaccagcctggccaacatggcgaaaccccgtctctgctaaaaacacaaaaattagccaggtgtggtggcacatacctgtaatcccagctactcaggaggctgaggcatgagaattgcttgaacctgagagacggagttgcagtgaacagagatcgcgtcgtgacactccaacctgggtgacaaagggggactccgtctcaaaaaaaaaaaaaaaaatagctgggcgtggtgatgtgtgcctgtggttgaggctacttgggaggctgaggtgggaggattgcttgagcccaaggcagcagggggcagaggttgcagtgagctgagattataccactgcactccagcctgggtgacagagtgataccttgtctcaaaacaacaacaacaacaataacaacaacaacaacaaacaacaaaaaacaaaagggagagagagaggttccgtcctagtttcctttataggatcatctatttatccctctcttttcctttccttttttctgtgtaggtgactgtcgaccttttctagtaaccacagtggttggtatcttttaccagtttctgccaaagtaggtagattctcaggcatgcgtgttggctgggaggaatcttgattttttggagtgaaatcttggattctgtcctgattataattctggtcttggatgttggttatgtcttagaggctttagccctttccacccatggtgctggtgtctcttcgcagagaactaggtggacactgcattagtcagggtggggcctcatggtcctgatatatcttttcacagccaaggatctagtgtcttaagagttgacttgccagggcttgtgactctctggtgaccagtggtccttatgctttgggactccagccagtatcccctgactacttttaatagcatcagactggtttgatagggaagactttctgaaccctgggatgtgatggagcaaggagaccctccttctgtaaaataaccattccctctgcttttgagtatgtcaggagggtctttcctgggatgaatgagcagtgagtaatgcttctcccttggctgactatggttgctggtgaacagtggagctggggtccagaggttttggagtggacacttattctttgcctttctgatatatgagcctcagcctttctcaccactgtctaagagtgctttctgctgctctggggatgagtcattggatagggcacacattttagaaaagaaaaaagataagtggatggtgatttgatatggatgggggcaggaactggagattcccctgagaaatgactacccctttgaggtgggcattggtcgaagcaacagcgccctagagatgggtagaaagtgagagatctttggccgggtgtggtggctcacgcctgtaatcccagcactttgggaggccgaggtaggcagatcacctgaggtaaggagttcgagaccagcctggccaacaaggtgaaaccctgtctctgctgaaaatagaaaaattagccgggtgtggtggcaggcgccttaatcccagctacttgggaggcaggggcaggagaataatttgaacctgggaggcagaggttgcaatgagctgacatcaagccattgcactcaaacctgggggacaagagcgagacttctctcaaaaaaaaaaaaaaaagtgagagatcttttagttcagggtgtttcatagtttttatagcctagtgtcttaagggctgatgggagaggatttttttttaaatcaaagtggaggttctaggttgagaatgctttatttggggcccgagtgaacagctatatgggacctacctgctactgctagcgccaaatatatacctattttgagggtgaatctctaacggagagagcagagctttaagatcgtagggattcctttgctttattagtttttttctcacacttgtgaacatttaagtttttggttcctagctctcccactgaccttcctcatagtttatctggatataccatgtagaggatgaggcatggtattgaatttgcagggtccagcctgtactactcaaagcaaaactcaaaacttctgaaatggtttcagacctagtgtaggagggtttcttctcctgcccatcaacaccctccccgcaagccacaagctactgtctcagccatggtgcttttagcacatatttgtcctaaattatgcctggggagatgctgcctgccggtaagcttttgccaccacaccttgccaagctattagagtttgatcctgagtgtctgtgagcttcccaaatatttattttatttatttatttattttgagacggagtctcgctctgtcgcccaggctggagtgtaatggcgcgatcttggctcactgcaacctccacctcccgggttcaagcgattctcctgcctcagcctcccgagaagctgggattacaggcgcccgccatcatgctcagctaatttttgtatttttagtagagatagggtttcaccattttggtcaggctggtctccaactcctgacctcaggtgatccacccgcctcggcctcccaaagtgctcggattacaggcttgagccaccacacccggccccaaatatttagtcttaacttcttaagcactctcatttaaatataaaagcctagttcccttccctagaaggatatgaaataagactcaggtggtttggttttagtccaggacctcctgggttctagtggaaagggcagtggacttagaggtagaattaggtttgactgatagctttggtggcttctcttccagttctcttctgttctaaacacaggtttctctccttgtccctgccagtgagaagtagccattagcttgatagtgccatgtagagacccacttctagtgctgggctctgtgttcagtagtgttatgggcattggtccattccggatgtaggattcagcaaggttatgcccagtggatttataatatgagactgtccccaggcaaataaaagtaagttgtgggtcatacactgtggcctatgagagactggtattgtagagatgtatcttctcaacatttgacccccaaatggagggggcagcagggtatagtgaaaggagcataggcctagaagccagagcaagattcaaatcttgactctttcgcttcctagatgtggaaaagttacttgccctttgagtcccagcttcctcaactataaaatgaggatgctacccaacttgcaggatagccatgaaaactgcatgaggtaatgtggatgtgaagtgtctagtattgcacctgggacatagtaggtatgcaaaaaaatagtagctgctattattattaaataatttatgaaagtaacaaaaacacatgtttatcctagatgattttggatttcgacaatgatgaaagtgaagaaaaacgtttcgcttatcatcttatatactaatgttttattataatatagttacatgtattaagctgcctattatatcttttttttttttttttttttttttttttggggacagagtctcactctgtctccaggctggagtgcagtggcacgatcttggcttactgcaacctctccctcccagattcaagtgattctcttccccagcttcccaagtagctgggactacagatgcgtgccaccatgcccagctaatttttatatttttagtagagatggggtttcaccatgttagccaggatggtcttgatctcttgacctcatgatccacctgcctcggcctcccacagtgctgggattacaggcgtgagccaccgtgcctggcctttttgacatacattttgttgttgttgtttgtttttgagatggagtctctctctgtcacgcaggctagagtacagtggcgtgatcttggctcactgcagaggcaacctctgcctctcaggttcaagcgattctcctgcctcagcttcccgagtagctgggattacaggcgcccaccaccacgcctggctaatttttgtatttttagtagggatggggtttcaccatgttggccaggctggtctcgaactcacctcaggtgatccacccgcctcgacctcccaaagtgctgagattacaggcgtgagccaccgcgcccagcctgatataaaatatttgaagtgtcatgtgtacataatctagtttaaaaagccgaaatatattacaagccttgtaataaataacaaaggtctcctgctttatcctttctcactcactgactcttcctcctggctggtgatcttgaggggagatattggtttaatttacacggtatttgaacaccccttgcctatttagcacagtgcctgatacatacaggctttcagtacatgtgggttattatattatttttgaaaggtttaaatcaatacttagtatagaacatagatttcaggttgattaactttacggcagcttggagaggctatccaaatctttcattgtatcatactgagactctgttgactgggatcttggttttggtttagatttgcaattttgatatgtctgtgtctgttttgctgtagtaatgagcaagatattttgtaggaattgaactctgtattaattcagttagattagctgtgagaaatagacacttaaagtaacactagctgaaataagtgtctctcttgtatgtaaaagtttggcatgagatggccagtgattggcaagacatctctgttccatgagccttacctccttctcgttcacagctctgccaactcttggggcatgatcatgtcctcatggtccaagatggtagctagacctccagctatcacattcactttccagatagcacagtgtataaagggatgaagaacaaagtccaaaggcctagagctggaatcttttaagacaggttacagaaagcacctacaatgacactttttagttacctggctacatctcagaacaaggaggctggaaaatgtagtaaatgttctgagtggcctggtgcccatcttgcaattgtgggttccattactatgggaggaggggagaataaccactgaagggcgactagcagtctgggtcacagatttcaggctcttttcctatcattaatcccttgttagtccttccctgatatgctgccaggattgctaatgtagcaatccctttctgctgtgttttcaatttgttttctctttctgctgctgactctgtccttctgctttaacccttacttggagatttctctcccattcaccccttcagagttggaggccttgagacacttgcttggatgtgcgatggaagcagacaggtaattccttccttgggggcaatgacctactgctttctgcataacgtgcttatagttgcagcattgagatcagtggttcccttggggagagggttactgaaaggtatctttgacagtgtttgtataaagtgtaaatatttctgtttttcaaatgtgcatgggtgctgttttgttgagaaaatatgaattcacttagaagcattttcttagggtgtttagtattttcttagtgtttaatatggcatggtggtctggggtcctgactgatttcattcaggcctgggctgaatgaaatgtcctggcttcgtctcttcccacttgtagaccagcctgcctgaatttcagtctccatatctgaaagtgggcatagttatagtacctactttccgtattgatgagaggattaaataagattataggtgtaaatcacttagcttagcacctggtatgttggaaggactccataaacattagttgtggttattattttcttcttaatcaacacacactaaaagtacaaatagcatcataatggctttttttttcagctgaaaggacatattttgaaaggttggaaatcattactgtagcttctcaggggactccaatatggccagccctggaacaggtagctggggaccagtacctaaactgatttaagcagacaccttttgggatgatttgcattcatttgttaattccagatgaatgtttattgagcgcttattattcctcttcaggttataggcatagaaagggagaccactgtagttcagctttactctagctcaggaaaaggtcactgtattgaatgctctctctctctctctatgaggggtgttttgtacccattcatttgctttggtttcctcttttataccaaaagggagtgactcctaagtccccaaggagccaattctctccacctttctgtagttactgtggcagggactcttggctgctgtgcctgagtccttgttgggaagcatagctttgctggttgtgccagtggaacccggtgcagctctgctgacaatgcggaagctgctggggccaccgttgctgctggcgtctcccttccatctctaggcagcaccgcagctctgctgaggtcgagtcggggagtctaggtggtgaatcatttgccttggtaagcaagtctggcctctcttggccttgcctggagagacagagcgggcagagccccacgggccaggagaagctgggggatgcacagcggccacactctggctccctggtagtggtccacgagtcaggctctctcatgcagctcttgctgcgtcagcacaacagggagcctgctctgtgttgggtctgagatcatcttccttcctccactggaggcaacgtgctgtaggaagcaaatatctcacgtgccactcaggagccctaaaggctggctgtgtctaatgaatagggcttttctctggggtagaatcacttcacctaactccttttccccctatgtttagctgttcttcagctcagatggatggtggggcttggctggctcctgggaaggactgacacagtttccagggagttacagactccaggaatgtcagaggtagggaaatgggggcctggtgaaggtcacacagtggtggagcgagaacccagacaccctgggtctccatctgttgcttttttctttctgccttggtgtagctcagagactgtttttattaaggtgagacaggatgctgtgacatagatctggagtttaagccctgggctttggcaggaacaagcaggagtacgtatatgccttcctctattacaccctcccaggatggattttgcatatcaggagagatggaagaaccaagtgatggaaagccggaagcctttgaaaagtttcctttgtaggatatgctagtttccttctccctaccccaagaaaacaaaactgaaggcacagttctatgctagggtagcagattgaacatgtgaaatgctacagctacctttactccctcctgaaacccagtgaaagccacagcaaacctacaaggtgcatgggagaagagacgatagctgttatgttttggagactggaaaactgatggagaagtggtaactgacttagaacatttgagaaagataattaagttgacagtagggaaagcaaaaaaaaaaagcaatccctttatatcacagaatctcctctactttatgcagccacttgactgccttttcttcttggaaagggtaaaacaagagttactggactggagacagcaagcacagaaaaaaataaataaaacaaaacatacctcctacgcgtcctttctaaggaactactggagagtacacaccaccgaagcaggggaaggaatcagtaaagaggggagtggggtacaggacacagggattaacacaggagggagacgaagggaaccccttaggactgtgtaccagacgtagaggatgggcagcttagatctgagcagcgtgactcagaatgtcatcaccaacttacctgcaatcattgtgccattgatttaactggaggactgactacctggggaagcctggggcagattgtatctgctcttggctgtcttgctcatgtgctgatgaagcttctgtcgcccctccttgccctgctgatggatagacgcattttatattaacagaagtgttttctttgcccaaccctcgatgctaaaggtaggtccatgtgaatttagaaacagaaaatatgagccaggcacggtggctcactcctgtaatcccagcactttgggaggccgaggcaggcggatcacttgatgtcaggagttcgagaccagcctggccaacatggtaaaaccccgtctctactaaaaataaaaaaaaaagtatctgggcgtcctggtgtgtgcctgtaatcccagctacatgggaggccgaggcaggagaatcgcttgaacccaggaagtggaggttgcagtgagccaagattatgccattgcactccagtctgggtgacagattgagactcaaaaacaaacaaacaaaagaaacagaaaatacagaagagtcccactctcgcaattaccttgacccctaccaccaggtgttcccactgtggttacctgccctgtgtttccaggacttgttcatgatcttgcctatcaactttcccaggaagggctcttgtaaattccatgggaatttcccagagactctgtttagcttattccctttgggaaggcttcatttagcaaaggcagtatttttactcctccatggtgttgtgggtagaatagtgtcccccacaaccctccacacaaacaataagttgaagtcctaacctgtgaaatttggaaataccatctttgcagatgtagtcaagttaagatgaggtcatactggattaggatgggccctaatccaatgaccgatgtccttataaggacacatagacaaataggagaatgttaggtgaagatgcagacagatacacaaagggaagatggccatgtgaagatggaggcagagattagacttaacgctgctacgagccaagggacactaaaaactactggcaactgctagaagctagaagggtcaaagaaggatccttccctggaacctttgaagggagatggccctgccgacaccttgattttggacttctaacctccagaactgtgagagaataatttctattgttttgagccacccagtttctgttaatttgttatggcagccctaggaggctacaacacacagcttcattttttgtttgccactcactttttcaaaactaaacattatcttatttagagatgtgtacatagctggtaaaatcataaagagaagtaaagaaatgaataacagaagtcacggttgtcagatgtttagggagagaggaaagggggtggtggagagagacacatggaacttctaaagggaccggatgggattatgtgggttttcatattatgttctttaaaccatatatacatttttaaattttagaaatggagtttcactgtgttgcccagattggagtgcagtggctgttcacaggcacaaacatggtggtgctatagccttgaattcctgggctcaagccattctcctgcctcagcctcccaagtagctgggactacgggtgtgctccaccactcccagccatatatacatttgtacatgttacatgtatacattttaatgtactctcctatgtgtataatacgtttaacaataaactttaaaaaataaaacaaaacataaccctcaaaaccaaattagctgagttacgtaatgtaggagagatggcattgaatcatctgaaccaaatgcaggcctgaggacatgagccttggcaccaaggtgagcatttagcaaattgaagcctcttgtactaatggagatgaataataaataagaaatctgaaaatgacatagatcatcaaccaaagctaagtttaccattaggacctaatgggagagtctcctcagtgatgccaagttttgagagcctggcctcagctaaatgatattaggtcagattcacaaatcccttagtggcaagacacccccgatttctcctgctgacctcctaatgggatggccttgagaccattttaagtggtctgcattaagcaacattgaatcccaaagaaagtcattcagcttttttgtgtaaatggaggatcaacattcattttggtgctgtttgtctgtaattcctctctaacacttcaaatctttcttctcaagcagagaaggcaggccttaggctcagcattttgaccatatgcgggtctgccactgtaccatttatttttgtttcattttatttgtttgtacaggttactcaatgttaggagaatttttggctttcccatttacaatagtgatatagaatttcttctttaaatttttttttaatttttaatttttgtgggtacataataggtgtatatatttttggggtacatgagatattgtgatacaggcatatgatgcataataatcacatcatggaaaatgggatatccatcccctcaagcgtttatcctttgtgttacaagcagctcaattatactttagttatttttaaatgtacaattaaattattttgactatagtcaccctgttgtgctatcaaatactaggtcttattctttctattttttgatgcccattaaatattatttaaataataatattaagtggtatatataggtggtgtcctaattgggaaataatcaagaatgatgtctttgtgccaggcacagtggctcacttctgtaattccagtgtttgggaagccaaggcaggaggattgcttgagaccaggcgttcaagaccagccggtcaatacaaaaaataaaaaattagctggggttggtggtgcgcacctgtagtcctagctactcggaatgctgaggtggagaaacgcttgagcccagtagttcaaggttacagtgagctatgattgtgccactgcactccattctgggcaacagagtgagaccctgtcttgacctgatactcacttttgtcacattgtctttccttatagaaggcgaaaggccgttgagataagctgagagtcttcaggttatctttctctgtgtgtcccctacccgacctggcactaactgggtgtgttagtcactggtgaacccctggctgaggtattactctttctctagtctcctcccagtgcccctccaccccctaccccaatacctggcaacaataagatgggaaagtggatagtttgagaagatgcacagatatcccattggtcaagtatgtgaccagcaagagatgagttctttttttttttttttttttttgagactgagtgtcactctgttgcccaggctggagtgcagtggcgcagtctcggctcacttcaacctccgcctcatgggttcaagaaattctcctgcctcagcctcccaagtagctgggactacaagtgtgtgccaccatgcccagctaatttttgtatttttagtagagacagggttttgctatgttggccagtctcgtcttgaactgctgacctcaggtgacccgcccacctcagcctcctaaagtgctgagattataggcatgagccaccgcacccagccgggatgagttctttcaaagagcctggtcctgtgcttggttcctaaaggggacatggcataggttccagaagaaaaagaatgaggtttttgctttctaggagtcatactgtatcacatgctagcggaaatgatgacacccatatatatgcagcagtcaggaatgattagaagtgcatatagtgttagattatgtggtatttggatgctgaaggaagaattcaggaaaaagaagtgcagggtagactaatcaattacagctttagggattaggcagaaatggaggcagggcttaaagacacataggatttctttctggcctctgtacggcatggcacaaaggtgaagaatgtggttctgaagtcagacagatctggatttgattcccttccccatccctcactgactgggcaactgacttaacctttctgtgtctggtttggagtgcataaaatggggaaaataattacacctactgctgaggggtgatttaaggattaacaaaagtgatggacataaacagcatcgtgctgctacgtagtaagtgacccataatgagtaggtgtcattattaatcaagcattccatttatctatacagcaaaaatgtattgcgtggttattgtgtgtcagggactgccaggccttccatatcagtcccttgagcgctgaaccctatggtttccatttatgtacaggatacctaattataataataactatagtgctccaagtgccaggtactctgctagttgctttattgctgtatcgcctttaatctttatccccattttgtagaagcaggaattgaggtacaaagtttaagagatttgtccagggtcacattaagagtgtcaagcctaggatttaaattatctgctcttttcctgttccatactgactcttattacagtgaacctagacccattatgtccaaaactaaacttggcttcttcaaatgggctttttctctcaacttcccaattaggggcaccaccattcttctgcttgtcacccaaacctgaaaggctggagatgtcttccttctccatcaggcccctacatctggttaatcactgggtctttagttccaatgtatcttttcctttctgttccactgcctggccaggcccccattgacttacgcctagactcgttagttcttctcggtacagtcacacatcacttaatggcagggatacattctgagaaatgcatcattaggcaatttcatcatcgtgcgaacatcagagtgtacttatactacacacctgggctatatggtgtagcccaagcttgtcccgctatggctcaggacactttttcctttgttttttttttttttagctgttgttggtgtattttatgtgtggcccaagacatttcttccaatgtggcccagggaagccgaaagattggacacccctggtgtagtctgctgtttccaggctacaaacgtgtacatattactgtactgaatattgtagacaattgtaatgcagtgctaagactttgtgtacctaaatgtatctatacgtagaaaaggtacagtaaaaatatgatataaaaataaaaaatggtacttctttacagaacactcaccatgaaatggagcttacaggactggaagttgccctgggtgagtgagtggtgagtgaatgtgaagacctaggacattactgtataccaccatagaccttataaacactgtacacttaggctacactaaatttataaagaaaacttttttttagacggagtctcactctgtcacccaggctggagtgcagtggtgcaatcgtggctcactgcaacctctgcttcccaagttcaagcaattcttctgcctcagcctcctgagtagctgggagtacaggcacggaccaccacacccagctaattttatgtatttttagtagagatgggtttttgctatgttggccaggctggtcttgaactgctgacttcaagtgatcctcctgcctcggcctcacaaagtgctgggattgcaggcctgagccatggcgcccagctgaaaaattttctttcttcaataataaattaatcttagcttactgtaactttttaactttataaacaaaaactgtttacttcttaactcttttgtaacaatggagcttaacataaacacactgtacagctttacaaaaacattttctttcttttatccttattctatgagcttttttctatttactttttttttgttgtttgtttgtttttgagagagaggtctcactcactctgccacccaaactgaagtacagtggtacgatcacagctcactgcagctttgacttcccaggctcaagtgatcctcctacctcagcctcctgagtagctgggactacaggcatgcaccaccacacctggctaatttttcaatttctttgtagagacaaggtttcactatgttttccaggctggtctccagctcctgggctcaaacgatcctcccaccttgacctcccaaagtgctgggattacaggcatgagccaccaccctcagcctacatttttttttttttaaagagcctggtcctgtgcttggttcctaaaggggacatggcataggttccagaagaaacatcagcctacattattttttttaacatacattttttgttgttgttgtttttacattttaaacttttttgttaaaaactaagacacaaacacattttagctttggtctacacagggtcaagatcatcaatatcacagtcttccacctctacatcttgttccactggaaggggcaaaacacacctggagctgttaatctcctataataacaatgccttcttctgggaatacttcctgaagaacctgcctgatgccgttttacagttaactttttttttttttttttgagacggagtctcgctctgtcgcccaggccggactgcggactgcagtggcgcaatctcggctcactgcaagctccgcttcccgggttcacgccattctcctgcctcagcctcccgagtagctgggtctacaagcgcccgccaccgcgcccagctaatttttttgtatttttagtagagacggggtttcaccttgttagccaggatggtctcgatctcctgacctcatgatccacccgcctcggcctcccaaagtgctgggattacaggcgtgagccaccgcgcccggcctgacagttaacttttttttacataagtagaaggagtgcactctaaaataatgattaaaaagtatagtatgctggccaggcacagtggctcccaccagtaatcccaacactttgggaggctgaggtgggaggatcgcttgaaccgaggagcttgagaccagcctggacaatgaagtgagacccacttctctacaaaaactaaaataattagttgggtgtggtggcacatacctatagtcacagctactcaggaggctgaggtgggagaatcacttgagcccaggagattgaggctgcaataagctatgattgcaccactgcacaccagcctgaatgacagagtgagaccttgggtccaaaaaaaaaaaaagtaaatacataaaccagtaacatagtcgcttattagcattatcaggtattatgtatggtacataattgtatatgctatgctgttatacgactgcctgcacagtaggtttgtttacagcagcatcaccacagacacatgagaatacatggtgccatgacattatgacagctgccatcatcactaggtgataggaagtttttagccctattattaccttatggtaccaccatcatggttttggcctgtcattgactgaaacgtcattatgcggtgcatgactgtttttgccattgctcgacaggagaggtgaggtttacacaatgcactcttatggacttcaccaaaatttgataaaacattcttacatttttcaagatgtgaaagcatgacagtttgttattgccacagctgtttgtcagtggtagaagtttacagtgggcttactgcagtggtacaaatatgtaaactgctgtgaatataacctttctcttccactcaggaaagcatgttgggagataacagctctcccctctgtttgtgttttaaagctttcctctttaaacaaatggggctgcgacaactgcatagccacatgcaaaagaatgaaattcgacccctgttatatgcagaaattaaaagtggatcaatgacctaaatgtaagagctgaaaccataaaacttttggaagaaaacatagaattaaatcttcatgatcttgaatgtgttaatgattcttagatattataccaaaagtatgtgcaataaataaaaaaataaagtggacttcatctaaattaaaaactttggtgtatcaaaagtatcaagtaagggagaagacagccagtagaatgggagaaatatttgcaagtcatgtatctgataagggtctagtatcagaatatatgaagagctcttataactcaataataaaaagacaaaccacttactttaaaaatgggcaaaggattgagtggacatttctccaaagaagatacacaaatggacaacaaactcatgagaagatagatgttcaatatcattagtcatcagggaaatgcaaacccaaaccacaatgagttaccatatcacatgcactaggatggcattaagaataccaataataaggaaaataacaagtattcgtgaggatgtggagaaattgaaacccccatagtctgcttgtggaaatgtaaaatggttcttctgctgtgcagaacaatttggtggttccttcaaaagataaacacgaattaccatgcgatccagcaaatatgctcctagatctgtaccccccaaatgacaacaagtatacaaatatatgtatacacatgttcatacacactagtcacagtagccagaaagtggaaacaacccatgtgtctatcagtggacaaaaggataaactgtaatatgtacatacagtggaatattattcacccataaagaggaatgaagtactgatataagctataatgtggatgaacttgaaaacatgttcagtgaaataagcaggtgtgtcacatattgtatgattgtatttacatgaagtagtcagactaggtaaatttataaagacaaaggacattggtgattgctaaggtttgggaggagggagaatggggaataattgcttaatgggtacagggtttccttttggggtggtgaaaatgttttggaactagacaggtggtagttgtacaacattgtgaatgtacacaatatcactaaattgttcactttgaaatggttaattttatgttatgtggatttcagcccaaaaaaaaggtctacaaaaaataaaataaggctttcacaagctttggtgctttaatgattagtagcaacgggtgcttggtagataccggtatttgaggacatgattattgagagtcactggcgtgcactaccacacctagctaattttttgtatttttagtagagacgggatttcaccatgttggccaggcaggtgtcaaactcctaatctcaggtgatccacccgtctcggcctccccaaatgctgggattacatgcgtgaaccactgtgcccagccaggaatttatttaattgtgacatgtgtattttagtttcttcatcagtaaaactgagatggcaatagtacctgccttgtaagttgttgtgaggattagagatagtggctataaaatgggtggtacaaaaatggatgcactgtaggtgtttaagaaatgatggctctgaccatcaatccatggcagctaaatgctggagcccacaggagaggccaggaggatggcagaagagttctgttctgtggtttccctgtgattaatgcagactctggtttcttctgtattcgtttccttgcctagtattgatcctccagaaggtggagaatggagacctgagcaacaagattctgaagatcactgattttggcctggctcgggaatggcaccgaaccaccaagatgagtgcggcagggacgtatgcttggatggcacccgaagtcatccgggcctccatgttttccaaaggcagtgatgtgtggaggtaaggtccaggggggcagggacagcatttcctaggtccatcttggtggcacacacatttcaagacttggagaattgaggttacctaggatcccaggcacctgaagtaggtctaagtgacctcccccaagagtcatctatgccaattcccatattgccaggggacagtttctaatgctttcatctaccaaaaaaatccctgaagtgctatacgcaggccactttttgctggtgattgctccctaggaaaggccagtagattccaggggcaacatgtactcccatctctacgctgtaagatgggaaggacactcggtccttctcggagagcttcgtgaggatcagtctggcttgctcagcaatgctaggctttcgtggctgttactgctgaacttggggaggggattaacccaatgtcctcactctaaagctcctgagccaatgaatgttctttgtgcaatctcgtttttcttgatggcctaaaaattaccttttccagttatctagttcatcttttagtcaaggctctatctgttgacattgatccagaaatcagaaaaaaatgggtcccaaatatgtgcccagaactgcaaagccgcagactagaaatgaccagccatcctcctagtaaatgtgagcccaaaaggttgcaaggaaatagatctaaaatttttcccagctgaggaaggatgagcaactacctagtatatgttgtcatggctgtgggacagtagcatcaccttagtatacaaaagaaaggactgtagtttatcattatatatcagtccatggagttattgtcctgatgtgttgtaaagtgagctgtgtatgtgtgtgtgtgtgtgtgtgtgtgcacgtttattttaaataatagctttattgagctattattcacataccgtaaagctaatcctttgtacactttagaatgtataagttgctggatacagtggctcatgcctgtaatcccaggactttgggagggtaaggtggaaagaactctggggcttgggagtttgggaccagcctgggcaacatagcgagacccccatctctacaaaaagtttaaaaagtatccaggtgtggtggcatgcacctgtagtcccagctacgtgggaggctgagatgggaggattacttgagcctgagaggttgaggctacagtgagctgtgattgcaccactgcacttcagcctgggtgacagagagagaccctgtctcaagaagtaaataagcatgtaagtcagtggtttttagtatatttaaaaggtgtgtatgggtcaccattgttattagtttcctagggctgctgtagcaaattactaaacctagtggcttaaagcaacagaagtgcgtgcttttatagttcctgaggccagaagcctgaaagtgatgtgggcagggccacaccctccagagactctagtgaagataatgactcaaataaggattctgggtattgggacatagatatagctttttagggccaccattcagcccattacaaccactatctatttccagaactttatttttatttatttatttttttgagatggagtcttactctgttgcccaggctggagtgcagtggcatgatctcagcccactgccacctctgcctcccgggttcaagtgattctcctgcctcagcctcccaagtagctgggattataggcgtgcaccacacctggctaatttttatatttttagtagagacgggatttcaccatgttgaccaggctggtcttgaactgatccaaagcaatctgcccacctcggcctcttaaggggctgggatcataggcatgaaccacaccatgcccggccaatttccagaacatttttatcatccaaaaaagaagctccatgtctattatcagtccttccctaatccttcccccttctactccctagcaaacactaatttcctttctgtctttatgaatttgcctgttctggatgtttcacataaatggaatcataccatttgtggtcttttgtgactaggcttctttcatttagcataatgttttcaagattcatccatgttgtaatacaaaattagctaggcgtggtggcgcatgcctgtaatcccagctactcgggagactgaggcaggagaatcgcttgaacccaggaggcagaggttgcagtgagccaggattgtgccattgcactccagcctgggaaacgagtgaaactccgtctcaaaaaaaaaaaaaagattcatccatgttgtaacttatctcagaatttcattcctttttaaggcttaataatattccattgtatggatagaccacatttgtttatccatttatcagttgatgggcatttgggttgtttttgctttttggctgttataaataatgctgctatggacacttgtgtacaacacaagcttttgtgtaaacatatttttttcagttttcttgggtctatccctaggagtggaattgctgaatcatgtaacagttctatgtttaactttttgaggaaccaccaaactttttcatcatagctataccattttattatattcccgttagcaatgtatgaatgttccaatttcaccacatcttttcaatacttgttattgcctttttttaaaaaaaaagttattattatgtctatccttgtggatatgaaatagtattttgttgtgattttgatttgcatttcactaaatgacttatgatgttgagtatcttttcatgtaattattggccaattatatctctgaacctgaagaaatatctattcaaatcctttgccaatttaaaaattagagtatttgtctttttattgttgagctgaaagagtcctttctattctctcatcagatatatgattagcaaatttttttttccattctgtagattgtttttccactttcttaaggctgttctttgaaacagtgtttttaattttgatgatgtctagtttattttatcatctgtggattgtgcttttggtgtcatatctaaaaaacattgcctagtccaaagtcatgaagacttacactcctatatttttttctaagagttttataatcttagctcttacttttatgtctctgatccattttgacttaatttttgtatgtggtatgaggtaggggtccaactttattatttttcatgtggctattcagttatcctggccccatttattgaaaagactattttttcccatcgaattatttggtcacttttatcaaatgtcaatttaccagaaatataaaggtttatttctagattctcagttctactccattaatctatatctgtccttatgccaataccaccctttcttaattagtatgactttgtggtaagttttgaaattaggaaatgtgattccaattttgttcttctctttgaagattgttttggccattctgagtcctttgcatttaatgaatcttagggtaattttgttaatttatacaaaatagatagctgggattttgataggaattgcatcagatctgtagctttgtagattatttacacccttttttttttttttttcggacagggtctcaattgcttgagctggagtgcagtggtgtaatcatggcttactacagccttgacctcctgggctcaggtgatcctctttcctcagcctcctaagtggctggagctacaggcatgctccactttttctattttttttgtagagacagggtttcaccatgttgcccaggctagtcttgaactcctgagctcaagctgttcacctgccttggtctcccaaagtgctaggattagagatgtgagccactgcgcctggccctattgacatcttaataagtcttccaattcatgatcatgggatatctttccatttatttagacctcctttaacttctttcagtgatgttttgtagcatctgtatattgaacctcattttaccatgcattaattacagggtaaagtagctaatgagaagaaatgagtttaactttccttaaaatatctgacctgatctcattaagttgagttgtatactgatattcaactatttttgatatataaaatcagcaatttcatgtttcagtttaacacttttattgcttgaccatatgctaatgagattaatacatcaattaagctaagctgctattacaaagaggcatacagatatggaggcttagataggatagaagcatattctctttcaaaaactagctaaatagcccaggctagcagggcaactgtgccccatgagatcgtttaggaacctaggttcttttagattccctcagtgcattgaccttgaccgaatggttaaattgggtgactgttatgtgtgtattacaattttcataaaagaggaaggagaacttactcatggcaagcgcagtttatctttaatttggaaactatccagaagttgtacacatctctgcacacccaattgcctgcacttggttatgtgggcacacctggctccaagggaggcagaaaaatgtacgttctagctggacaactgtgtgccccactatggaagacaggaagggtggatttgaggggacaagcagccacttgtcacactcaactctctcttgccttttttaatggaaaaccatgatttctcagtaacatgattgttttctacctccagtattcccactaggtttcttctcccagcctaaccctgaaattgctcaggttttactgtcacacactccagaggtttctgctggtgacgatttggacagagttgtgtcatgtatccaagtaccttcgtaccttcccagtgggaagggaaagcacaaatgccgcatgtagagtcttctcaggatgacagaaattgtagacagggaaagacaaggccattgcagagcttttttctccaccgaaagaacaagggcaggacctttcaacttttaccctaagtatccttgttgtaagactaacctctaggtcttgccctataaccatgatcctaaaagcaggcttgaaggaagagcctctggtgagaggcatctgatgaaattattctactctctagaggaaatcacttggaggtaaacctcaaatcagaagcactttggatgatgtgtcttggatattgtcacatggtctgccagcaggtctctagttgctctagtctagacttgttcccaggacttaagcctcctgacccagtttggttgatgattgtggtttgaaaacataattcaccctgctccctttcagctgtcttagcttctatgctgcaggatttccttcaaagcacaatttataacccattaaatgggcctttcattccttcttcctcaggcttacccatctaagtagctccaaatggtctctcacctttagcagaggaaaatgtgtgcccactgctgtacatacagcaatgcttgtacactggtaacagttgttaccacctacaaatgcttaagggctagggtctgtggtaaatgttatacatcttctatagtcttcacaagaattccccaaagtagggatcatcatttccattttacagatgaggtaactgggctcagacaattgaagtcacatgcctaagttcacccaggtggcagacataaagctatgattagaactagatatgtgtgtagtgacaatctgtgcttgtagttatgccaccatctgtatggtcttgttcctgcacttaaggcagcctcttctgaatgatcagcccaccgtgcgtgcctagggcccagcagggtgtctcagggagggccagggcatgcctaggaacttggtacaaagctgtttcccaaactgacttgtaactcactgactcattcaagaagtgtctgtggaatgcttgccctatgccaggtactggctgagtctgagtgccccacacctcaaccctcctggaactcatccagagctgggggcctctgcgcctctgctattccaggtgcccagggccatctggtttgtcttcctgctctttgagtgtgcttctaaagttctcctgcaaatgttgtgatggagggtgagatgataaagggctggatcctcaattgtgtaagtttcccagtctgcttggattggggactgcctcaagaaggctattgctgaaattgttccctttctttgcgctgtgtgggtagagcagtggttactgtcagagggcatcgtcccacaaggccttcttgcctgttggttgtgggatgaggtggaggcattttcttaatcattttaagtttaaaaaattacaatagtggctgggcacggtggcttacacctgtaatctcagcactttgggaggctgaggcgggcagatcacaaggtcaggagatcgagaccatcctggctaacatggtgaaaccccatctctactaaaaatacaaaaaattagccgggcatggtgctgggtgcctgtagtcccagctactcctgaggctgaggcgggagaatggtgtgaacccgggaggtggagcttgcagtgagctgagatcgcaccactgcactccagcctgggcgacagagcaagactctgtctcaaaattacaatagcaaaacgttttctgtagaaaaaatttgaaaatatgggtaaacaagaaagaaaagatagggaaagaaaatcaccctgaacccacttatagagataatgcgtattgatatttgggtgtgtttactcctattcatgtgctcatctgcctatccctagtgggatctttctgttttaaaagttgctttttgaatgtaatatagcatgaacacataaccacattaataaatatgttgttatgtcaataagtttatcaatgtatatattacatatatgttaataaatacatcatcattttgaatgagggttcagttaataagaagaagaattatatgctactttcaatttacaaagtgctttcacatatattagttcaattatctttgtcaaagattattaaacagtcagtgtggttcctggaatgtggaatcatagataattaccaagtgcaagacattccccagcccacctcattcaagggagactggtcacctcctttcagagcatggaccctgacctgacagtctagagatggtgcaggttactacaaaatagagctctggcccagcacaggcgtggagttgctgtgccttttgtcaagaaaggtagctgtccacttctcctcactttgaaaaaaaaatcaaacacccctcctccacctctgatcctaggaaatggttgaagggattaccaagcctcgggaggtggttaattattaactcaagagtaaattttgtgagggttgggttaggcagtgaggacttttaggaaattactggcagcactgtgggagctggtgggtctgtgttgcggggaggtactcagaggcagtgacttagctgaacgagttcttccaggctgcttgcaaatggtcatcaaaggacttgttgaccttttaaccttgggagggcaactaagttgactaaacctgaggtaaatcacatcaacttctactgcccgcctttccctgagctcagatccacgtaaacttgtatttctcttgaatttctccagtcttttttcccaccaacagaataccaagtcttcatttatatcacccaccttccattgtaaacataaagcgggatgttggcagaggaaaactagtttagtcagccccagaaagacttcttctctgaatgccagtgtccctcagcaaagctctcaccaacactgtagctctacataagcctcctcagacacaatctcatttcaggcccttttggagaaaccacaggtctactagccatagatggtaatttctggatgagggttagttgttggtgttagtgattccttgtaactcttctgtaaggtcggtattgctgtctttgctgtagggatgaggaaactgaggtttggagaggtgaacttgcttcctaaaggcacatagctgttaagtgataaaacaggcatttgacccaagtctgtctaaatctttctctggtagcattctgcctacttgggcagtagttctcacattccttttagctgtagaacccctgaagtgggatagaatgcagacaaacaaagaaacaagccaggtaagagcagagctgccctgactggagctaatggggccagtcccagtcccataaccccccacccctgcctcacccccgacatgcttccaggcggtctgagacaccttcacaggacactgagagcttagtgtgaaaactgtcacagaagggatgcagggacacaaacagaacatatttggatctttgaaacactctatgatctttccaggtagttagggcccagataccgtctgtctttgtctggttgggagaaaggggttctgtgggacctttggtttttattctccaggatggaggtgggcatttattccaagagcaagcaatggaggataacagtggctttgacctaggaatctggttggcaatgctgagagttcctggaggtcacttggtagaagctccccagcatgaccactacctggataagtcacatgaaaggtttgtcaggaagtgtaatagtgcaattcttgatgatgtttgggttttcctctagaggacccagggcagcctgcaggactgtctgaccatgcgctcactcccatacccacagacccactcactcacatatctatgagtgcttcctgtgtaccagagcttgggctaggtcctgagaatgcaaagattaaaaacatttctccctgctctttaggagcctataggctagcagacaaacagctacaatacatggcagcccaaatgggctgagtaacatctggggttgtcaagaaggcatcgtaaagtatccaatgctattcccataagcctccaaactaaaatccatctcctgtctagacgagtcaagaccaactggctaccaggctttttgttttttcctggcaagatgcataaagaaaatgatagtatttgaaggcctcactggggtaaagccgtcatctgatgaatgaataaatggtgggacatttgagttggatcttgaaagatgattagcatttaccaagcaaagaaatggtagaaggcattctagggggaataaattgagaactggtctgggcccaccatgatgtactctgtgtatgcccttagtaatatgctcctaaacatgtctaaaacttgctttccttgtgtgcaaaatgttgataatacctatcagaattgttgtagagattcacagtgatgtttgtaaagtgtcttagtggtcttcatatataaggtttcatgataaatagctactgggtttattattattattgattactttgagacagagtcttgctctgtcacccaggctagagtgcagtggcgtgatcttggcttactgcaaccttcgcctcctagattcaagtgatcatcctgcctcagcctcccaagtagctgggattacaggcatgcaccaccacacctggctaatttttgtatttttagtagagatggagttccaccatgttggccaggctggtcttgaactcctgacctcaagtgatctgcctgcttccgcctcccaaaggctgaatttacagtctgggattacagatgtgagccaccatgcctggcctattattattttttaaattaatatgacctttgttgctggttgcaaaacttattgttgaatttggtgttgaaaacataaggagagccattcttctaactattcatagccttatggtttcttgtcctgacttattcctggaaggactgagtgctgtgtgattgtgtctggttctgatcgtgaattcacagaataattcttccattaagctttgtactccacattcactgactcacaggacacgagaaaagaaattctttatgtggacttgaaagatagggagggcacactgaagttctcacagctgatgcgctgctctgttctaccgatgtggtctacccttgtgaaacttttccatttgaattagagatctccgttaagaacccactcacgctgatctgggggcagaaatctattcaacctagtgggcatttaaagaaatcttttataggaacaaaatctgctttgagtggttagcactctgctttttgtaaagctaaaaagaaaatctgttaatcctagcactttgggggaaaaaatgtatctgtgacaaaagctgaagttttcttaaaacagaaaaaaaattatacttgggaggctgcctcttctcccagtttatttcattaataataatgataacaggccaggtgtggtggctcacgcctataatctcagcactttgagaggccgaggcgggaggatcacaggaggtcaggagtttgagagaccagcctggccagtgtggtgaaaccctgtctctactaaaaatacaaaaattagccgggcgtggtggtgcatgcctgtaatcccagctactcggcaggtggaggcaggagaatctcttgaacccaggagatggaggttgcagtgagccgagatcacgccactgcactccagcctgagcaaccgagcgaaactccatcccaaaacaaacaaacaaacaaacaaaaaacaataatgatagtgaaagagctatggccattgggcacttatttaaacactatagtagctcatttaattcaacaatagccttgccagactgatagtgttattcgtgcattacagatgaggaattagaggcttaaagaggtgtagtgccttgcccaaggtcatatagctaaggaattatgggagaaaacttgaaaaccaagtatgcttgactccagagattttgcttttagctagtaggctttatggtttcccttttatatcacattagtatttctgtttcattagtctcactatctgttggggagaatgtgggatgctcagaaaagactcatgagctattgcagtgaagttgtacctgaagtttattacatggcttctgtcttcttcctctccttagctatggggtgctactttgggagttgctgactggtgaggtgccctttcgaggcattgatggcttagcagtcgcttatggagtggccatgaacaaactcgcccttcctattccttctacgtgcccagaaccttttgccaaactcatggaaggtaagtaagccctggcctgaaccaaactggagacactttgcctcttgtaagcactgggtagagtttggccaattctgtgagatcagttactgaaagaggagataaagtttcagtcacctaaggaggaatcctctgggcaactggaaaggcttcttcaagatgacatccacaccctgctgcaagcagtcatatctccagggactgtagaagtgaaattagtaacaaaagcctgctatccggcacttcagcatattatcatttaatgcaaaatcagaaagtacagcaacttttatgtcaggacctctgaataccttaagagacgtgaagaacatcttaggagaaagaactctaaaagtcatctagtcaaaccccataattttgtaagtaaggaatctaaagctaagcgaagttgagtggataggtggccacctcattagagagtggctgagctgggattaggtagaattcgatttccctgactcccactagaatgcttttcatcctcgcctcctcatcatcccattgtgggtgggggaaggctaattcatttatttatgggaaactgaagcccagggcataattccccattgtctgttcttgaatcaggtagtaacatggtaaattgtgttgtggtggtgctttgtacaagaaaactctttgggctcgcttttcttatccttaattaacagccagaatggaatgagtacagaactgctgcatttcatttccattttcactctttatggttgtaatggtggacagtttgctttacttcctgagccttatttgaggttacctaaattctgatctctgtttctggaagaagtaagaggtagttttctgggaagtgaggccatgtaatagcctaagtcttacatgtttgcttctgtccattcatgctttctgagtattcacatgttctattcagactgctggaatcctgatccccactcacgaccatctttcacgaatatcctggaccagctaaccaccatagaggagtctggtttctttgaaatgcccaaggactccttccactgcctgcaggacaactggaaacacgagattcaggagatgtttgaccaactcagggccaaagaaaaggtaaacaaaacaaaaaaaacaacaaaaaaacgaacgaaaagaaaaaaggcatgcattgaattggtagacctcactcacagggacctctggaccgagtctgactgaccatcttgattctagcatgcccaccttccagcttggtatctacttaattgtccaaaccagcgaagaatgcagttgggcaaaatcccagtgcttggattacaggccttttttcttttctcacagtggaatgtctcaccctgccagctggaaatatgagaagttctggaaatgtttcttgattctacaatagacttctagaagaaggttaacttgatatagggatacttcaaccttgaggatagttatcagaacatccttcccatgtcttttgacatcagaatcagaaatagaatatgggcaaaaaataacatgggtctgaaattgtgtggcatttttcatgtttttatgaaaagtatttcaagcccaaaccaaccagggagttcagagactcctagcctaccagagatctgcttttttgttttggtggccattccctaaatggcccctttctgttccctcagtgtgtccctagcagtcagtgtacacacaggtgaagccagtcacatgcaactatattgcttatataggggcaggactaaatctaagggatgtagctaggggcaagagagaagtctttatagatttggttaatttcttttatctttttttttttttttttgagacagtctcgctctgtcgcccaggctgaagtgcagtggcgcgatctcagctcactgcaggctctgccctctgggttcacgccattctcctgcctcagcctcccgagtagctgggactacaggcgcccgccacctcgcccggctaatttcttgtatttttagttgagatggggtttcaccgtgttagccagaatgctctcgatctcctgacctcgtgatccgcccacctcggcctcccaaagggctgggattacaggccttttttcttttctcactctgcactatgggaatttgggaagttaatagccatgtgataataatgatagctaaaattgtttatggctttatggtttcccactttttccacttgaaaaatttgatgagacctttttgtctgttttatccaggagtcctatggctcctgccatcagtatgtaggccaggtgttattattgtttccatctcagagctgagggtcagcaacttgcctgaagtaacagagttagtaagtggggaagcagaatcttgaatgtgggtcttctgattccaaaaaccgatattcgttgtaatattatattagtctgttctcatgctgctaataaagacatacccaacactggttaatttataaaggaaaaaggtttaatcaactcacagttgcacagggctggagaggcctcaggaaacttataatcatggtagcaaacaggtccttcttcacatggtggcaggaagaagaaataagtgcccagcaaagggagaagccccttgtaaaaccatcagatctcgtgagaactaactcactattacgagaacaggatgagggaaccacccccatgattcaattatctccacttggtccctcccatgacccatggggattatggaaactacaattcaagatgagatttaggtgaagatacagtcaaaccatatcaagtgtcatttttgttctacacaaatgacttacaaataatttctggagctgatttgaagaattaaactctttttatggaacatagcaattctgaacacagtactgtttgccaagtcaatgagcattctctagaagaatggagtgagcttacaatgactctttagggtccctggtgggtggacttgcactggctgttgagcagaatgattacaaaagactgttcctctcactaaatagtattccagctagaagaatcccaagagttgctggccttttgtttttttgattgctgcatcactgacccttggttacctttcttttaattgatgaaattataagggtaccagccagtaagaaaaatgaagtttggattttgtcagtaagtagttactaggaagtcaaactcataatagctaacatttgtagagcatgtgctatgtgccatgctttcttatactttctatgaattatcttatttaatgagataataattgtctgtgtcaatgatgtcagtgctattaactccatattacatgtgatgcccttattaacttgtccaagaccacacagttaatgatggtgaagctgggacctgaacaggcagtttgttccagagtcctttctcttagccaccatgctatgatgcctccctgttataaggcttgttgtttggtaagtgagagtaagatgtgctttctctctggagagattcttcttaactcattctgtatgtggaagatgtgatttgcaaactgtgcaacacaaataggtgttgcaaaagtaggagattcaacatgtttaagggtcctccaggtgaatggtgtcataggcatatattccacaagtttcctcatttaccctatgattcagctaattcctcaggttggatcaacctactgtttctaagtattattgtgagaatgcattggtgtcatctggggtttgtgttccattaaagagagtgacttagagccagaccatcccttagacaagagcatggaggagacgagggcttaggaagcttgaaattagctttgatttttaaacttttacacttaacagcaaaatcaaccaaccaggaatattttttctgcatcttccatgaatttttcttctcttggtaatgaaaacaaagtcataggacagagaaacaaaggatttggagggcgcacaacaattaatttgaggtttatttcatcaaggaagaagtagttcaagttcaactctcaggaacttgtgataaatctatgttcccataaagaaggattgcattcacaatattgcactctatctcctattattatttctcttcattcatttattgactcaatagttattcaaccactgagtacctaggcctaccacatgctagacacttttcaatgtgctaattcttttctcatttcttttctatcactttttttttttttgagacagagtcttgctctgtcacctaggccggagtgcagtggcatgatctcggctcactgcaacctccgcctcccgggttcaagcaattctcctgcctcagcctcccaagtagctgggattacaggtgcacgtcaacatgcccagctgattcttatgtttttagtagagacagggtttcactatcatggccaggctggtctcaaattcccaatctcaggtgatccgcctgcctcggactcccaaagtgctgggattacaggcgtgagacaccatgccggccttctttctatcacttttatggctattttgacattctcctggggatggaagacaagctgaatggagagtttatagcatcagaatattgtattcatttcttgatctctttcctctcttccacttttacctgctgctcagcttccccaatatgggttcacatgcttgttttctagctccaggttccctttctacactattttgttttaatccagaatggttacttatagtgagtatttcattaagaagttaggtttcgaccacagaagtgtagctgtggctcctttactgaagaaatatcctgctttttcagacatggctctctccaggttccaccccacaccccactttaatccaaggcccagggtaaccagcattaagagtttaaaatctagatttaaaaattttgtaggcatgctttgttttctttcctgtttcctgattctatatcccctcccctcttgccaggaattcagtgctgggctcacttgtgaactcatgcgtaaggataaaggggaggtagggaagaggttctgccatctgatgtggctcctgcttccattctcagagcaggacaaaagggcctgttcttgggtcacaagatgcaattccaaatgggactttgtcccagttccaccctctagctttctggcttcagctctccccctagcagtgtgactgactgtccttcagatttgcaggggcacggtctgctctggggtgacatctcctgtgctcattgagcagtttgtttcaggggagtgtgatagagcagcagccaaatttggttctagagcaagtgcctgaaaaagacctcaggaaatgttctcttttttccttgctatgcttttgtgattcttctagagcaaatcattgtcctttaagataaggtgagagttgaaaccacatacctcagtggattcattcctcaagtgaccatgaagatttagatgacatgcctcacttagcttttgagcagccaccctggaaacatatttatattttattgttagatgttacctggaggatgatttatgtacagtggatacattttaagctggattaagttggctctgctttaaaaatatctttttttttatttttactatttatttatttttaattatactcttaagttctggggtacatatgcagaatgtgcagttttgttacatacacgtgccatggtggttagctgcacccatcaacctgtcacctacattaggtatttttcctaatgctctccctcccctagccccccactcccacagggtgtgtgacgttcccctgccctgtgtccatgcgttctcattgttcaactcccacttagagtgagaacatgaggtgtttggttttctgttcttgtgttagtttactgagaatgatggtctccagcttcatccacgtccctgcaaagacacgaactcatccttttttatggctgcatagtatcatggtatatatgtgccacattttctttatccagtctatcactgatggacatttgggttggttccaagtctttgctattgtgaatagtgccgcaataaacatacgtgtgcatgtgtctttatagtagaatgatttataatcctttgggtatatacccagtaatgggattgctgggtcaaatggtatttctagttctagatccttgaggagttgccacactgtcttccacaatggttgaactaatttacactcccaccaacagtgtaaaagcattcctgtttctccacatcctctccagcatctttgttttctgactttttactgatcaccattctaactagtgtgagatggtatctcactgtggttttgatttgcaattctgtagtgaccagtgttgatgagctttctttcatatgtttgttggctgcataaatgtcttcttttgagaagtgtctgttcatatccttcacccactttttgatggggtttttttttttcttgtaaatttgtttaagttctttgtagattctggatattagccctttgtcagatggatagattgcaaagttttctcccattctgtaggttgcctattcactctgatgatagtttcttttgctgtgcagaagctctttagtttaattagatcccatttgttaattttggcttttgttgccattgcatttggtgaaaaaacatcttttatataatagaaaaaatttggcttgtcgcagtgactcacgcctgttatcctagcactttgagaggctgaggccgatggatcacttgatgccaggagtttgagaccagcctggccaacatggtaaaacctaatctctactaaaatacaaaaaaattagctaggtttggtggcacatgcctataatctcagctactccggtggctgagacatgaaaatcacttgaatcagggatgcagaggttgcagtgggctgagatcgcaccgctgcactccaacgtgggtgacagaatgagttgctgtctcaaaaaatagaaagtaaagtacaaccaagtctgtaaataaatacatgattatattttctattcaaacctatatatatatatatatatatatataaatatatataaatcacaggcaattttaatgaagaaggaaggagcgactagaaactcttagcccccatttctagggcttgacctatggctttatcttctctgactgtcccgtcagtatggctgttctgagccttcctttccccaccattcaaggtggtctaatgttcatttaccagctatcgagtcctctctcttcactgagcatcataggagagctctccaggtcaccataagccctctgggagctctcaggcctcaccccagagcccctctgcactgagcaccccagtcttttctctgatggttctgcccatcctgcaggaacttcgcacctgggaggaggagctgacgcgggctgcactgcagcagaagaaccaggaggaactgctgcggcgtcgggagcaggagctggccgagcgggagattgacatcctggaacgggagctcaacatcatcatccaccagctgtgccaggagaagccccgggtgaagaaacgcaagggcaagttcaggaagagccggctgaagctcaaggatggcaaccgcatcagcctcccttctggtcagtggccggggactggctgggaagtgggagcagggcaaagaactcgtgtggcagagggtttgagggagcccgggactgagcttggaaacatgacaccctggggctcaaactccagcctgttttaaatgggccattctgttcactggaaagactggcatgttgaaaatctaccctactccagggaaattgttgcatgtgagtgaacacagaatatgaagtgaggacaacccggcaaggtccaggctgctagaagcctggtggctcacaggggcacatctcactttaggcaaacctggagaaggaagcatgaagttgggggaaaacattccagggtgtgcatgtgtgagacacgagaagttttggctctgcaaaataacttgtctcaaggtttcttttttttgagacagagttttgcttttgttgcccaggctggagtgcaatgacaagatcttggctcactgcaacctccacctccccggttcaagtgattctgctgccccaggcccccgagcagctgggattacaggcgcatgccaccacgcccagctgatttttgtatttttagtagagacagggtttcaccctcaagtgatccacccaccttggcctcccaaagtgctgggattacagttgtgagccaccactcctggctgacgtttttttaattagtcccctgagtgcagttgagactgggtttaatgtatgagaatttacatgataagatttacatgtgacctttcagacacacacatcagttgaataaacatgcatttgttgtactgcagccttggggaaaatataaagaaatatgaaactattaattagaatctttgtggtgtgtaatatatccatggagggagccgaatgctaaaatgtgtgttgatgtagataaagatattcactgtgttctaagtctatgaggccctagaaagcaggcttattagaagtgtaaggaacaggccaggtgcaatggctcatgcctataatcccagcactttgggaggccgaggcgggtggatcatctgaggtcaggagttcgagaccagcctgaccaacatgcagataccccgtctctattaaaaatacaaaattagccgggcatggtggtacatgcctgtaatcccagctactcaagaggctgaggcaggagaattgcttgaacctgggaggcggaggttgcagtaagcggagattgcgcccttgtactccagcctaggcaacaagagtgaaactccatctcaaaaaaaaaaagtgtaaggaacaaagaaagaatggtctaatggggcaggagtagatgatgttaagcactaaaatggtggcttaattaagtacagataagggaactcattccatgcagttgagtgaatatgtttatgagccgtgtttgctggtccccttgctgcacatttgtttttccttttcagacagcatggactctttaagcaccctttgagcatctagcatgtgtcagcatattgttgcatgtcaggatgcagatagaaaagctatagttcccacctgcagggagatcacagtctaatggggagacataggtgcaagcagcagctgtttattttacctctttgatagatgaggagactgaaactcagaaattcagacctgtaagttttacattctttatgctgtactgtaacttcctttggaatgtgtccgaattggagccatttgctccatctccctcactgccctaggttcccacaagggctagtcattgataccctgctgtgcctgcacttagtgagaagaatcagtgtccctgcttcagtccctgagaaaagaggaccaaatctatctgataatagattatgtgaaaccaataattttaagttaaatttcctagaataatcaacaacatctcatgagctaaacagctattcttaatacataactgcttgaactatattcattatatagacagctttatgaagctcacagatgaagttcacttgcacagtgaattttccatctttttatacgttcatctccccatgtcccttgggaaaaagagatgattctaaaagagaacatttcccaggtgaacaaagagcttttcaggaaactggggcctgtccctcaaggatgctgaggaatgtcatatttcttatatgaatttaattatgggaaatgttaatgcatacacgtgtttgtctttccccaagcagatttccagcacaagttcacggtgcaggcctcccctaccatggataaaaggaagagtcttatcaacagccgctccagtcctcctgcaagccccaccatcattcctcgccttcgagccatccagtgtgagactgtttcccaaattagctggggccagaacacacaggggcacctgtcccctgctctgtccagccaccgactggtccaggcttgctccatccataacttctgccacctctcctcgacaatgtgtatatacatgcacatatgtacgcaaacccttagccctctcccttgtctctctccattaactttactactgccccctctaccttttagtcacatatcagcaaagggatttgtgggtactaatgggatctttagtggtttgcaaagcaatttagaaactggtgtgtgatgtggatacaggttgctacctggcctgagaacctaacacactctttgccatatttggggcatcattgtttttctttagtccacacttcccaaggaagggtttttttttcaaagtataggtcctaaggaaacttgccatatactttataataagccaaatctggaccaattttatctttgctacagtatttgcttaaaaaaaatactcacacatacatgtaagtgtgtgtgtgtgtgtgtgtgtgtgtgaacatacacctatatgtgaatgaattagtttccctggtttaaagacagattttatttaaaaatccaagatttcggctgggcatggtggcttatgcctgtaatcccagcactctgggaggctgaggcgggcagatcatgaggtcaggagatcgagaccatcctggccaacatgctgaaaccccgcctctactaaaaatacaaaaaagttagctgggcatggtggcacccatctgtagtccgagctacttgggagactgaggcaagagaatcgcttgaatgcaggaggcggaggttgcagtgagccaagattgcgccactgcgttccagcatgggcgacagagtgagactccgtctcaaaaaagaaaaatccaagatttctagctttccttgaaaaatgaaatcaaatcagtaggtttcttttttcatgtggctacagttggctggcactaatagcagcttccgtatactccatattttgcctcagccccttcagctccttgttttttggtaactagtttgctcgtttatgatataagcacagtccctggggcatttgggtctcaacccttgctccaaggtattaatgtcagaaaaatattcctcctctcttatctgtctttctctaggcctctttcttccccttctcccactccagacttccttttccataaccttgaactcctcattttcttcccaaccctttctttccaagattcctgcatttccacgccttccttaccccttgtcttttttccccccttacctgcctccttatttgctcactacccaatcccacccaacaaaacaggtaaagtcagatctgtttggaactctgatgtctggctggcctaagctctagctttacattggatttgtgaaaattgaagaagtgtttccatgtttagtactttgagagagctaaatgattggtggctgagaactccattactttcctggaagggtccacttgggcacagagtttttgataaggtctaacttccctgcagctccaaatgtgtgtgtgtgtgtggtggtatagaggctagtttgggggagccctgtctgtccattttctagatcctatccaacccttgtgattcacagtgacaccaggtgaaagcagcaaaacctggggcaggagctcagtcgtcccaaaggaggaaggggaggaggaggagaagagggccccaaagaagaagggacggacgtgggggccagggacgcttggtcagaaggagcttgcctcaggagatgaagggtaagtgccagatgacatgaaattctttctctcttgaagatggatgtaccatttaaacataggatatgaaataactttttttctctgtcgtgtgtttgattgctttctgagaaattacaagcttcttgatctttacaacagtttttcaccctccaagttcctggaacgtcctagaacaggcatggaaaactttttccataaagagccagataatacatattttaggccttgtgattcctatggccctgtcacaactcttgagcgccactgttggaacacagaagcctccagagaccatggacaacatgtaaatgagcgagtgtggctatgttccagtaaaaccttataaaagcaagtggcgggcagggtttaacccaccagttatagtttgccaacccctgaaggcgttctactcagagtagcaagtagcccaagcagtaaccaaatgtaaaaagttctgccagggtgttctgcttatacctggctcttcttccatttttaaagcagaggaaagagaagaaagagcagaagttaacaggactctcttgcctagaggctcatgctgaagcaggggcaggcagaataacccagctctggtagtacagttgtatacaactccagggccgctagaactattttcagatctcaccccatagccacactgccatgtatgatggctcctctgggcagggcacaagaggggtgagagcctggagtgtgcttgtgttctcactcgtgggcttgagtcctgggggtcaaattctcccctgagtctgggttcttcacaggcaaggcactcatagtgtagtaatgaagatctttgactctggcaccaaactgcctgggcatgaaccctggcaccaccacacctagctgtgtgacgttatgttttctcatttataaatggcataacattagtacccatctcatggagttgaggcaaggaccaaataagttcatctttgtgagtgcagagaggatgagctggcccatagtgagcgtatgtaaatattagctgtgatgacacttcctgcttctcatgcaattttacatcatatctgaagaatggacggaaccgtttatacttcatattcttggtgttagaagctagcacagtgtttcttgatgtttctattaaataagtgcgaggatagccagcagtctccttccacattttttagtgactttctaaagagcttctcaggttgaatattaggcttacaagtgccctgaacctgcaagtggccttggtaatcctttaaacactaagattccatgtccaaaatctatgattttcccatgtcagatctgagccgaaggtaaaaataacagtttgattcataaaggattgactctctgaagctaggctttgtaaatcactagatacctttgagcagaaagtttagatatgtagggcaaactacctcagctatgtaagaatccagcgatggaatccttgggggatggcagattcttctactaagttttgtaggagcaagagctctccagtttgtcccttgagctctgggctagagtagggttgagctgggtctgagaaactcagtcaccctgagtctcttgatttaaatattttttttcttttggtcttggtagtaaattaactttatttcacattgcaaaatattaacttcggaattttcttcttcctcacaaacttttgaaggaattaaaaaatatatgacttaattttttcatgagtcttagttcctattgaagaaataaaagtatattctatccagacttgagtgaagacccctttaatgtcagaaattttgagaacttctatgtgatattatttctggttttagtaccttttgactaaagaaaacacgtgatgaacaaaagccattttgaattcagtaatgttaagtgagttttgcatcctcatccttttaaaaaataatacatatttgtccaaaacatgcatacctgtctatagactgcttgggtatctatggattcacagtccccctgcaaccgtgctgcagctgcccagggatctttgtcctgggcctgtcttggcttaaacaggaccatcttgttaagattctttcatggtgtgggctttgtgtctggacagtgggaaggcagctggcgatgtggtgtgaatccagccttgggtgttttggtgtgggagaggctgagctggatgtgccctccattgcctgctactgattctctttattcattgaagatcccctcagagacgtgagaaagctaatggtttaagtaccccatcagaatctccacatttccacttggggtgagtctcatcttcaccctttcaccaactgtcctggtaacaatctcccttccatttccttgttcttacagcataccccatagaatcaagcctcgttattgccagggctgaactgacttttttgtttttgtttttgttttaagcagtaccattgtgcaccttgggaaaattcctgtgttgatctaattttaccatattcttcactccactgaccactccaattaggatactcctggcactcttggttttagagaggcttagatatgtggctatttatcctttggtcttcagcactggttttgactttactaatctggattttcctggatccagagctggaagtgatgttacgagagtctcagtaggaagccccaggctgtgggtttggcagcaggcttatctctgactatattttggttgaaaccagtggtggttgggatgtactttaatttgctggtatttctgatagcacttgaaacagaattctgaacagcgaaaaagttggtcctctgtctctctcaagatggctgggactttggggaaagtggtctttagttgaatgattcttcctagacttaaaaaaaaaaaaaaaagagccactctggtcataatcccaatatttccagggcaaccatagcccacagattcctcagtcctcccttttactgtcctctagggaaaagaccagtgcttctaggcctctggttcccccctcctacaaagtggttggcagggtgcccaggctgtatcctcggagagttaccggctttccatatgggctgatgacagggatttgaaagcgagctcctgtcctctgtctctccacccccagacagaccaagggctctgcttcagcactgtgcactacccacataggtctgtcccacagtgcactgggttggtgcagctttgtgggttggttttgccttttaaaaaggggatggctttgaaagttgcctaagcatgccataaagcttggaaggaaagcctgagaaatgccttatgtggagtagcctggtccacctctgctagctcggctgcccggtgcttgcctggcttcgcaggtctttgcatcaccgtaactgtcatgccatgaatgtgttgtgtccagtgtctgcttcgagtgcttctctcttgagatgggctcaggcaagacccccagccagcagggccatccttattctttctgtctgcttgccagcttgcccactagttctttctacagttccacagcagcatgtgagggggatgggtcatgtcattgcccttttcttccctggagcatgtgcatttctgtttgtgaagcaggtgggcttggtaagagtcattgcctgtatgtactccaaggttctttggtagaatgaagcaggcagggagaaacgtctccatagacccatggagctgagggtcaagtaagaaaggtaaccagttctgacagtttcctcttttcctctgattcagcctcaagtccctggtagatggatataagcagtggtcgtccagtgcccccaacctggtgaagggcccaaggagtagcccggccctgccagggttcaccagccttatggagatgggtaagcatagctcctcttgagagtcttggctgtctccctgctccctgggggcattcttgcccaagcttctaggaccatttaaggacccctagcactgcttcatggaggaaacattgggaatgtttttgttctagaatgttcagtgttctagaaactcatactacacttgtgttaaggggccggtattagtcagggttctccagagggagagaaccaatagcaaccaaaaggaagtttattagggagaattgtctcacacagttacaaaggcaaagtcccatgacaggccgtctgcaagctggagaatgagaaaagcctgtagtatggctcccagggaagacagtagagtggctcaatcccagtttgaaagccttaacaccagggaaaccagcagtgcagctcccagtctgaggcctgagagcctccgaaaggcctcagttacaagtctgagagtccaaaggctgaagaacctggactctgatttccaagggcaagaggagaaaaagtgtccctctccagaagggagaaacagagagaggaagctcagcaaactgagcatccccctttttctgcctgctttgttctagccttgctggcagccagttgggtggtgcccatcgacattgaaggtgggtcttcctctccctgccccctgactcccatcttagtctcccctggaaacagcctcacagacacacccagcaactgtgcttcaccagccatgcaggcatccctcagtccagtcaagtggatacccaagtcactatcacagatcccttatgaaagaaatggcaaattagcggatcttttattctgctctaaggaaatgggctctggaatggagagtggtttccctgtgttggggggtggataaagcccccttggttcagtgttcaattccatgtcctgctcatcacaccattgaacctttgtgtccctgagactgagacaggaggcctggggtgaggggaaagggccagattcttattcctgccacctcatttccatttcctgtttctcttccactcttgtcatcttcacagaggatgaggacagtgaaggcccagggagtggagagagtcgcctacagcattcacccagccagtcctacctctgtatcccattccctcgtggagaggatggcgatggcccctccagtgatggaatccatgaggagcccaccccagtcaactcggccacgagtacccctcagctgacgccaaccaacagcctcaagcggggcggtgcccaccaccgccgctgcgaggtggctctgctcggctgtggggctgttctggcagccacaggcctagggtttgacttgctggaagctggcaagtgccagctgcttcccctggaggagcctgagccaccagcccgggaggagaagaaaagacgggagggtctttttcagaggtccagccgtcctcgtcggagcaccagccccccatcccgaaagcttttcaagaaggaggagcccatgctgttgctaggagacccctctgcctccctgacgctgctctccctctcctccatctccgagtgcaactccacacgctccctgctgcgctccgacagcgatgaaattgtcgtgtatgagatgccagtcagcccagtcgaggcccctcccctgagtccatgtacccacaaccccctggtcaatgtccgagtagagcgcttcaaacgagatcctaaccaatctctgactcccacccatgtcaccctcaccaccccctcgcagcccagcagtcaccggcggactccttctgatggggcccttaagccagagactctcctagccagcaggagcccctccagcaatgggttgagccccagtcctggagcaggtgagtcttcttcctcttttctctttcctttctttgtgcctcctcagggagtgaagatgtttgcaggcctcattttctctttccacttcgggatttgagtgaacaccattcctcctcttagccaatcaagaaatacagatctgggatcagggaggcagccagggctggctgacttttctctgacctgtgcctcaggggtcttccctgaggattgaaagaagacaggcaggttctaggaagaatcagaagacctgggactcctttggaatgtccagaccctgagtcttagggtagggtagtgttttcagggcacaggaagggcaggagtctagcttctagttattccctgaggaggatgatgcattttccaggaaggaatcttgcactgcatgtgggagcagtattttctgccacatagctgggattttgcctctcattatagcattagttcacacacactcagaaggcaggcttccacccattcatcacactcttcaacactcacccctgactcatacctgcctcttcaggcgtggagatgagtccaggcaaattgctatccccgtgcatatgactgccctcgacatctgacacctggggacacacactctttcctgtcaccatctctttcctgtcaccatctctttctccctggaagacctaagtctgacttggaaacagcctctaatccagtaggaaaagggggcatagtaataccctttcaatgagatttaagtgtcaacaacagttgtatttaactgtttggcttgacctgccctcctgttttttgttatactcagatatgtgacctctttgggaacagaaaccctacattactcacctttggacttctgatacctagctctgttcccgtcacatgtttattacatggatgagcagtaaatgaacagacatgcccttgagtcaggaggcagcaagcttttttggtgaagggccagatagtaaatattttaggctttgtaggccgtacagtttctgttgtaactaaactacgctgccgtagtgggaaagcagacactggatgtggctgtgtttcaataaaatgttattgtatacctttttttcttttttttgagacaaagtttctgtcacccaggctggagtgcagtggtgtgatcacagctcactgcagcctcaacctcctgggctcaagtgatcctcttgcctcagcctcccaagtagctgggactacaggcatggaccatcatgcctggctaattttgcaaaaaaattttgtagagatggggtttcatcatgttgcccaagctgttcttgaactcctggggttaagtgatcctcctgccttggcctcccaaagtgctgggattataggcatgagccactgtactccacctaaaaccttgtttataaacacaggtggccagcttgtgtgtcatttgccaacatctgccttcagttatttcattacatgtgacccccaaatgtcctattattcttatcagatacagggatcatggccttctaggtcactactgtatccccagtgcctcccagtaggtgctccacaaacatttggtgattcatgttctcctgattgcgtagggatatggtggtgttgggggggagtagcggatatctaaccccgaaatatggtgcctcatctgatgcttctccttttgtctttttgaccaggaatgttgaaaacccccagtcccagccgagacccaggtgaattcccccgtctccctgaccccaatgtggtcttccccccaaccccaaggcgctggaacactcagcaggactctaccttggagagacccaagactctggagtttctgcctcggccgcgtccttctgccaaccggcaacggctggacccttggtggtttgtgtcccccagccatgcccgcagcacctccccagccaacagctccagcacagagacgcccagcaacctggactcctgctttgctagcagtagcagcactgtagaggagcggcctggacttccagccctgctcccgttccaggcagggccgctgcccccgactgagcggacgctcctggacctggatgcagaggggcagagtcaggacagcaccgtgccgctgtgcagagcggaactgaacacacacaggcctgccccttatgagatccagcaggagttctggtcttagcacgaaaaggattggggcgggcaagggggacagccagcggagatgaggggagctggcgggcacagccctttctcagggttggaccccctgagatccagccctacttcttgcactgataatgcactttgaagatggaagggatggaaacagggccacttcagagggtctcctgccctgcagggcctttctacccgtgtccactggaggggctgtggccatcagctctggctgtgtaggggaggaaggggtgcatgcatgtcccccaccctccacagtcttccttgcctttagagtgaccctgcagagtcactcagccaaatctgtctgctgctccctctcctcagccagttgggtgtgcgcagagctgtcatagggtccctttgtcagccccgagttcagcttcccaaacaccagtgttggatattctgtgattgattttggtcctcctccgctgtcccccaacacccaggaatgggaatctggcttggttcgagataggagcttttctgtgtcctaagccctttcatgctagcaggaagactgaaagcaaggtggcccagtgtggggtcatagggcttgatagacctggcactgcctatctgcacttccaggtgccccacctatttatctgagcccacaggtggaaaggggaactgcctcagtgagaacggggggacggggatgttaggaaaaatacagtaaagttgcaatgaagaggttcatgaagtatgtccttgttctttttggaaactctcggcaaagggcaaaccagcaagtattgagggtacccatctagctacttggggtcaggacctcgtcagaccaggttcggatacaatcatctgctcatcccaggaatagtttcttgggggactcactcactggtgccagttctaagtcagagacaaaattccactgtctgttccttttgctgtctgaactttatgtgttactcccttcctttggtcttcactctaatccctggagtttgtgggcttttggttatgtttggttagtagatatcaccgcaatgccctagaacagctatgaagcagaataccatatggccacctggacattgggacttgggaattcactctcaactgggccatccatgttgtgatgcccttgaagtaaaatggagccagcaggagtaccttctgtaaatgcatgtggcaaagtgctatttatagggtgcccagggagccgctgatgtacaataaccttgaggtcccccatactgaaaactgaccaaggcctgtgcacaggtagcccctcatgctgggctctggaccatgagctgagtaggaaggatagcagaggccaaccctgaccttcctggaagttgtttccttaacttgaatgttgagcttcctctaaagctttctcgtgtatgtcttctccatgccactactctgaggcctcctgtgttatgtgtgaacagttgtctttatgtgggaatgacgacttgattgggagtagagtctcaaggtcattcccctcttccctcaagactctctgaatgctgctccactgtcttttgtcttggaggtcactcagcaggttccttgcatttgctgcctggatgtgcagctggcaacagtgatgaattggtcactgctctttctctataactgggatagatgtcctgccttggggtcactaaaggggtgaccttgttccttgctttatgagcccattagcactttggttcaaggggcccaccaagtcttggacgggaaggcgctactggttttattgcccaaggttttgttattgcttctcttctgtgtccttctctttgttcagtgaagccaatatgtaagatactgtttttgtccccattcccctactcctgagctaggaggaaaaaatgtgaatcttaccagcagttccagccaaccaagtgattcttcttcattcttgatggggagaagtacatacaaagtttgttctgacagggcgcggtggctcacgcctgtaatcccagcgctttgggaggcagaggcaggtggatcacctgaggtcgggagttcgagaccagcctgaccaacatggagatatcctgtctctactaaaaatacaaaaaaattagccaggcatggtggcacgtgcctgtaatcccagctactcgcaaggctgaggcaggagaatcgcttgaacctgggaggcggaggttgcagtgagccaagattgcgccattgcactccagcctgggcaacaagagagaaactctgtctcaaaaaaaaaaaaaaaaaaaaaaaaaagtctgttctgtggcctccttcccccgggccctccataacctcaggctaaaccatgaacacatctgtatatccttggctccactaaatggccctcttgtggccctccaaaccatgctgcctatacacagtgctctgtggtatgaagcagagatttttcctttgctcatttttaacttttgccattgtggtaggttgcagccatctttctagatgtagtgtaactgatgtagtgtaactgaatgatggtcacctgccattgagtgagaggttgagtgccatccttacttgtccactgtggggaaagataaagcaagcctgggtctttgctaaggaaataattgtacctgaaagaagcaaaagcagggctatccaaaggtgctactgtgagcatccatgaagaaggaacagttaccatctctcagctcctacacacctggtctctgatgggcccctgactgctgcactctctcagtggggcaaggttggagatgggctaaggatctgtatagtagtagcaggtctcagtggctttctattcgctcaggttcccttgttctgtggtcctggtcgggagcaggccctggagctgtggatgaagccacttgagtggcagtagccggcccccctttcctctgccttccctttgcacaaagacacgttccttctgctcttggcaggtgctaacttcatggaagatggtaataggaacagatactgctctctgcccctgcttcttggattcttcagctcctaccgctgattcggattatccccttttgaccctcttggggatccagactgctgccaggaggctgagtagatacctcagttatctgtatgttatttctgagaggctttggcggatcctcttcacttggcatcctgtggcatccctagggtctggtggtagcagtaatagcaacaatgatatcttacatctggacaactcagaatagtgctaacttttcctcctgacctttgcaaaatgacatcattttccttgtacatttgatacccttgctagtagagaaggggaaatgcttaaagatgaaaattcaagtgaagagaaatgaaaaagtggcttggactaattgctgagtgaggccactgggctcagaactgaacaggttggctgcattccccattctgcttttgctgtgtggccataggcttgtctctttagcccctctcagatttccttcctttaaaagcaatcatcacatgctttcctctcaagggagttgggtgtatgtatcagagaaggtcagtgaaacaccatagctccttgccagctcctagaggaagcttctttcatctatacaggatgaatcgctgaagttgagagtgtggctctcatcacctttgccttgagggaacttgccttttctttcgtcctttggcttctggaagaggagtgatttggaggtggttgagcatgactaatgggggccctggtcgggcccatgcccttctgccgcatttatatagcatctggtgttgacaagcattctttcctaattcccccacttaacttgtctgatgctgtctgccaatgtcatcctcaccacttgtgtcttacagagaaggaaatgggagagggaggttgtgtcttacagagaaggaaatgagagagggaggttggtagcaacatcagagtgacagttggctgtctctcatttcttggggtcatcagtctgatttgtttagagcctgggatcatcccagttcctggaagaatctttggaaaagggtccccttgttcttgggacatgtgtcatggtcactaagccccctttccctcaggctactgttgctcagggacacaatgagataccccaaggacatctagacctgacttttcatgaactctcttgcctctgtggtccccacattggagacctccctccctcctccttcccttgtgtgaaggagacacctcccgagcaatcctaactcatccagctcacttttaacaaagcaaagagcagagggcactgaagactggatggctgtgaatggtacaccttggggttgaaaccgtgttggcaggaacctggtgataaaagctgcctacttcctgggtgtgtgaatttgcacatatcttttcccctcactggacttcagaagcctactgtgaactggggacgatgctatctactttccctcctgaagcccttctaactttcaaatgtatggtcctggggccatgagtcctgcacagaaactgcagccttgccagattgcttcccttggtgcagaaaagtgtgtgtgtgtgtgtgtgtgaaatatacgtacggttttacgtcaaaaacagtcgaatatcagctatttcatatggttcaccctaatgtacctgcctctctctttggctttaggtctgagaatgacttgtctttgtcaaggtatactattgttagaaacgcattaccaaatgcatctcttctgtcggatcagcgtattcctagattaggaattcaaattaatgaaaattcacatatgaaaggaaaatccattgctatttctggagaggacctcagtcctgggcttttccctggcattgctacctgggtgggtgctcaccactcaggtgctggtgttggaaggcaggaggaggaagctgaaatcctgccgattaaggctaattaacagggtttaggtgcctaattatcatgactcagcccgggacttatggttagccgtgcaggccaggtgagtctcttatggacttcctctcagactgctctttctcattttgtcctgatgagatattgacagtcatgtccacccgcttcctcatccatttcccgtcttgggccctggaagtacgggggcctctgtaggctgcctagggagccctggctttgctcttcgtgttgggctcactccatgatcaggagccggtgggactggtccttcctgattcttactgtctgtggttccccatcccctacggggagcctgctttgggccttgagctggatagagagaagagctttggggcccagctggttataggagctgagcttttccacacctctctttgttaacccttggaaacagacctgcctttcacctgacccatcttcctacctgtctggtctgacctgccctctttgaaagcactcatcacctagttttactaggctgattggcagatgtggacatgacaggtgtctatcgagataggtgtctaactagttaggtgtctcaggattggacagcagaataccattccaggggtgcacagacaggcctctcctaccggaacatgagggatagacgtctgggcattctgaacccagaggtcagagtagtcacaagcggagccctggggagcgagggccccagggccgtggtgttccttgccctgcgctcactgaagtccaaggccaggtttcagaaatagtgtgctgcctgttcctgagatccttcacacctggacaccaacccagacaaagcctgacttaaaattttgatactgtattcatcgtggaatttttcaataactctgatttttaaaaaatactgcattgcaatatgatttaccttgattactgaggctctttttttttttggcacccctttaaattttaacccaaggtgagggcctcactccactctatacccagccctgcctgcccctcacctggacctgtgagaggggcttaggtaccactgtgaaatacgttttaaatttttacttgcccttcccctcaggtcctgagtgaggcagtggctctctggcggtgctcgcatttaaataggagtgtgtaggcttacagcaatgaaacatctaggagcttttaactttggatctatacctgggtgtgacatttccttggtgttctctggctgcctttctggctctgcagccctgagggcacttgtgtgtgtgtgtgttctctggagaagggaagtgattatggcagagaggctcctttagattctcctcttaaacctctttggaacatgtttgaattccagaagtgaatgaacttcattcattctctcgtccagatttcagaagggactaaagtgaacggaggctttttcactccctggcatgctaagagccacattccctagctctgtgcctgcacagtgagtcttcagaatttggcccatcacaccctctgctagtatcgtttccaccaccctcctcatcctctgtcatctttatttcattctcatcgtttatctctacctccagttcagatgccatgctggctgtggctcttttcttcatcaccatcagagtgaggcaaagatgtatcctggcctagttataaagacgaataatacatgataagaaatcattaatttttttccacgtggggggcggtgctgtcctagtgattcatatatatataatttttgactccttacaataattctgggatgtgggtattacccccatttaagaatgtggaaaccaaggctctgatggctctgtaatttgcccagggtcacacagctaggaagcaagttgctgatctgcttggttccaaagtcacctctctttttcctctgagcacatttctaagccactacttagaagctcttgagataaagttggcctagctcaggtccaccgaggttttgagattgccctttgcccaaggaggagttgtgtccttggctcacctgtcatctgcctgtgactggacttgaaccctcgcacgtctcagctgacatccttgatgctgctggctgccttcctcgccctgtttcctctccatgactccaggggtttgaagcacacaggagctggacatgtcaattctgtagctcttctcccaataccactgaaggccgtgagcctctctcctgtttccagcctgcaggtgccctgttgctgctcttcattccagcttctcctcacttttctctcagtctcttgagcttggaagccttactgtagcttgtgtctcctccctgggcacttgaggtcaggcttttgcctttttgtcacattgagccacatgcctttgatacacagttgtagcaaagaagggaggtgatgaacttgctcactttcttttctgatttccctccctactcatcctgcactccccaccgaaacccagatatcttatagtctaaggcttgtagaggattaaggaaaggaattggagatgggttttacttagttcacagaaaagctttctttgggatttttcctcccccttagggcttttaagtctaggtgaagtgaaagttcacacatgtgtttgtttggttgctctgtaattagctactagtttttatccctagaccttctctgctccagtgtcttgttcatgtgtcctgaccccgtgtccttgaattcccactttgctttgggatttaagttattgtatgttgtcaacaatatttaaagatgaaaaagtcctgaaggaaacttcctaggaaactttttttggcttttttttttttttctttcgaggtactgtaaattgttaactagggatgccaagcaggcttggttcaatggctaaacctcttattgtattacagtgtaatgctgatctcagcctggtctcaatgccagagcacacagagacttgaataaaactgttataacgattacctctggtttgttgtggttctttgtaaactcatcctttcccccttctttttcttttttttttgagatggagttttgctcttgtttcccaggctggagtgcagtggtgtgatctcagctcaccacaacctccacctcccgggttccagcagttctcctgcctcagcctctcaagtagctgggattacaggcgcccaccaccatgcccacctaattttttgtattttcagtagagacggggtttcatcatgttggccaggcttgtcttgatctcctgacctcaggtgatccacccaccttggcctcccaaagtgctgggattacagacgtgaaccaccacacccagcctctttttactttttaattaaactgaaggccatgagtctctctcctctgtttccagcctgcaggtgctcaagtaactgagctgtttccagggagttttcatatgtaggaaagaaagaactggagaaagacggaaatgctgtagaaaagaggaggtgggtgagaagcttctctgagggtctaggagcctccagcaggaccatgggagcctttgtgaatgatggtgctgaacggtgcagtctctgctcacagttgattttcacacagctcgtggattttggctttcagagccacttgtgaatatgtgctgtctcctactccctacaactaaccatgctgacattcctggtgaagttgtgaatggagctaagaggacaaacagatggagttatagacatgtgaataggatttgctggctgtgagtcacagattccttgtagctctgatgctcttaatggcactcgtgagctgtgtgaccttggcaaggcacttaacctctctgggcctcttctggagcaagctgatcacaaagcagcctttgtgctctcactttccatgattttgtgttaggtggggatgaggataaaagcagacaggatgaatcttgtttgaggccattcttcactgcttgaatcctctatttcatcactcagctacatgtggaagaaaacgacttctgaacttaaatattcagacacccttgtgtgaatgctgtaacctttcatttctctctgacctctttgctcttttctctgacacctgaggaggggtgactccgaggtggggttctgtgctggatgcttggattgggagggcaaagctgacattttgctgagccttgaggttagtttcaccaggatccagataacctttgtaaagccaactgggcaaaaatgaaaaattgaccaatctccttgctggtgccatatggaaaggtgccatactatttttgttttgttgagacagagtctcgctctgtcacccaggctggagtgcagtggtgccatctcaggtcactgcaacttccgcctcctgggttcaagtgattctcatgcctcagcctccccagcggctgggattacaggcacatgtcaccatgcccagctaatttagtatttttagtagagatggggtttcgccatgttggttaggctggtctcaaacttgtgatctcaggtgatctccccacctcggcctcccaaagtgctgggatttcagacatgagccagtcacccagccaggcaccatatactgttaacatgtatacaaattgctgcatgtttctggaaagcagcttggccatatggtattaaaaactacaacacaggcctagtaattctgttactactccatagtaataaaaactagtttaatgtgtcaactgttgcactaagacctgacctatgttatctcatttacaatatttcaacatctttaagagtacatccattattatctccattttacattgaggaaagtgagggccagagggttgagtaacatgcccaagaccgcacaactggcaaatagtggagctgggacttgtctgattctggcatctgcgtttgtatcataagattgagttggggcctggcacggtggctcacacctgtaatcccagcactttgggaggccaaggcggttgaatcacgtgaggtctggagtttgagaccagtctgaccaacatggtgaaaccctgtttctactaaaattacaaaattagccgggtgtaatggcacatgcctataatcccagctactcgggaggctgaggcaggagaatcgcttgaacctgggaggca

SEQ ID NO: 1871 - DNA, 3027 bp, Homo sapiens
ctgggctgcgacgcgccgctgccctactggacggccgtgttcgagtacgaggcggcgggcgaggacgagctgaccctgcggctgggcgacgtggtggaggtgctgtccaaggactcgcaggtgtccggcgacgagggctggtggaccgggcagctgaaccagcgggtgggcatcttccccagcaactacgtgaccccgcgcagcgccttctccagccgctgccagcccggcggcgaggaccccagttgctacccgcccattcagttgttagaaattgattttgcggagctcaccttggaagagattattggcatcgggggctttgggaaggtctatcgtgctttctggataggggatgaggttgctgtgaaagcagctcgccacgaccctgatgaggacatcagccagaccatagagaatgttcgccaagaggccaagctcttcgccatgctgaagcaccccaacatcattgccctaagaggggtatgtctgaaggagcccaacctctgcttggtcatggagtttgctcgtggaggacctttgaatagagtgttatctgggaaaaggattcccccagacatcctggtgaattgggctgtgcagattgccagagggatgaactacttacatgatgaggcaattgttcccatcatccaccgcgaccttaagtccagcaacatattgatcctccagaaggtggagaatggagacctgagcaacaagattctgaagatcactgattttggcctggctcgggaatggcaccgaaccaccaagatgagtgcggcagggacgtatgcttggatggcacccgaagtcatccgggcctccatgttttccaaaggcagtgatgtgtggagctatggggtgctactttgggagttgctgactggtgaggtgccctttcgaggcattgatggcttagcagtcgcttatggagtggccatgaacaaactcgcccttcctattccttctacgtgcccagaaccttttgccaaactcatggaaggtcaccataagccctctgggagctctcaggcctcaccccagagcccctctgcactgagcaccccagtcttttctctgatggttctgcccatcctgcaggaacttcgcacctgggaggaggagctgacgcgggctgcactgcagcagaagaaccaggaggaactgctgcggcgtcgggagcaggagctggccgagcgggagattgacatcctggaacgggagctcaacatcatcatccaccagctgtgccaggagaagccccgggtgaagaaacgcaagggcaagttcaggaagagccggctgaagctcaaggatggcaaccgcatcagcctcccttctgatttccagcacaagttcacggtgcaggcctcccctaccatggataaaaggaagagtcttatcaacagccgctccagtcctcctgcaagccccaccatcattcctcgccttcgagccatccagttgacaccaggtgaaagcagcaaaacctggggcaggagctcagtcgtcccaaaggaggaaggggaggaggaggagaagagggccccaaagaagaagggacggacgtgggggccagggacgcttggtcagaaggagcttgcctcaggagatgaaggcctcaagtccctggtagatggatataagcagtggtcgtccagtgcccccaacctggtgaagggcccaaggagtagcccggccctgccagggttcaccagccttatggagatggaggatgaggacagtgaaggcccagggagtggagagagtcgcctacagcattcacccagccagtcctacctctgtatcccattccctcgtggagaggatggcgatggcccctccagtgatggaatccatgaggagcccaccccagtcaactcggccacgagtacccctcagctgacgccaaccaacagcctcaagcggggcggtgcccaccaccgccgctgcgaggtggctctgctcggctgtggggctgttctggcagccacaggcctagggtttgacttgctggaagctggcaagtgccagctgcttcccctggaggagcctgagccaccagcccgggaggagaagaaaagacgggagggtctttttcagaggtccagccgtcctcgtcggagcaccagccccccatcccgaaagcttttcaagaaggaggagcccatgctgttgctaggagacccctctgcctccctgacgctgctctccctctcctccatctccgagtgcaactccacacgctccctgctgcgctccgacagcgatgaaattgtcgtgtatgagatgccagtcagcccagtcgaggcccctcccctgagtccatgtacccacaaccccctggtcaatgtccgagtagagcgcttcaaacgagatcctaaccaatctctgactcccacccatgtcaccctcaccaccccctcgcagcccagcagtcaccggcggactccttctgatggggcccttaagccagagactctcctagccagcaggagcccctccagcaatgggttgagccccagtcctggagcaggaatgttgaaaacccccagtcccagccgagacccaggtgaattcccccgtctccctgaccccaatgtggtcttccccccaaccccaaggcgctggaacactcagcaggactctaccttggagagacccaagactctggagtttctgcctcggccgcgtccttctgccaaccggcaacggctggacccttggtggtttgtgtcccccagccatgcccgcagcacctccccagccaacagctccagcacagagacgcccagcaacctggactcctgctttgctagcagtagcagcactgtagaggagcggcctggacttccagccctgctcccgttccaggcagggccgctgcccccgactgagcggacgctcctggacctggatgcagaggggcagagtcaggacagcaccgtgccgctgtgcagagcggaactgaacacacacaggcctgccccttatgagatccagcaggagttctggtcttag

SEQ ID NO: 1872 - protein, 1008 aa, Homo sapiens
LGCDAPLPYWTAVFEYEAAGEDELTLRLGDVVEVLSKDSQVSGDEGWWTGQLNQRVGIFPSNYVTPRSAFSSRCQPGGEDPSCYPPIQLLEIDFAELTLEEIIGIGGFGKVYRAFWIGDEVAVKAARHDPDEDISQTIENVRQEAKLFAMLKHPNIIALRGVCLKEPNLCLVMEFARGGPLNRVLSGKRIPPDILVNWAVQIARGMNYLHDEAIVPIIHRDLKSSNILILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEGHHKPSGSSQASPQSPSALSTPVFSLMVLPILQELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQLTPGESSKTWGRSSVVPKEEGEEEEKRAPKKKGRTWGPGTLGQKELASGDEGLKSLVDGYKQWSSSAPNLVKGPRSSPALPGFTSLMEMEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 1873 - DNA, 148815 bp, Mus musculus
  misc_feature (1)...(148815): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggaggaggaggaggaggaggaggaggaggaggaagaggaggaggaggagagagagagtttaggaagccacacaaagcaggtagtgggattcagagttgaatgggtgcttaagcagtctgcacgagcctgaccttgggctttcccttgggttttcagtcccatgagtcccaggacagctcccgcaccagggtccctgtgaatgatgcacaggggctatagtgtggcagtggcacatgcctgaaggtcttttctcatttgtagggagaaattgagaaggctctctaatggtgcccccgatacaagtaaatagcaactctctcagttcattacttgttagccccaggcagggactgcgccgattggctaattgtaatagccaaaccattaaagggaatagcattaatggaggagaaggcagctaatacggtagctgaacttggctacagccttgtacccagggtacaggctgctgctaacttaagtacctgtttgttctgcatctggaactagccaggaagaaagaatttagtgaccctcttcaaatggtggatccataactcaggagtatttctgggaaactcagacattgaaacagttttttttcccagaggtagcccttgagggtctgtgtatgtaaaaacactcacctttcctaccgtgaacagtgctgctggcccactgggaagagagctcatacactttaaggcgttttccaggagctgtggcgaatactgccagcttcatctgtcctcagcttcaagctattgtagcatcgttagctgggactagtgtgccgtctaggcctgggaatggcacgaatttaattttcctgtccaggtctgaagcttgtaaccttgctcgcctgtgcatgattccggggcctggccagatgagccagccatccgtgcatcggaagatctgggccggctccacagtcctccctggaaaccacacgctggcattgctagctaaagaaccccggcttcacttgctgctttctctccgtgtcagaaatatccaagaaatccagaaaagttgcaaagaagaaaaaagaatttcgtgctaagccactctcaggagtggaaaggatcttaattagaatatttaaaaatcagaacagtaaagacgtggatgtaaggtttcagctgtgtggttttggttttctgattttttgtttgtttctttgttttgttttgttttaactttgataccctgttcctagacacaccgggttttacaactttatagagtctgattgctaggtaagtagaaaagaggtttctgttgtgatggggctgctcttgcctacattattgtcatcaagctttgacttgccagagagtgtcatattgtatgagcagcatcttggaattgtgaagcatttatgtgagcgccgccgccgccctcccccaccccccagtatggaagcctcttttagaaaaccttcctgcctcagcctcagtctgctctcaagggaataatcccacacacgtgtaagctggagctgttggcagggcttctacccgcatagtgctcagtcaggtctgtattacaggctccgcctcctaagtatacagttgctgttgatttagtttaagtatctttcaaaggcttgactccagagtggcactattgggccctttgaagagatggggccctatgaagagggacctcagcagttatgagtgttgactgctcttctggaggacctgggtgtgattctcagcacccacatggtgactcagaaccatctctgacgctaattccgtgagatctaacgccctccaatggcctctgtaggcatcaggaatgcacatggagcagaacactcatataaaataaaaatgaatgatttttttttaaaagagaggggttggagagggaggggaatggggaggggagagggagagagattgagattagaagagtgagagatcttcagaccatacgtgacatgcccttgaacgggatagtggaatagactggtgcctccctttctctctgtttgcttccctgtcttcagtaaagtaaagtgttttacattcttctgccaacatgtgctgccttgccacagactcatagccacaaggccagttgatcacatgctgaactcttgaaactgagagccggggacagacctttccttgtcctaaggacttgttgcagaggtggagtgttgactcatgtacagggaatgcaccactctttcttctactcactcctctgatactcgaagacgtcttggagaatctgtaacacgtaaagggccagaaggccactgagtgcataaagccttgctgactttaggagtgtctgtccccaggcctttgaaggagcctttcctagatactgtccactgtgatttctgaaggcatgcttgcctccctaggacataaaattcttcctgccgtattaagtgagtgttggcagggtcccttcctgctcctcacttttaaaaatctcgtctacatatttagatttgatgttcttgaagaattggaaaggattgagtaagagaaatggtttcttgttagagaaaacattagggataaagagtaagatatttttacccaacagtaaccaagatgagatttctgtacagtgcaaagcaattaaacacacaggcaatctgtagatgcttcgctggtcctactgattgttgcaaagtaaacacacacccctgtatgaattctaatggttgcccctctaaagaggccatatggggacacacttctcagacattgtctactccctttcttctagccaaactctgttactttgtgctcatgagatgcattgcaggcctaggaaagtgggtccctggctttgacagtcctgtcagatgagccgctggtatggatgggttccctgagagctgaggacagaggcaaatggaggagccatcccaagggcactgcagttcgtacagtggcaagttacctcttgggattccgcttaagctacaaagccattggtgactggccagtggttcttgaatgcagtttcttgatgttcctctttgttagcagcagttcagtggagtggagttagaccagcctgtacccacaataccagctatgctgtctcccaagctggtgacggaacaagttgctcaattaagccttacaatcttcagatcaggttccctactgtgggttggtgataaggaggccttcctggcagtgttcttgaggatcgagaacaactccacaagaagcacacagcccacggcctcccttaatgttgttgttgttgttggttttttttttttttttttttttttttttttttttttggatctttgaagtatctctgttttccagctgtatttgtattctgacatgtataagtgttcttagcttttatgggtaaaatgatatggctgccgttgctgatggttgtttgcagtgttagggctagaacccaggaccttgtatatgttaggtaaattctaccactgagctgcacggtcccaccgtagaatttaaatatgggagccattctagacatacaaggacttagagttgtttaatgcagaaggacaaatacaggcctacactcagtgagcgttagaatatttcttagtgatagggaggggagcatctcagtggcactttagtgcaaggctcgatggcagggcttattatcaatgtaccttttctatttcctttataacaccactgcacgtaagataataggtgtgggtaaaggaagatttaaagttatctgacctaactctgtccattggacaaatacagtgtgttgtcttctgactctggaccacctgctttatccatcatcaaagacttccagaggaaacagaagagcctggctccccaggagagccctgcctgttgagtgtgtgtggttagtccctcccttgagagggctgcccaggccatcaatgaggatgacttggggaggaaactgcagaaaccaagaatgtggttcccacccttgttactttccagagggaacgcccatttgtcttccccgagatactgatgtgcatcctgccagtgagttctaaaaaccagataccatttgggttatagaatgactatccagatagagatttctcttaggaagagcctggacacctagaagcatttgagctcttggatttagaagtctcctagaccctttctgggagaagaagaaaccaccataactctttctgcatttgcgtttctgccttactattcctgtatgtctggatacctgtgatgatcttcctcagccgagtctctctttctagggacatattgtttctttttagggacactcccaaaattacaatttctggttgcatatgcatactttctcaagttctttctcaagtttacctcactgaatcttgggttggacaaaatagtgaatgtacattttttaaagacaagtgaagaaatagatgtttgggagcatgtgagtttgggtttttatttgtgtctgtaatgccagagacctagaaaatggtgcagatatatttttatttctctctctgtgtctgtctctctctctctctctctctctctctctctctttctctctcttaaaggataatgtatagatgtggtttgttagtaaaagcatgcttatcaaacacatatttagtgaaagccaacaccaccaatcttggatcattttgcagccagaatagaattttaagatgttgtttgcttccattttcctgctgctttgataaaacatcctggcaaaaagcaacttaacaaaggattattttggtttacagttcggtgggacagtccatcatggcggggagagagtggtagcaggagattcagacagctgcttctgtcacagccactgtgcagaaacagagcatccttgtgcttagcatactatctgctctttgcataacccaagattccaaccaaggggatggagccacccatagtgggctagccttcccacctcagctatcctcatcacaggcatgcttgcaggttcatctcccagttctttctagatctcactgagttggcatttgagattaaccatcacattgaatatccctgcttgtttagtaagtcacagtagagctcttcggaggagggagtccttctgtgcaatccgttaaggttggttacaggacaagtgttagctttccctcaagctttctgagatctggcagcctgatctttctctgctggtttcacatcttctctgggttgcagtgctcactgtcgtgggacgacgccaacatgcagcagatgagaggcgcctacggtggcattcttaccataaccccaggaagcagtcactgttcagtcccatgacactcctcaggattttccacgcaggcttcagaaatcaaattggagatagaatcctggcatttacaatgttgttgaggcagtgtctagaaagaattcctcaatcaaggatatctaacttatttgcaattgccctctaaccatctttccatgagaacaccagcgttatttcttcctcccttgattcacaacacgtgtcgcctgtatttccagaaggtatttgattaacagtagactccaacccaacctctcatccttttttaggtcctagtgtaagaataagtatgtgaatggaccagagtggtccccataatttacagaagccccctgttgaataattcagaagagggagatgctcgtggtattaatagttctgagcttttgacctttctagaatgggcctggaaaggagcggagggaaagacgttgttttcctgtaaagcatgaatgagtgaggcgcttctacatggaagtttcaagttcacaggttaaaaataagcccaatcaaattggtacccttcattagcccttcatgctgtaggcagtattggatgggggagatgtaaataatttcaaattcagtaagttgttcttatgggaacatacattttaagaggtttatataatggttagggaaatgtgcctttcatcccttgccctcagccgtttccaactttcctctccctttctgaagcttatcgtcccttcttccctccttggggatattacagttgacctcagaaattacaacacttcccctttgtccagcagctcagggtggtgggttgtgtctgcacatttgagagcagtgtctcctccccgcccagcagctaacaatcacacactcacctcagagtgtgtttaatcatggcattgacttccatccatagcttattctttataatacttcaatgcattagtattgctgtctatacaatttaatttaattagagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgtaaaacgatagaagataaagcttttctggaaatgagtaactgttgatatctagatacgtggtaagactcgggccttgtctgaggggtgtagagtgtgtattagatgacatcatgatgccatgcttgaaatgcttttagcttttctgggactgggacccctcactagatgaaagacgtgattctcatatatgcagttattacttgtgatagcttatgctcttactccacatgcctccaaagaaaacacccaaaagagtagcttatctgtatgttagagtcgcttaagatatttgatgctaaggcggggtgtttgtttatgttgatgctttgttaaatgttttatgtcatgatcattgtggttgatttagagatccagtctaggtatctggtcttgccctggattgagaactttaccatcacagttgtacaatgtatgtttgaacaggtagatattctagctgtctctttgctgctagtggatgccttagggaaagtatggtgatgtatatatatgtgtgtgtgtgtgtgtatttaaaattgaaatttcccacctcaactttccaggctctgagcagaagaaacacttgagtttggttacagggccaaggggactcctctccttccccccacccctctctttttgagacatagtctcacatagtccaggctggcctttcctcactatattgtccaggctagctcttctgaacttcttgtgtcttacctttcacgttctgggatcacaagtgtgcccagctggcgaaggctgtctcgcatcaccttaaccttcttttactgctgacctctgtcttcacatttcagtttcacggcctttcctcccagcttacgttggcacatggtctttctcagcttcatttgtccattggaaggcagtggcaagccaagctgggctttggtgataggttggagctgcaagttgtacatctgctcttgctgatctcagcagttgttttcacgtggctgttacgactgccctcctgctcacgtcacgtttgcttcaattgagctagcaaatactgctggtttgaagttgagtcggtgggtctgttgtagccttgttcatctccttgccgattgataagtacctttacttatgatcaaatagttgtaacagacccctggaatacatcaaagagaaagaaaataattgctttcaatagggaggaagaaggaccaaggggatgcttgttcatgtagattaagcaggaaggacatttagaaagtggacgtttgaggttgtggttttgttatagtgagatagtgatagaatgcatatttaaaccacctgggactattgctctgtcactgtcacctgtgcttgctaagcatgtatgagacgctggggtcagttcctagcactgaataaccagacacggtcacacctatctgtaatcttagcactcagaaggtagaagcagaaggatcaggagttcaaggtcatccttggccacatagtgagtgggagcccaacctgggctacaggagaccatttctcagaaaagaagacagaaaataaatctagatcttaatctttggacttagaaatcatcactttcccactctcgctggattatagaggaggtatagagtcctcctctgattagaagctggggaccttgccagagaagagaaagcatggtttaaatgcattgaccacattcattaagtgacttggaaacataattttggggagtttctttggagcactactctttggatgtcttgttttcatttcctcatcttaggcctcctcactcagggaacaacccactaattcggacacctgttgatcctgaatacaaacatctttccagtgttctttgtgtactcggtttgtttgaaaatcaaaacagaaagaacttaaaagtggtattacttgaggatatggctactccgatgccagtgggctgccagtattccaggataactatgtttgtgactcaacatgtttgtagatgtcagggccatgttgtgggatcagaaggttagacacacccggaagtggggaatctctggacaggctgatgtccctgacacctgcccctcctgccttttgctaagcctttcacacctccactgcaacatttcatgccttttctccctcccctttttcctaacagcaggaacgaatttcatacacgcccccagagagtccagtggcaagccaccgttcctcgactccgcttcatgttcacacagtgcctcgagcgctcaggatggaggaagactcgatccacctgccaacacacctgcgtgagtgtttaccttcgaggaggtggaagttgggaaggggaaggtcagacagagtcctggcccctgaggatcccagggagaggctctgggtctgagttggtgttcatgggatttggccagctgacctggggtctttggctctcacccctataatgaatggctttgaaaggtttaagagtcttaccccttatttctcaatattttcatttgtactctagctgataagaacaaggcagggagaaactctagaaacacctcatatataacagagttaatgtaatttaggaggacagatgagttgtattttccttgaagtttttaatctctaagttcatacctagtctggcttcatattttctttgtatctagttgtgggttccgactcattgctttaagagttattttgtttgtgcgtgtggagggggagggtcgtgtttgggggtgtgcgtgccaaggtgcatgtatggagattggagggtactgtttggaggttggctctctccttccaccatgggctctgaggaggcttgaactcaggcttaggcctgtcagtcaagcacacttacctgccagtgttagtctccaaagagctgagtccttttgtcagctcctccttgagtggtacccgtcacagggataaaatgtgactggagcatccagagaaaagtaatcccctgatcactgggatccaagaaaatgccaggtcctctggcaggaatattgtttggagggcacatgtccaggttctaggatggcactggggtcgccttaggcctttcaaaaaacgattccaagtgactctaagatgtcgaatcgttatgctcgctgtcccttggcatgacggtggtcctcagattgtcctgctttctttgtgtagccctcctcaggagatgcttgctgaaagtggggaaacaatgggacaggggatgtaggctcaggaaataaggtgatttgtgtcgggctgggggtgggtctccagcagtgctgcgggccatccctctgcttacacttaggatgagtcttctgggtcgttgagagcactggagccatcccttcctccgccagtgcttgcagagtgacgccacacgtgacccaggcacgcctgcttcgcttccccagcagggagaaaagggtgcaggcagcttcattgtagccttccaccctctgaagcagtcttgaagagaaggttgtactgttgtccttggaaagtggaactcttgcagttccagtagggcacacagacctggaaacgacaccgcaggcagtagcaattttgccgccagacgttgtcctgcgaccagaatatttactttaggaatgttcaccttggggtagaacatactcacaccgtgcagataaaacccctgtactaaatctcctcacttactccagttgccaatgcaccaggtaccaagattcagaaagcagagctctctgcttctgcagaacataaaaattacagtttccccagatagggggaagtttccttcatactaatttgattcctatgttttgcaatactcctcaagggtccccaagtcctgataagcctctgggtaccttttaacatccaggagcccttggctggagaaattttgtagacaaacaagctagcaagtcagcaagcagacttaactggcaattggatcttcattccgagctgtgagttggtagtttattaggtctttgtttcatgtttcatgtttgtgtttggaaaagagaatagttaacagtccttctgattttaaagatgacaagtctcatctccaccatcattatcccaatctggaactgagctttagtttctccttgagaaggcaaccacctctgtactacttctcagatgtattcgcctctatactatggagagagagagacagtcatcctatatatcatatatgtgtgtgtgtgtgtgtgtgtgtgtgtgtatacacatatatgtgtgtgtgattatatatatgtatatttttcatacatatatatatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtccaactaatccagtaatggctagctgtgaatgcaaagtccaagagtctagaagttgctcagccccacaggctggatgtctccgctgatctgagcatgctgggatctcagtgctccggggaaggaatggttgtgctggcaagaagagggcaagcaggcagagagcaaaagcttccttcttctatgtctttttatagacttccagcaggaggtaggatccatattaaaggtgtgttttcccacctcaagatttagattaaagatctgtgccttccagctttaaaaccatatcgaaggtttatcttcctaccacaatgatcggggctagaagtggatttacccacttcaaaccaagcagaaaatctcacaggtgtgccttccatttctggattgtagttttttccagatatagccaagttgactatcccaagtagtcctcacaccagcatatcactaactacagtaggctatcgtaatagctagtagtatggtggcccatgccgtaaatcccagtactgagaggcgaaagccggtgaatctctgttacttcaaggtttacctagtctagaaagtgagtttccagagcatacagagaccctggctcaagaaaactaacaaaattagtaatatttaattattattgtggcaccgtgtgaaaccttaacatataaatttttatttcagactcacattaatataggtaaagaaaattttctctttatttccacattatagaataaaggctaactccatgttatacatacagggttggagaattttattttatttttgggcagtgctaagagtcaaatgcataacctttcatatactaagcaagcactgtaccacttagcccaaggcttcaagaatttaagtaattttacaatattggtcacagaactagtaagatgacagggtcaagattcaaactccgtctcatctaacctcacaacttagattcttaatctttatgctatgtgcagctgtgtgtttaatctgcttattttacatggatgctaagccagttatctgatgtggctccagaactggtttgtggcttgaacctattttctgaactattgttctgttgctgaagaactcgtgtcaccccttggacagatggatggatggatggatggatggatagatggatggatggtcaccaagataactacccactgtggagctgtagcacattactggtgacctgtggataatcagcaaattacggattcgtgtcagggcagtgatttttgcctgcgtgtctcagcttaagtgataactctccgtggtagtctgcaggagcgctgttgtgacatggtctctttcaacatctggaatgaatcctctagacacagaggttcccaggttcttgctgtgtgccctctgctggggctttcctggcaggctagcccagcttccctcctccctcttagtctaggactgcctactccttattctgaggaattcagtggtcaccaactctgaggttgggccatacacatcccagctgagtttccaagcttaaaagaataaaatgaatactcgggcaagggaattgggttgctgctgttttaatccaggattccagacaattcccagtagaatgcgcatggaaagtccggggaagagtctgggaggcaggacagcagcaggacatttatggcattacaaggatgagcacattctcagaggctcgttttaaaagaagagccagcctggctcccgctcactgctctccagctgtagcttctcgatcttacctttcttttcttctgacatccttaaatgaagataagatttggaaatcgggggagggcaggagtctcatagccaagattctcacgcagtcttaccactgtgttagacaaacacaagtctactaaagacccccacctggcaaattagcacagaggctttgcagacatgataaaggggaagtgataaatgaaacaagtgctaagtaacgatcacgaggtgcaaaaaggacatgcaggataatacaggcctaggtgcccagagctgcagatgatgctgttcagcagtcctactgacctccctgttcatgggaggacagatacgttatggaaaggataggaagggcatgtttctcctcctcttctccttctcccctcttctgcaaagcattctgaatcgtttataagcctaagggtagaagggctgaggtatagtcacagcagtccatgaagaacaaaggctcccttctttatactgagcatcagtctctgtgtccctgtgagaacacctcagcaccccaggggttcagggttgggctcactggtgatccccaccattgcatggaaagaggaagtcttttccctgtgctcttggagactgggggacagtatgggacttacaaatgaggcctcacagcatgctaccactgctgtcctgttagatttgcatccccgtgaccagatgtctgagcaaacagacttaaaaggaagagctttattttggtccatggttctgtactctgaatctgtggccactgactccttcgttctgggtgcgtggcaaggcaggacatagcaatagcacaatagcttccaggaagcagagacagggaaagtgaaggaccagggttccacagcccctcaaggacatatatccagccatttagctgctttttataggccccaccttctaagggttccaccatattctaataacaccataggctctggtgtccagctctttttcatatgggtctctagagatctagagatctaaaccataacagattcgtaatgtgttcataggggctctcctggccttttaagtaccaggccccaaacactattggccaggctggactgtagagtagcaagatacatgtgtttcaggtgtatacagcagaatttcagtagttcagtgccttgttttaaacctctattaagcacgactaaagcctgtttagttgatttaatcacattcaatcagcggtcgacgttaatgacatttacctgaaggctttgcatcttactctctctgtttggccttactcagtccctaagatttgatagtaaaaaaatcggaacccgggactcatgtatcatatctaatagggctttggattatgatgttgtgggttaataaatagccgtaataactgccctgagttttccagagtcgggacaccagaaatggtcccctggctctcctttctttccttgtgaatctttcagaattcttacgttactactcctgcgtgtgtgtgtttaataatttagttcctgtgagagcctcgctgctcaccccactctgctgctgtgtctcctcagcagagtgactggggttcatccagttgcaaggcaagctgaactccatcagaatctgcacacacagacagatgtggcgggagcctctgttttaattggccggaaccataattctctatactttgaaatcatgcttgtcctcaaaagcagagacaaccatgagagctaaatataatctagttaatattttatcgtgtcgtgagaaacaagacacatccgtacacgttatctaatcacgtgacagttcttgaagcaggtgttcaagatccagcctcaggtcaatgggcttgtccaggctcacacaggagggaaagggtctaacaggatttctgccccacaagctagcttttagcctctttaggaggaggcatataggcaatgtctctgggactggaagattagtccaaagaatgtggatagactatgggaaataaagggttcaatggcagacatggttctaaagacgccccttggacatggataggcacgagcctccatcacgctagcatgtccctttcagaaggctgagggggagtctcgggtagtgttagagccaagggtaaggactgtctctttctggttttcccccactgctctgctgtccctttgctttatttgtgtgtgtgtgtgtgtctgtgtgacctgagattgaaattcagtttatttctgcaacccatggcaagactggctttagaggcctttgaggaccagctctgaagactgaatgggctttagtctcaggacagtgtcttccaagtagagggttcagcttctctaagactaactttctagaaatgtctgctgactcttgagaggtgagagattcctgtaaacgacagagttcacatgcataacgctggcatgatgccaatagtggggaggagggtaactcagtgcaggtctgctgtggtcttctgtgcttagcaggaggcttccccactctcatactacatttgtctccttagggaaaggacctggagctaactcgtccacagtccacatagtattgagattggtgttcttgacttgtggtgcaagcaggatttcattgctgatagtttcccatgattgacaggctccctcagtctggaactttccctggccctcccctctcatcttctcaggtctgtcaaatcttcctaggcccttggccatcagtagtgttccagaggtgacctctccttacagctgcttgtgacatgtggtgacatcaccaccagagttgaggctaattcccagccagtgtcttaaagcagtactgacttctggcaaagttggtcaagctgctgacgttttttagtcctttattgccccttaaaccttcctttggggaccttcatgttttataaccaaatgctcactgttctcagttttccttacagcacatgggataatataagggtccagtttagctgcttcagataactccaaagtggaggggggtggctgtctacaatggaacagccagccaggatgcttcggaagggaaatttcctttttgggtgtgctgtctgaaagaatttccgatgcaggcagacgttaattcctagctccatgcttcctgataaggaagcaacttcaataaatgcagctatttatagatgtctctcttctctctctttaaacatataaccagaggtttattgaccttttctttcgctgcacatttcttgcagtgagctgtgtgcacatttaaggcagttcctccagcaagagctctggtgtttgctctgactctcggtgggatccagagggcaaacacagccacctcttgcatgtcaagggctctcacttttttttttctttttttttgccttctgaactagacggaggctgctggcagttgctggtccccacgtgcatagatacacacatggcttaggtttctgtgctgctgggattatctgatgtgaacagatccaggggagaactatgttttggttcatggtttccgagagttcagtccgtggtcactagcccccttttccgggcccctggtgaggcagatcattaaggcagtgaaggcctgcggtggaggaatttcctcatggggtaaggaggaagcagaggaagtcagggcaagatgtgttcccaaggccgtgttcccgatggcctgcctctttcctctagacagagcttcctgtttctctccatcttccagtaatgccatcatattaagaacccatcgatggattaatccagccctaatgatgcagttgtgtctagaaatgtcccccagatatactcagaggtgtgcctcaggagtctctcgggtatttgttcctgtctgttttcaaatacattttaatttattccttgagaactgcacacaatgtgttttcgtcaaatacacccctagttcctcccctccaacccctaccgggatgactttatcacatctccctcctaactccaggtcctttagacaagccttgagacagtcaacattaacaattaaccgtcatactacgtgaacccagaggtgtctgatttactctagactctgcataggtttgtgacaaacagaaccattgaaacatatgagacattgaaaatcagtcagttttgggaaagagacatggtcaacagaaaatgaccttatgtctaccttgtttttgttatctccccttttttttaagtcctgagaagttctgtggccttctcttgacaggctaaggtttgcagattgaagagccttaccttctacatataagcaggctcatgtacatgccggctgtacccccgggcagggatgatggcgatcctggatgatgttagcatgttgtacacttccctaacctctccccttcctcttcattctcagaaagcattagtgagatgcctttacccaagtctgatacagttcccattcctacatagcatacatttcccccctttcttctgtccttctgctgcacctcttctgtaactcactcttgaagattcaggcgggaatgaatggccccgacagctgcatccttccacaactcaatcgcagagggaacctccaggtgctaactggtttcactgctgtcctaggtaaatttggattctcagctgcttgtgccgagtatgagtattttaggggttcttttactaatctcatctgaggcaagggtaatgaaagatttggggggacttacgcagttcctgactctgaccacatgcccagtgtggattcccaggtgctatcagccacctagactcacgttcccgcttccagcttggatgggtagaataagtcccattcttttgaaattggtcatccttagtgcttcctaccgactgtggatgctaatagctgttagatggcactctgagattccagtaatagagctacagactgcagatactgataatgggtaaagagctgtggaagtacgctaggtgtagagagggttccctggaaggaaaacccatgcagggagttctcggtcttaccagaagtaaattcccaacctttgaggctggaatgctaacccatgctgtattgaggagggtgacggtctgtaagggaaaaggaaataatcctgtctttttgtttttgttttttttttagtgcttatggaacttgcactttaaaaaagcatataaaatactactttgttttatttgtttgtttgtttaagagtttcctgttgcccaagctgaccttcaattcagcatgtagctgtgtatgacactggatttaggatgtacctaaattcctccctgtacctaccaagtgctgagattagaggcatgtggcatcaacatcaagactagatcttaagtaccatttatgtatgcatgtatgtatgtatgtatgtatgtatgtatggtctgtgaactgccagcatttagaagcaatgttccatcccaggagccattgcaaggtcacctgtttctaagtccttaacactagttcagaggctctatggcagtgtcgtgtgcagtaagtactgatagccattactgtatagagagcacttgctatgtgccaggaaccactgcaacgtaagtctgaataatcacaaacacatttggggctcagatgtggcacatcgtgtccccgaggacacagagaagtcagaggaaatcatgacctgactccacatcttgttccaagactcggcttttcctcacttcatactccacctcgaaagtgttaggaactaattagttatttcattctagctgttggtaaggagaaaaaaaaatcaaagcttccagttgttttctctttttttttggaagaaaaaaagaaatcaagcaaaattgaaattaaaaaataaacaactgacgagaagacccagagggataaaatcagagatacaaattcaacagtcctttgaacttagaacacgataaaatttcagatccaggcttgtgggtatactgttatctgtcgcatgttttcaagtgtaaattgtagaatgttaggaacaaaaatttaatgaagccaatggaggttcccattgtaccgagtttcccatcttttctgaagaagcacactgctcacggttaatactgagcacctacctataaggatggtgatgtgcttggattctggttggtacactgagttcacagaggacaccaccacacttcctcgtagcccatgctaggctggtgtgtttcagaacgtggcctggtgtgctggggcctcagtttctcccttgtgtccatcatgctggcacgtttgtacaactgccagggcagccgctctcccggtcaggtctctgggcttctggccccgtgtggctgtgatgtgggtcatccctgccacagataattcgctctcctggggaacagtttatctgtaaaatgaaggagctccagcccacggttcccgagtccttccagactctcacagattatactattctgattccagagaagctgtgtgcttctcaactaccaagcactatctacagacacacggatggtgctcattcgtctgattgccggtcctcagccgccaattttggtgcagatggtagtgtttcgatgatgcaggggattatcctccacttgtgctgtgtgactgcttttcgaggatgccctacaaggaagtatggaaatctagggtctggctctgttggacttttctctggggtgcctgtgtgtttgacacgagggaatgcttttatgaggtggaagtgaatgcccgctcaggtgccatgcagggcttctgccactggctctgctgtgcttcctaatgccagtcccaggacccggcagcttagccttaggcgcgctcctccgttctcacagtcccctttatgacctgagaattgcctgtgagctggccctttgcccagagcatcgcacacaggtgtagcttcctgtaactgcttgatcctggctgtgtgatctgtgggaatcccctcatgactcagggcatgtttacttatgttgtcgtctgcgaaagttgcagcgtgaatcccccccaccccccacctcccccagctgcccaccggggctctgcagggccagtgatcagcacagagggcccacaggatcctgcttcagccagcctcatagcacatgcacaattaatactgcattaattaattatggggaaaaaaggccgagctggcagaggcttgaaggctttcagcttctaaagtgaaggctttgaagcgaagctttaaaatacatttccatcggcctcagcagcagaggagctgtgacacttaggctgtcccctgggcatagagactcacacccaagaaactctttctaaacagagaatcccaaccagttgcttgaatcatccatgagttgccatgggctgtccaaaggggatataagatttggaagaaagggattgcccagagcacggtgatttgtgaacaaaacttataaagggttttgttctgtccttttgttgttgctaatgagtcaccaactttagatacactaggaagaaaagtacagggacctggtgccaactggcactcttgatatgggggggggggacgacgacaatgagatgactctgtattctgccccctgaccacccccaccccccccccagctttgggggggggtactttcttactagatctggacagagtgtggagaaaacagtgccttttctccatcatttggaaatgcttctctcaggctggcagtgaagccaccacacagaatccctgaccgtatgttcgctcccatttgtaactcccatttaaacattccatgtgagactctccctgaccttaagccctggatgtggtgtacatagtcgtttacccaagtatttggagtttcacttgaaggtatttttaagatcacaaaagtagaaattctctgagatggtttccttgcctgagactgtggggttataaatgttcttttcaaactatgcttggagctggggacattatctgctgtaatgatcagtagatcagttggtagagaacttgcttagtgtgcatgaagtcctgagttcaatcccaagcaggagatgagccaggcatgttgacacagaccccctccttccagcacacaaggagattacagtcaaactacttgaatgttctgatcatatgctgactgaaacttgagactaacaaaaaaatggcacacatttgtcctttgccaactggatatttgaaactgaaaaaagttttcttttgattcatgggcagagaaaatttttcttcagataaacttgtgcgtgcatgtgtgtgtgtctgtgtgtgtgtctgtgtgtatacatgtgtgtgtgcatgcatgcacacatatgaacacagatgtgtctttgggattatagcagctattaatccagatgtctacatcacaaaactcctgtgatggtttctaccacccacacattatgaggaaagaacatggcggatacaatggagtattgtagcgctgacattgtacctacagctgtagcactctctgcctattggcatctttgtttgctgaatggaagattcagattcccaagtgcctgttgctgcacccaggacagagagggcttctagttgcctctgaaccgggccagtgttctgcgaaagcagggaatgtggtcccccagttgaaatgactatgagcgccttgagtgtgaattatctgctgtaatgaacttctctgcgcctgcctttccacctctgaaaagcattccttttgcatcaggcatgttcccacctagctccgttaaaacatttttttttttagatttatttattttatgtgtgtcagtaagttactcgtaattatgtatatatgtgtattacatacatgcctctagagctaggaactaaactggcacacacagggtgctttggggtatctataagaacagtgggtgctttggctgctaagcaattcttctgagcccctagccccactttttaaaagtagtcaggaatgtaggtaggtagtgccttggatagagatggtgactaacccacgtcctttcttcatgcaaattagtttattaaatttctcaattcccttgtatcggagggatctgtagctgacgtggaaggccaaggatcaagttggaaataacgtctgtaattttgctcaggagatagacgagtgaagcaggacaaaatccaggtcccttgcttgatgaagacaaagtattttaaacctggagccccgaggctgagaagagcacccagtcctactgcttagcatgctcgggtgctatctctagatgatgccagcgatgatcttgaccagacaagctgagcatctgaaggccagcatcatgctgaggatccacgccttttgtgtccttgggcagaaacagtgagtttgcaggtacagatcctcacacacagaaggggcgcgtgaattcacgtttcagtgagggggtcaggaagatcttgaccttcccggggtaacttacacgcatgtaagacattttgtcgctgagtcctcttgacagccctgtgaactgaatttccttctcctcaccattaagatgaaaagtccagtttaaggaggttaaaaaggcaagctcagccagcgccactcacagagctggtagccagtccagtggcctctcagactctgtcttccttccttcccagtataaaccaaagccctattatctagatgaaaagaatgaaaaacagtgtcacattccctctgagactcaactgcggttaagacttcataaatttcagaaaaataggataactcaccaaagtaaacatttaaaaaaccacctcacagcaaatggctaccgcaaccccaaacctcaaggttcatatattgagatttcagtgagcttcatgattctcatccgtctcttaaatacggctctgtttcctggtaaataatatctcttcagagccctggcacataaatagtgtaataagatcagctctgagcaggctgccgttctagtgccctctaattgcagggtgaaaatccagggccgccttagctcctcatctgtctccgtctctcactggccactgcctgacacccagtctgaggttcaacaccgtctcttctttttgtgctttagatagatccgtcctttgcacagattttttttttaaataaagtgatttgaaatggaaaattaaaaacttaaatgcaagtttggcagcttgtatactcagaagcttcataaaattctctatagcacagnnnnnnnnnnnnnnnnnnnnnnnnnnnnnnnnnnnnnnnnnnnnnnnnnnnnnnnnnccgcctcccatgtttcgccgagaatcttcactgggaaaagttatgtggaaaatcccatcacccgaggtaaaggttcttgagtgatagacacctttgggagtctgttacttaccatgttgtttatgtgtgctctactcatttgaaatcctgtcctctctggcaaaaatctgaaatcttatgtgcgatcctgataagtgtgtgccgacactgtcttgggatgcctctgtgtgtctgtgtgtgtgtgtgtgtgtgtgtgtgtgtgtgtggtctatctgttgtctctgtggatctggatgcagatacttcaatccttcctggcagatttaagctctccacgtcccacaggctgcagtagaggacaagggcggcatcagagaatggagagctttggtggggtccccacccactggcccagagaccaactgtttatccctgggtcccggcagcagctgaaagccaggggtgtttttgggattcggctgccaaagtttcttgaatcagccttgttcaaaggcatatgctgggctcacttctgagggaaatttcctttttggggaagttgaagcaaaggaatttcctgtgtgggcagacagagcttcctgacgtgaaggcttcttggaagggaaacagtttcataatgaaatgacaaattaaagatataccagccgggttcacttcaaaacagctattgagagtgcaggcaaagccctattataccccctcacagaacagaaataaatcccatcctgacaggtttctatatgctgggttatatctgtccccccacaccttccttcacagtctcccacatgctccctctcccacccccaccactagctaccaccatctctgtctttaacaggcttcgagcagtctcggggaggcctggggcatccttcctgcctcttgtcacctttccttaccagcttcgcccatcctaggagtgcttggagcctccttgtaggtgatggtaaagcccgaggctgcccagacttaggagtgatctctttccttcttttgacatgattgaaaacaatgattgaagatggcttcagctggttcctttggctgccccttaaaatcttgtaggcagtccatgtaactgctattcttatctcagagctggtctgaagccggctttgttcaagaaaatagagctctctctgcactgggcagatgacggtcttgtgctgagcgtgtagttttttgcacttcagtcagccagtgtagcggagttttggttttgtcttgtacactgatatgaagattccctttgttgctgtttttatttttaagacagggtcttgcttcatagccctggtactgatccagaacccaccttgtagactaggccttgggcgtgatgtaatcctcctgttgtcacctcctgagtacgcatctctttctctatctctctctctctttttctgtgtgtgtctgtgtctctgtctgtctgtctgtctgtctctgtgtctccttttcttctccctcctttccccctcttttgttagggttgggttaaggatagaactcagggccttgtgcatcctgggcaatttactctcccactaaattacaccccagcaccctacatttcttttctttttccttccctcccttcctttccttctttccttctttctttgcctttagaaaaaaacaaattaagagagaaaaggataacagcatcttttgggcagtgtgtaagaacagccattattcgttaggcctaggtcagtaggatcaaaaacttacagaccttggaaaccaacgattttaaactgtcatttctagcactatacagccagcaatgcagccaagtctcttaacctcttggcctcagtttccttgtccttacagtgaacacagcaacagcttttcttcattcctgtatagaaattaggttgcgatctcaaacatactctgtaaacactcagagctccatcatggtttttcattaatccaccaatggactcttttggggttgaggcccagtactgggctaagatagtaaaattatatttacagatcagtttggtaaatatttattagagatttttcttcctatacaactaggcttggtggagaaaactataacaagttagacatttagaatggcaatgaagcagagaatgaagagtgttgaacctggagaccaaaggctggagtccaatcctgactgttactcaattttatttatccatgtgagcttcagttgctcatctataatactggaagaagctggactctgaatgtacctgtctctttgcaatcctcacattataatcagttttaaagggtcctgccttttaaactaagatcgtgtgtattgcctgcagaaactgaataacgtgtgtgtgtgtgtgtgtgtgtgtgtgtgtgtgtgtgtgtgtgtgtgttcgcgagcgcactcaggtatgcacttgtgggcactccctgcagaaactgaataacatgtccaatttccctcgagctgtacatagttcaaggcaacttccaaatatgggtgtgagatgtccaatgtaggtgctgggaactgaactcagatgtgtcctatataacaacagcatctcagatggagaaacttgcctcaaggatggaaacagattttgttagtgtgtgtgaggtaagcagggaaatatggtgcttcccagaaataccagctgtagtgagttatcactgggggcttctggtgatgctgacgtggaaataatggggactgtggctgaactcgggagtttcctcaagaggacttactttgaagcaccaggttttttctcacaggacacccaggacttttccaaatggttgttcatttaaacctgcccttcatggctactcttgttcaaaggaaattgaaagacggcatgcagtctcgatggtctctatgttgtgatactagggctgctaaactgtcctgcccgtcatctcccgaggtttacagggtgtaaggtcaactgcagctgtaacaggttgctccctcggttttactctccacaagcctgatgggtaggcggctctgtcatcgctttacagacacagatacggggagttagctgtgtgggtaatgtgcttgccacacaagcttcagtatttgacttctatctccagaacacacatgaaaaagccagggttgttggtgtacgcctgttatcgcagtgcaggggaggtagagacaggcagggtcctggggactcactgaccatccatccttacgtaatcagcaaaccccaggccaaggagagcttcacatggcaaaacaaggtggatggctcccaaggaacgatgctcgagggagacctttggcctccagtgaatgcgtgtgaacccacatgagcacgtctttagtgctgagcttacggtgatgcactgtacttggaactgtagccctgtatgaagcaagaaactattgatggtagaggccaaggttaagatgtgtatctcttcagttaagacttaatccactgaggacaccttatctgtatcggtacggttggaccataattctcatttttacgagtaccaaatgaacaggtgaggggaactccgtgtaagaaagcaaaaacttcgagcatggttcatcaaaaccagtgtgtactgagcacctcttgtatgcaggagcatggcagttacaggaaatatagctttatttttctgtgaagcatcatacttactaattagatagcagcatttcaacgtcatcattgtacattggttgcttttgagacaaggtctcattgtatatgctgactcccatctcaacagtgattctcctgcctcagcctgtcaggggccgctacccctggctctggatatttgttttccatcttgcgattgattttattcattgttctttgtataaataagctttatgtctatgccagcatgcttctaatattttataacttgccacttacacagtttgaattaattgttcatcttctcattgctaattctcccttggcgggggatatatatatattttccaaactatttttcaatcaaaaccaatttttctttctaagccacttataagagtgacatctaggagcaaatctcaggggaaaacttcacttcaatggcatctaacagttaaggcttcacagccctgttcctgtttggcctgtgtcgcagcattgtgagttcatggtaagaggagaaacactgccatttctcctgttcagaaattcaatctctcagtttaatttttcataggcctttctagtagccaatggggtcttattaaaaaaaaattcctttccctcattactgtatattccccatttggtcttaagagtgggtttggtgggggcactgaaattctgtagcccagtctgcatgctgatttgctgctttccttccctggtgaggacctgggtggggggaggggtagaagagatggattgattgtttattctgtttggggatgagaagagggggcagggccctgcggcgttcgagtgcgcacgtgctttcctggatccccgctatcaattgcttggttagcttttcttagctggtagtctgaggcaagggaggagacctcaagagggaacaaggcgactattggccaggaagtggaattctgtaagctttgaaggaagggaagaggaataaaggggggcagttgccagtcagtcagtctgagttatgtctggaagtccctgctcttcaaacactggtgctaaggacaagtcacctgtgagtaaacagtctctcactgggaccttgtggcgagtccccaggcagaccaccaagctatagaaactgagagtcaactgtgtcttctggtgtgtctaacagttcctttgtacccttccaatgccaggtggcccagatgagggaagtggcctgggtttcattctgagagctcaacacagcaagttttgccttctttattcattcgcctccagcactggatactagagttgcctgtacccatctcttataaaggaagccagagaatatgatggctttatgtggtgcagatccatccgaagcctgggcattcagaacctgacccagtcggctccagccttccctccatgactcagaaggcccagcagaggacctttgctagttaccaccagcccagtgacagacatcttccagacaatagccctgcctccttcccctcctttctttgtctttaataaccatgaagcttaaagaaaaagtcttcccaccaggcatcaggtcctacataacatgtagcctcatttgatgcttaaggaaagatctgccttgtggtaggtcttactatgctgcctgtcctggccttgaactctctgtgtaacccacattggcttccaagcctgtgtttgcaattcctctagtttgcatttccccaaagaaaacccacccaacttctgccagtcaagaataagtaaggtctgtgttacaccttcatagatgagccagggcgcttgcctaagatccggggtggtcctgacatgctttggttgccagcagcatgacaactgtacatatacagatgtcatatacagatcaactaggtggcattgcctaatataggatttccagtttctgaaaacatagtgactctgtagagattaccgtaagtaatgctttaacatttcacagctcacagtcatgggcgggatgccgtgcaagcagtgcattggagataatcagtaagtagtaagctacgctacccacgggtccccgtcatttgcttttggctctttatccaataatgccataactgagtctataactcacacctggggagcagttgttctatgtgaactttgttgctttgaaatcttgagacactgttcagtacctccctctctgtttctgagtactcagattcttaatgacatttaaaagccaaactctataaacattttgaagcaaaatcccggcagaaatgaactttaaactggtgagggtaggggcagagagagagagagagagagagagagagagagagagagagagagagagagagatccttgtgggagtcagaaagaggctcttgtgtgtctggactggtggcaggtttgtatgttaccagagtgatctccatggtaacagatcaacatggctgcagtgacagctttatgctcagagcttcaggttcccatgagaagggggattctcccagcaagcagagaggaagaaatccagagaggtcgatgaacacgcccctgcttggtcaaactctcgccatggagcgtcgttccatataaccagcatgtctggttcagctactctgcctctctgagtagaccaaaggtctgcagagagtatatggagttgccctctgaatattctctccaattttagctcaactcatgcaaggtttaaacagccttgaatgcaggcagctctgacactgatgggagaaaactacccgaaaggtccttatgcttacagattctaaaatttccaacaatagtcaattgatcaattatattgaaagcctttggtgtgctacattagtaaaaaggcagctgacataaaacagaaagtctctcttccatcaaagatgatgaggaagaggaggaggaagaggacagtgatgattgtgtgtgtggcaactacagcatctaaaaagtagaaagtgggctctgcttctgttataaatcatccctgagtgcaataacccaaatatggaagccggaaaatcaacagaggagttaattttcctggagccttggttacaaaaggtaattcatttgcaggaagaatcgccaaacactagtttatcttaaaccacagaagaacatttgggacttcaaaagaacaattatgtaatttggcaatttaaagaacctctttcctggggaatcttgtgactcaacagcccaaggtgtcagagtggtgaaggcattctggtggtcagacctgagcctcgactgggtgtctgctgtgtgtatttaaagagaccagtttggggtttttgtttttttctggtttttgttatgtttgtaatgacaatttctttactaagaagtttaaccctagaattgtgagagaattaaaaccacagtgacttggggaaagtaacttaattgcatatttcctttaaaaggtagctggattgtggagtgtctgaagcaaaccctcaagtccttccagctacttagcctttagctaccaggtcacacagttacagggacagctgagaagggcagttctccatttaagtttctcatgtcattcttaggcctatctttaacaatcaaagtctaaacattttttttaatcattctaattataagaattggctttgaaagacaagttcaggattttaagtatgaaaaacttagactgtatttcattatttccctcgtcataattttaagttgactttgttgacataaaagaattcttaattcaataaaatctaaatataaccacgtgcgcgcgcacgctctctctttctctctccccatctctctcccctttttagtgaagtgtttccaaatcccgactgtttgagacttgacttgcaaatgttaaaggtgaaatctaaatgaccaagatggagagaaatatttttagggcccttccctactaacagttttcatccccgaacatcaatattgcccagttcagatgtaaatatacattgttttatcatcacaagctagtttaggttctttattctgcatgtaaggaaaagattgtttttttggtagttcaaggctcatggaaacgaagttctacacattgtttaagtccagctaagccagggtgtgaagcacttttcttaggctctaaccactgttgacatcgcacttatattgtattataagtaatgcttacataatttgaaatattcaggaaagtgtgtgtgtgtgtgtgtgtgtgtgtgtgtgtgtgtagcttctatgctacacactgtgtcattaccgtgtcatttcatacaggggacttgggcagcctcagattttaatgtccacaagtcctataaccaatttgtagaaaccaagggctaaaacggatttgaaaaatcaaaatgaatgcagaaattaaccatgccattattccagctgtggcatgaggaatacctgttacctgctttctgacccttgaagaacttggggaaaattaacaagtagtaaattgttaacagtgtcagagtgagggtggtgttactttaaacagcccccaggaattctcagttttacaaacatggacccagggatcccggaaggtagactcagacctccctccttgcctccgagtgtctcagagtcagagctctgtgtttgtaaagaggatctctgcacatttggacatagttagatgtcatcactatgtggtcgtgtctgtaaatccctgttcacagatgggtcatggcccggaggaagccttgtgtcagaaagcaacttgtacagttttctgtagttaaagctatgatctgagcctttcacttataacaaatgactgggaaaagagaaaggtttggatctgagaaccggagagatgactcagaagttaacagtgcatgttgctcttacagggaaatgaagtttggttcccagcacccatgctgattggctcaaaactacccataattctacctccaggaaatccagtctttggtctctgtgggcatctgcactcaagtgcacacacccttccacaatgctcagaactaaaagtaataaaaattggttttaagaaagagatgagatatagagagacattcttaagaatgtgacctaaggaagggacctgagtggtgacaccaaatctgacatcagaagccagtagataaagtacttggatgcagcctctttcacacaggttgtacgcctggaaagttgactgtagaagaaagcttggccattctgagcaaatgcccccggcctcacagtgtagtcggtaccttgttgaatggtggggttagtctgtgaaacaaatgtagacatggctggctttaccattcacaaaaataactttacgtacatttgtgattccttcttccgcaatattcattgaataccccatatgccaggtagctgctgcacacttgattccattatgagtaataacagacacttttccgtatgaattcatggttttcaatttaggggagatcttgtccaccacatcagatgtgtagatgctgtcactgtcctagctgtcccttgctcaggtcactcctcctgagaccacatttttaacatcaccctagtgtgcgagctgctcatgggccagcgaaatcacataaattgcaccaacgatcacatccaagcagtggtttctgcacagtcaatgaagcaggtttctgccctgaacattgtactcttaccgatggcacgcacatcaatactttatcgattgcctcattgtgccaacctgttctgttttatgcagtccaggctgctgttatctgtcttgaactgacatccctaaagaccaatcaggagacccgttcagtgtcttttctgccgtgtccgctgcagcaccaggcactgggtgctcacagtgtttgcagctgtcgaaagagctggttatcagcagtgctgagtctgcaaaccgtgtcacagttgatgacgttttcatagcgcacctgagagttcacaggagaggagagaggagcttcggaggcagcccatggaagttacgaggtgatggaaattgatttcctaggttaaaacaagtccccagtgcagtgaccacagtaagcatgccaggaaaaagtcgtcaccgcgacggtaacacccaaaatgagtaccagattttctaccctaatgaaactgagtaactcagcaaagaataaggaacagtggatgacatgaaggaagcaggttgttggaatagtaaagtcctgaactggcagagtttggggtttcttgtttgttcctttaacgtcgattgccaagagaggtggagctgaaggaagacggagatgggcgtttgtctttatatctcgccgctcactcggacaataggagaagccatggaggtgagaaaagcagcactgactgagctcagttgtttaaccacggatgggctaaggagcctgacttagttgatagcgtgcctgctgagcagtgcacaaagccctgctcccatcgctgggaccacataaatcagacatggggtcacacgcctgtcatcccagccgtgtagagctagactccggagaatcccaagtccacgtaactcggctgtggagcaagtctgaggccagctttggctacatgagactctgtctaaacacaaaacagatatgagtacacgcgaacgcaaggagtggtgccgttgtgggaccatcatggcagcatgagatcatggcagcttgagtaaagacctttagaatgtgttacctgttggctcagtcttgctccagcaattgccactaggaagcaacttgaggagctgacagatatcattgcatgcacaggtgacacacagcagaggacaataacacaggattggtgaagctcggtattattaaaaatcatgttcttaaaacccttgtctaacatcaccgaatatataggttacagatgtcaccttagaataatccagtttttccctttttaaacataactttctaaaacatgtattataaggtgtatttgtgtgtgtgtgtgtacacataccatgatgtggtggccaaacgacaattcacagaagtgagttcagggactctggattgtccggattggtgacagatgcctgtaaccactgaaccatctcacccaccaggacgccctcttcccccaacctttttttttttttaatccataaaaatgagtgaaggcactacaggggcctagttgttatctctaggtgagagggctgagtgtggtatttttctcactcgaacacatggtttttattaggcctgagtagtggtctgttgcgatccctgtctgtacatagtagggtgttcttgattgagtctgtcagaatgcgatctgtgattccctcctcatccttcatgcctctcaatgtttagaacggaggccctgtcctgaggagtcctgctccttctgtcctctgtgcacaggcttgttctgacctctcacctcaggagccctttgtatttctttgcacctgtcacaagtcacatgtttccttgtcttcctctgctcttcccagtgctgaggcctcccccttctccacaaacaagataactacagcagaatcctacctcactctacaggcctcagcttagagccctgactgccgccatgcttcagggaagactcaccctcaggagcctcccatgcccttgtcgtcccagtctgctcttaccatgagccgcatgttctctgagggctgagactgggccagagccagggtggtcaccacagcaccccatcccaaatgccacacagggctctgcccactccgcatggttctgaagtagtttcaggtgggtgaaggcagccagggcgtcccttctccaggccagctgtgtcaaatgcaggttgaacattcctaacctgaaaatctgaagtgtctcaaaaatctgaaactttttgagcaatcccatgacattgtgagttccatatttgacctggagcgacaggtcactgtgtacatataggtgcatgaaaaaatactgtctaagatcttcagggtgtgtgagagatgagggaactttgtgtttagactcctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctttgcgagctgcctaatgtggatgctgggaattaaacttagatcctctggaagggcaatattcacacttaaccgctgagctgtctctcccaccacatggtagtcttgattgagacctgaatgcctgacttactggtgcaaggttgcatgaatgacgacttagggagcttggcttgtggcagttgccagtgtgaagtgatttaccgtcagccctcccccctatcccccctgccccacactgccaggcatcgtagtgtgctcatccccgtgctcacttatggcattatctgccatgagtcactgctaaaagtttccccagaagcagtcttttccccagaaattgagttccggttagttccatcatagttttcctaaaggtttatcttaactatctgtagtatcaatggacgccaccccccccccccccgccatgatacccagtgctccatacctgtgtgtgtaggtgacccagaatctgactcaaacactgggtaaaaaaaaactgttatttatatcctgctacatttttttcttgggaggtctgatcgtccaaagtctgtctggttacttgatgcctgatgaagatagacatgactcttgtattgagccagagaactcatttttcactttggctaggcatgtaatcccgggtttggaagctagaagcaagcggctcgcgagttcaaggtaatctttagctacgtagtgagtgtaaggccatcctgaattgtacgaacgaccctgcctcaaaaccaaacaaacagagctcaaaaggtcacatttatttcaaaacacttagaactgacccagttgtgcatagttagtgtattgcacattataaaaaccatgctctttcttcaaggataaataaagcccataggtgggtgattccaatgtaaaatgagtttcaaacatcactttcttatacaactgacggtttggccagccagcccttctgccagctctcctctgactgtggcttaacatcctgaaactcactggctggagttggaggttatttcatttcccagacagcaaaaccatatttttgttgtgaaatgagagaaaaatgcctcttgtcctttcctcatccagcccctggatctttcagagttgctttaaatattctgttctcccatagagcaaggcttccagcagacgtgaacaccgagtgtcaccttcctcttgtgaaaacgcaaggatgcctcctaggtagttatccgtgcctttgtgaatgagggcccccttaacatgaagccgtcactgtcactgctcagctgtttcagtttgtggtttccagggttcttagtttgacagaagagtgagcctgacaggggtgagccacccccagaacactaagtactgaacttgccaagttcccatccgaaaatgttgaaattcctttgactttctcttgtgacggactcctgtgtgatctgggactgtggtcgggtgctagtgatcattgaatggagtgctcaaaaaaagtcacattataaaaagagcctaaaaatagcctccatatgaaggaagggcacttaacttttctacctggggaatcaggacaaaaaacgtttccaggatggaagtgacatagtgcaagtgatgtaaccagttggctgcctgttcttttcctttttttttttttttttaaccagaaggaaaactaacatcatgtagaaaaatcccctcaagttgttaaatagtcactgaatgatgtagcctttggtacttaataggataccctgaccagcatggaactcgggaacattcatttctaagggtttttaattgaaaatctgattggtgtggacaattcggggcgttgtatgaggtgtttttcacagaggtgaaggatagcaagagaagtcactgaggtgtgatcagctcagctcgctcctttgtcacctgcctagtgtgcttcgtaactcaacaggtgggcacactctgtaagttccatacagtatcaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaatgatgcttgcatagtgtgttcaaggcatatatgtttgataatctgatacctccaaaggcaagtgggttaattgggaataattcattttctctcattctggcacagatgtttcaatgagtatttcctgagttaatgaatcagtctataaattttaatctattacaaaatccatttatggatatataattgttatttcttagtttgacagatgcactgattttttttaaaaaaaatatgtatttggtgtgtgtgtgtgtgtgtgtgtgtgtgtgtgtgtgtgtgtgtgtgcaacttttgggagttgcttctcactttttaccttgttttttaagtagtctcccttgtttctgccactgaactgtatgttccaggctcactggcccatcttactatatggaagtgctggaattacaggtgtctgcataaactccagaaacaaactcaggttgtcaagcttataacaaggcaagaacttgtacctgctgagctgtctcccctgttctacctaatttttttaagctgcaatctttgcctttggaccgccagcttcctaacagaaggataaacaccttggatataaatcccagggagttacccaattccattagctttctagccctcctgcacccttgaacagtggaaaaacccacttcaagaaaaagatgagtctggtttcttaacatgtagcatccaattctttggaagtgtttatgtacattttgtttaaaatttaaaaatcacaaagcataaacaaaaaccgagccactttagtcgtttctgttatttgtctaagaggagagaactcagagatgatgcattctaatttgttgtccaagccatgactgtctctggcatcccaaatcaaacttaactccctggtccttcccctcttgtggtggtttgaatgagagctgctccccagaggctcacgtatttaaactcctggtcctcggttggtggtcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatgggaaggagttacagaaacaaagtatggagctgagatgaaaggatggaccatgtagagactgccatatccagggatccaccccataatcagcttccaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggnnnnnnnnnnnnnnnnnnnnatcaaacttaactccctggtccttcccctcttgtggtggtttgaatgagagctgctccccagaggctcacgtatttaaactcctggtcctcggttggtggtgctctttgggggaggttaggaaatctttaagaagtggagctttgctggaggaagtggatcgttatagaagtaggagttgggagcatagcctcatctcacttccagagagtctctgtgtctcgctctccctctctctgcttcctatgttcacacaaaaatgtgctcaagtcagttagcgtcctggtccagccaacatgccctgcccttcctgccatgataggctttatcccactgggacggaaaccaaaataagctctttcttccttaagttgcttttggccacggagttcattttatcacaggagcagagcagtaactgataggggcctgtgtaggtgcccctggtttggtcttcatctgaacttggtgatgcctcatcctttggttctggttttatttaccccatggaaccaaataggaagtgatttttcaacatatattcctcagacggatgggacccttgaagtcaggtagagatgtgaatgtcaattctgcgtctaacctgtctcagtaatttttccttccgacagatgtaaagtacatgttaaatatgtagatagtccttttattaatgtagcgtaagtccgtgctgacactttagatttcggtatctgtgttatactcctgttcatctttgcttgggctatagccagaagtcatcatttttctccctcattctttgatcactaatccttccatcccccaaccccacccctccccttctgtggtttaacattccgcctgttaagttctgggaaagctgactgaggtgattataaccttatggctgctgccctttcatctcacttggggtttttgttcggagacaagtcttaccgtgcagcccagaacttcccaagtactaggtctacaggtgcgtacaccaccttttaaaaccccatctctatctccttatgatccagatcggatgagtatgcctttttgtactttaatgttaattttgttgaaggaaagacagtaagacaggattagtgcatgcatgcatctggtggcccgctggtagagattgccttccaggtaggcatagaacgcggccttcataattgagacccatatcctgtttatatggtttatgccacgtatagatctcatatgctgtaaatgacacatgagcacggggattctgaatttcagtttaaccgccgagaaactgtcaagacagactcaaattgtttgctgaaatgtagatgcagcgcttgactcgcctcagagtctgcaccaggtgtcctcctctgcttcatcagtctgttcaaagtgaacatgaggccttctggttagtcttgcagagttgttcttgggtcagtaaacagatgtttatcaacttatcttctcgaagtgctttcaagagagagagagaggggaaaaaatcctcaatttgttaagaagagttcagcctaaccattcagctagaacctgtctcctgtccactgtccactaggtagggtacgtcttactctttcgctcatgataagcagtgtgtttgtgtggatttgtatttttctcccacttgtgataaagggttttagatttcatttgttattttaaaatggactctgtatggtagaatgttcaccgatgccagagagagacgggtgatgccagagagagacgggtttggggagcggtgggaaatgtggcaccaatcagttatgtagatggcaaggttcagagtcagacagcttttctttgatacatgtagtacaggctagcctgaaactcactatgtagtcaaggataaccttgaatacctattcctcctaatctcaccacctaaatgctggcaagcatactccatgcttataggacagcatttcttggttagctctccctatcccctccctctttctatcccatcatcctttctctcctccctccctgcctcgtcctctctccttacgcctccctctttgccccttatcttgctagagattgaacctagggtctcaggcatgcctaggagctacagctacagctacagcctctagatatatggacggtctcaagaaataaagccacggtatccaaagaacgtgcgctgttgattcatatgaatttaaataagaacctcaagtgtattgatgtaagacaggcagctaagttatcacatgtgtaagaaaagcataagagatacatgtatacataaagtcataactctgctatcctgctagttgaagacatggtagagcaaggttttgaagagactctggtgttccacactaaagggtgtagatcatctcaggaaggttctaagatgccatagaagaaattgaagtagcactaaggagtgtatttaggatttgttcagtggtggcaacacaatgaacacactgaataaaacgctgtcttcagtactgcggctgagaaaaattacagttgccagctaagaccatccgtgctggatgaatgaagtggaaatatgcaagggataatagcagatgtgtgagtgagactctgtcactgtgacaagttctgtgagaagcgatttaaaggaggaaagagttatcttggctcatagtttcactctggcgttcttggtcctgctgctctgggaataaggccatgagcatcgtggcagggggcaaagcagagctgtccatctcatgggaacacagaaacagacagagaagtggaggccagagcaagataggcccttcgagttgtacttagtcaagcccaccttctcatagcccataatgaagtcaccaacctcatccatgcgtccaggcatggagaacaatgagaacctcaaggggagaacatggttaccatggtaaaaggaccagagaggaagggagtgtgtctccagtgacagatgggacgagagaggtgagtgtgagaggcaggggaggtaggggatgcctgtgccgttaaaaggcttcggcatttaatttttcaatgagaattttaggcagagggctggtgtgatctgattgtgatttgagaggactcctgggaagtaacgagagagacagaaacgggagaagggagagagtgaaagcataaagggcttttgagagtgagtccgtgaagacatgatggcaatgttgggcagagtggctcccagcctgccatgcttccagcctgacagnnnnnnnnnnnnnnnnnnnnctctccctctctctgcccctccctccctagccctccttcctcccctcccccttctcatgtttcagttatcccccccacacactttctcttccctaagaaatgtgcacaaacacaagaccttcatcctactacctaccatgtttcttctagaattccttccatgatgccttgcccctataaagatatctgacagaagccaccaaataaagaaaagatctgttttggctcaccatttcagaacatctcagttcatcatggtgaggaaagcccactaacagggcctgcccagtctgtggcagtggaaactgtgtcaggtgacttttcttatcgttgctaatcagaaggcagaggcagcatactgtaaggagaagccttcagaggtcagcacccagtgacctatttctgccagccaggcccccctcctaagcttgtagcctcccagaagagcaccaccaaacaaccacaaatcaagttttcagatagctgagctgtgaggtgaatgaggggtattgggtattcaaattgttaacaccctctataacatgtaatcaccatttggtgtagtttataattttgtttgcttatttgtttatgcgttaattgcctggtgcctcgaagagcgccctcccccaaggaggtgcttagtaagtatttgcctaatcaatcatggagtgaaggtcacctgccgccattgtcacgagtaaccgtcatgacagggctacggttttctcctcaccatatgtccctttctggaaagacttgatacgtcaagcttcgtgtaccttccgtgtgaagtagaagtgtgtcactgagccgctgagcgggcttcttggctcccagtgtgtcgagcagcctcgcgttcgggtttgcgttgggctctgtgtctttttttagtccggctgctcactcttcgcagccctccagcttaaactcttgagtaactctggacgttggagttttctgagaacttgagaactagatgaatgagattgccaatagcatgccttctgtgcctggcatctaattctggcacttgctttagcaagcaccattgcataattatagccattggctacaaaaggtgaccacgtagcctgcaatggggaattggaagctgtcctagttagcattaactgtcaccttgaagcagcctagaatcacttaaaagggctcaattaagtgatttggtctgtgggcatttctgtgaggaatattcttcatcgttcattcatagaggagggcccagcccactgtgggcagtactattccctgggcaagtggttctggtctggaagctaagtgagctgtgaagcgagccaacaaacagcattcctagttggtttctgcttcagtgcctgccctgacttccctcagtgatgaactaaggcctggaagtgtaagtcgtataaattccttcctcttttaagtcagttgtactcagcgttttatcatagcaccagaaagcaaactaaaacagagacccaaccagaaagctattctagagatgtgaggacaggctacgtacgtttctggattttttttttttatgttctattagttcttgtttatttttaaggagatatgcagttttgtttgtcttcttgttattccaaactttatgctttggtctacaccaagtgtgactttcttagaggaagttaatatgaggctgtcatttctggcctttttgtaccaagcccttggttttttattatagtttccaagcctgtatcccatgttttgcagtgttttctttacggaaaactttatatttattaaatagacgaacttaatttgttgttctacttctacctaattaaatacttatgaactacgaggtttatcaggacttctgttaaatatggaatggttgaatagcaactcacatggctgccataattctaaaataaaagccagggtatttacagatttagcctcatcagaccaaagattattttatgaatttaactcgaggctcacacattgcaaccaccattggggcagtgtccccagctattccctgatatatttaagaatcctaaaagaattctttagcagaccttccgtgctcatatagaggggcttgatgctttattcttttgagatagtctagttgtgtggcccagtctgactctgctactcacgaatagaccaagatgactttgaacttgcggcagccttcctgccccaacctccccagtgctgggattccaggtgtgtgccaccacacctgtcttgctagtgatagtgaacgtgtttgtgcatccggagtcaggacacgggttttcactccttgcacgaaggcagctggaagaggaagtggaacaccctgggtctgtgactgctcgcgactcttctggaataggattgcagtgataacttgcctgtgtctaggcctgctgcagcatctctctggcttgggaagagctgtgaggggaaggatgatctcagaggggagtggctcatgttgagagaacagataccagaccttctagaactctccctgtacagatgaccccattctccacttcctggaagtcctgggtgtctcctcctctgattcacgccctctttgactgacactgatgccaggatcacccgcttgagtgacctgaatgaggccaaaaggtgttagtattcccaggaaccctaggagactggaacagaaaggagagtggaggcagaagctagcttctctactctgaattcgaggacagcattgtaaagttaagccagctgaggaggcgtgagttttctctgctgtttgtggctggagtgactgatctgagagtaaaaggcttgcttgatgctgctctagaatgagtgttgtctggcagagacagagctaaagctgtgcctcccatcacggggatattgatggcagcactcatcatattcattgatctctactgtgaggataaattatccacaagtccctaaaaccttgacattaaaacttgcctttaatcctagcacttgagaggcagaggcagacagaactctgtgagttcaaggccagcctggtctacataatgggacccagtacagccatggctacacagtaagaccctgcctcaaaataaataaataaatataagtaaataaaataaataaagtcattaataacttcacattgaagttattttgtttaaatgatgcaaatttcaatatatgggtataagtggaatgttttattaaaggtactatcaactttgtctctctccccctttttattctggaaataaaatcatttaaaattgtattatgtggtcatgttatgtttctgatctaaagtaaggtttctggggaccagagagatggatccatggatgagaacatggaccactattacagaggatccagaccttattcccagtatccacaccaggctgctcacaactacatgtaactccaggtccaggagagcaagtgctctggtctcactggcatacacacccccaaacatgcatgcatacctgcattttaaaaaataaaaagaaatcttcaggaaatgccaggttcttaaggtgcctcggtgggtgacagagctttctacccaacctgaagccctgagtctgatctttagaacccacagcgaaatgggagctctcactccacacagacctgggagtgccacatgcgtgctggggcagataccttcccacatcagaaacagaaagaataaatgagtgttataaattggaagctctaggtatcgaagaggctgggcctctccctctttcttttacaaacgatcaaggtgagatcagagaatttaacagtcaatttggtcaaaaccgagtagtgagccagaaggcccaggtgcattttcttgaaattttgcttttcatgaattgaagtccatgaaactgttgctttggtgcaagcgagagggccacagcttatgttccagtttgtgtcaaagcgctgtcgattctgacttatgtcatggctggcagtgtaactcagtggtagagtgtgctcagcgtgcacaaagctctggattccgttctcagcttgagggggggtgcgggggggggagtatcatttttaatccaaccaaaaatatcatccggtgcaaagaaagagcacctggtgagttctcctgtgtgacttctcgaatgcatttcttcttcctccttgctcttgggggtggagccttaattgctggagaaaagtgcactaagaaaacattacacgcctgctttctacacagcagcccctctctcttagacaaacactcctaagagactaaagctggctggaattaaattgcccccgagtcctcacccagttcatttgttatcttttccacggggcagaggacctcgaagtctgtgcctatcgtggggctgtactaacactccaacatccacacaaaatgttctcaaatggattgtttcaaaagatcttgctctcctaagacttgagcgtggatagtaatcaaaacgtttttgaggagggaggatcttttatttcacctcctttgtgtaaccaaagcttagcaatccagcccccgcccccccccaaaaaaaaaccccaccacctataaaaagtgatgtaggaagcacggtgttgtcatggtgcacttgagaagctgcaaatgtgtccttgttatttcgtggtcccctttgctctgagctgtcctgtctcccgggacagcatcatgtggacttgtgaggattatgactgtatatggcaggtcaagaatgtaatcgctctacaacgttcatgctctcccactttagcccctctgatttcattttggtgaactctttcaagtctttccactggtttttcatcagatttatttatttgtgttttatgtgtacgatggtttgtgtttatgtgcctgcatgtgtatctgtgtaccttgtgtatgcagtgttctcgggggtccaaaagtggttctcattgtagccggtgttagaaatcttaaagcctaacctggaactgcccgcctgcccaagataccagcccttggaccctcctacacttggcttgactcttgcgtttgagtctcttttctcagagcctcgctttcttccttgctagcttgtcctcttgattcaatggaggaaacctaccaatagctttctgagaagtgggaagagagcacattttttgactcttgtatatggtctccccattgattggtaatagggttcagacaggaccttgtttttctcacaaatgtgaaggtattgctccatcgtgtgaccatatttataaccttaagtctttgtgtgaattaatttcttggttgctggtttgtcctatgtgaacattcagtccccaagttctacagggtcaggatagtgtgccctaatctggaatgccccttttaacttggagattcatttccttccatcctaggatatttattgctatttcatgtatgtgcctcccccgcccaatggttattattagaaggttgcttggtgctattattttcttatctttgctcttcagtttttaacctgtgtatttggtttttgctgttgttgttttggttggttggttggtgtttcaagacagagtttatttgtgtaaccttgactgtcctagaactggttctgtagaccaggttagccttgaactcacagagatccacctacctctgcctcccaagtgctagggatagagggatgtgtcactaccactgcccaactagcctgcgttttttaaattcctgtttgggagactcgctatccctttccttctaacacttccactgagttttattttggaggattttgtttgtctttgtcattgatttgtgtgtgtgtgtgtgtgtgtgtgtgtgtttatacacattaacatgcatgcatgatcacatatttgtggacacacatttgtaagtgcctgtgtgtttgtacgtatgagtggagagcagagttggatatcaacatgtccctttgattgctctcctctttatatactgaggcaggtctctaactgaacccagagctgacagaatcacctactctacctagccagcttgtcacagaacccctttgttatggttcagtttttgttcttgtcctcaaacactgtgaccaaaagcagcttggggaggaacaggcttgtttggttaatacttccatgtccccagtccatctctagggaaataaagtcgggagctcacaacaggaagccggaggcaggaattgaaacagaaatcttagagacatgcagcctactggcttgctccccatggctccctaaatttgctttatcatataatccaggactgggccctctccagaaatcattaatcaagaaaacgtcctagaggctggtctacagaccaacctgatagaggcgttttctcagttgaaggtctttcttcctagcttaagtgaagttgacaaagagctaaccagcacatcccgtctctgccccaaggtgctgggatcacaggcagtctgccatgactgttcattttctgtgtgggtgctggaactctgaactctggctcctattttagtacagcaagctctttatcagcggaagcatctccccaacctttgttgatattttcaattgagacatttttaataataattctttgagaactttatatgaagtatcttgctcatattcacttcctactcctctcagattaatcaattcaatcctaaatcattgtttataacatgtgttgacactgttgtccccatggacctttcttgcccactggttcacagctgggtgtcaccgtcagtgacccttcccactccacggcagccaacgcagtacctgctattactatgaaagcttgccttgaggaacctcagagcttagtaccagcctgatttctctgtctttgaccaaattccatgctgtctttagcactagggtcttaccatcagcatgtggtgggtgactaagagcagtgggaatagcctgtattgttttgggagtctctcgcgtacccccagccaacaactggagggagtgtcccacagcatagccagcactgggccttttacttggcaatctatagcttctggggaaagcattatcccccatgctggatgacctcaaaattaaacttcttttagtgtaaaactgcaatgaatcctgtaaaacagtagattcctatatggcatttttaacatccacagtgttagttatccctcactctgccctctccttcatcaccttctacccctctccccacacaaatctctcttctcttgttggtatttttgaaaccaggttaaaccgtgtagcgcagactggccttgaccatgcatcctccttcctcaactcccaggagctggagttcaggacacatacacctctagtttggcttttgtttactctctactctgttttaactcaatacctggtgctctgtgtccctctatccccatttcaagttaacagagccgcaggccctaattgaaaatcctggtcatctttgggctacccctggagaagatgacccacatgtgcatgttattgggacaccattaagtaaatgccagcagatttggagcttgactatgcagattccccaaaggtggctgtgtacgtctgttgacttcctcgaggagcagcgggaaaacagagacaggaggtcatcacacgtgtgttcttttggtctccgtctgtaaagtcccagtgaaccccacccagtgattctcctgtcagctccgtctggttctgctaggatcagagcacatgctgtaactgccatgatagggaaggaacccagactccaggtgttccagatgtgactggtgccaccaaacccccgtccccttaagatcttgccatgtgaacctgcagttacctctctgctgtcatgactggacagttagcattcctctttcttggatctgttgcatagaccaccactaactgactggtctgcctccattgactggtctgcctccatgtttctggtttgttccctttcttcttctccacaggcctggttgttatttcttgtgttgtctttgtctttgtgggtttacgtctcctcaaaagtctcttttctgttattttacaggagtttgggaaagagaagaaagctaaaattaacttggtcccctgatgaattctgacagtctctctgccgtagggagagcgcccaaaatgcacgtgttcttacatatatcaaagtagaacttctgaggcagggactcttcctccactgaaattactatcattattgatgaagagcattgatggtggctttccttagatatttaactcctgccacttattacatagaattcttataagctgtggcttaaggggcaggtccttgtcactttgttggtaaccttggttaaaagaggtcagtggaaaactcagaattaaacccagctaggtattcacttttacactaaattcctatatttcaatgaagcattcttctgtgagttattaataaagtacttagcgtatatagagcattcaaagctgagatagcacatatccacccccacccccaaatacccccaaacactgtgattatagaagtgtgccaccacacccacagtgacatgacaaatctacctcatgatcttgaaaacaaatcctgtgttccatgtcagccatactcggtcacagtctcttgggtgagttccaatattgagacaaaatagagcttcagttttttaggaaataggtaagcaaggtgtttgggcagcctcagggatcgggcatcactgatagaatttaatgtgctgaagttggtgtaggaaagtggtacagttaataaagcaaaggaggaaaacatgtgagcaaaacctaaagtcagagtatttggacacagcaaggaaataaagcaatactatgtatacatacacatatataaatatacatatacatgcatgtgtgtatatatacatacatatactcgtgtatatgcatatgtacatacatatatgcatatgtatctatactacacacatgcgtgagtgtgcacgcgtatacacacacacacacacacacacacaatgtataaaacctggaaaccaaggccctggtggcccagcccagagcagttggcggtacactgcctctttctttgagatgttttccctcctgtttaatcagctcccacctggtgagaagaaaatgcacaagaggctcccgtgggtgggtgcgcactcctggtctcccactgccaggcacacgagtgttagccctccccactcagtgatgagtgacgctgaagctaatgcctgtctcagagtcgggtctcctctgctaatggtgctcgattctcatctgtctgctgtgaaaccaaactgagctgctgagggaagggaagggggctggtggagcatcaacttttatttgtatgtaagtgacttagaaggctctcaaaggcgaacttaagtcatgattaacagcagctttttgtttaagtcggtgttgggacagtgttttgatacagatcatgtctgggagctgaagggaggggtgggagacgcacactgcagaatggccaggtttatgcctctgaacatttacatttttaaaagtagctggtgcggtgccacaaacatggaatccccacacgtaggaagtaggggcagaaggatcaggaattgaaggccagctttggttagagtgttgatgggcaccctgggctacgcaagtgccattcttcaaaacacagaagcaaattctcacactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtctgggtccaagaagttcatctttatcattttttttaagttttagttcaaattcggtctatattgtagggatagtggataatgatacacttggtaataaacacctcagtggggaccaggtgccaggtcctgtcctgggcacctgacacctgataattcatttagctatcacagctctccattgggaaggatctggtataattaatctccagatgcaaggcacagtcactgaggcacagatatctgtcttgctcacttatacatttatcgaacttggaacactgcctattaggtcactatagggtctgggcttggaacacgtcatggtccaggcagaggaggaccaggcatgggatcttagacatcgagtaactttattagggggctctttgaggtgagtttcaagaactgatattaaccctacaaatggacggtgctattattgtctttagctaggattcgacccaggtcagaacctagcaaaatggtttctgtctcttgaatatcgcttatcccaattgcttagaagcagaagtggttcagagtttgaggggttttcccagattttttttttaaatatttgcatatatacaataaaacatcatggagaacagacacaagtagaaacacaaactccgcctcatgtattctatacaatgcctaattgccattttatactttatggaagttcccggcatcgggacttcaacggtcacctgaggtcagctgcggaattgcctgtctgtggcctcatgtcagctctacctttgttaaatacccccccaaaagaagctcagagaaggacagttttatttggctcccatgttgaggggatacaggtcatcatggcggggggcgggtatagcagcaagagcctgagacagtttagctcactttctcgtcactgttcagtctgataatgctgctgcccacattgagggttggtcattctgctcttctggaagtaaccccaccgagaccctcagaggtgtgtctcctatgtgcttttaagccctgtcacgttgacaactgctacaagacttgcaaactctgtagatgtagggaacattttgagtcgtagagtgtgtggaattgggacttttggagcaggcatgcttatcctgccttcgtttgctcacttttgtcgctgaggatgctctgaagcaggaccaaggatgaggactgagtctcttccctgttacctggtgtagtcctgtgctatgtccacgccccaggcctggccaacagagaaagccaggaagggtggaataggagaaaatagcacagggtggtatggacagcggggagatacatccgcctactccacttctctgcctcccacttttcctttctccctttccccttcttcaaaaagaagtggaagctgagctcatcccagagaaatctaaaataactgtcatgagaaaacggcccctctggaaaacgccttgttctcccgctgtttgtaaatgtgaaccgctcagcaactgggcagctgcgagggtataaatatagcctcagccctgacgccggctgaatcctactttcttagaagctcgctgggaacccacggaagtcagggagcgagcagtaaagctcagtcaatccgtcaacctcctctctctctctctgtttctctctccatcctggcccttagtgtgggtgtgaggatagaagtagctctgagagtgtgctggaaatagcccttggcactggatgctggttaagctcaaagacatcgaagatgcttcctatatagctgccccctgcctgacccttagacctgggctattttggccattctgtgatctcaagagcacgctctcaacccagctgcttgggcacaagcaggttttccagcctgagctctgtccgggcacttggcgcctctccgctacctctgcactcagatatcttattctgacttgactcagctgtctagagcccggggtttaaaaatagctcttggtgcttgctgcagaatgaagggacagagagatagcctgggcacagggaggtcaacacttggggcccctctcttcatacctgtaggcttcgttggactggagtttttagtttcttcaagttgacttctagaccgttggccaatcacgaggctgcacgagaaagaagagatctcttaatatttgtgggtattgggtattgatattgtttggagtctacgctatggcagaagagagtcattattttccttggtggttctcagaaacaaacggtacctagttacctttcggtgtagacagcagagtcgtttagtgttatatttatttgctttctctttcctgtttggtggtaaatgcttgaagaagagagccatgtactttcattgtgtctacccacaaaacttcaataaatcattttacacaacttaatgtgctgcatgaccattgaactgaccacaataacattcgtttaaggcccatggcattccattagcagatggtgtgaatactacattgttcacatcgttcattgtgtagaggtggtgtccagcagcagtctaagagaactgtgtgtgtgtgtgtgtgtgtgtatgtgtgtgtgtgtgtgtgtgtgtgtgttatggtttctgtagaactaactgagctacctctatctattttaaaacatttttctgaggttgtttttatttttttcaaactgatcctcttagcatattcataaacataaagcaggatcagcaggatctgttattcagctcatcagaatacattgaaattgctacatttaagcctgtattcattagggaagacctcgaaggtcaagggctaggttctatctgtgccctggtggtggcattgcctcagtgcagtgtgaaccatcttggccccagtccccatccttggaactgaggctcaggtagcgggagcactctagctgccttttgccctggtgatgaagcgtggtaaaaaggacactctccgaggcaattggggcaaagaagcccaggtaaacatctgctccagcacactgaactaaggtttgataacacacccctcctaatcatctctagctatcgatggcatgggccagacccactcttactcccgagaacaaagagaaccacccctagtctacaaaggtatatacagtggagtcagccacttcacagcgttgtctaagtcagagcagggaaaatgtgagtgtcaaacggtgctgggttaggcacagagtaagagctaagtaaatgctggttgagaaggaaacggcccctgactctcgaagctgagcaaagtcacaccctgcatttgatctctgtggccagagcaagttcattccctcgcctgaagatgctcacattaccctggctacattcttttatgtttttttttccccaaaactgaaatgcagtttcacagagatgacaggcagcaccctggcctccagttcagccacctgagagaaggtgggggatgagaccagaaggtggtccacggttataatgcactacctccccccacacacagcagaaaggagagaggtgtcccgtttctgaccttctggtcctcggctactgttaatgttcacctgctatgtgtgaattcttatctcagggttaagttcttactacctctaccctttcacccagccctcctggccagccgcagctcatagctgggtcgtgctgctcacacttagaaggtggggaaacagtctgggctcagtagggctacaatgatttatctggtgtctgcatcagactattaagtggctgactgaggatctgaagccaaaaccttctgattcccaaccaaggaaggtgtgaatcaaaccatgggaaagacacacacacacacacacacacacacacacacacacacacacgccaccaccaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcctttatgcaagtatctctaaatgctttgaaatgggcctcttaaaataaatctgcataccttcattctgtaccacaaataaaatttaaatgttgccttcccgagctgtggcatttacgttcttacacttgtcagatctctggagtccattttgctagtatttgtttttcttcgagataggagttaattttgtcacagtttcttcccctgacaataactgcaactttttccccccctgaggtagctttccctccaaccgtttcttgttgttcttacccaagactcagtatctgccaaaacaaatgtaagagagtgataagtgctgagaggaatgtctgttggaccacaggaaatttcctgttcaggaagagatcttgggaacttcctgtggaggagtgcattatgggacttctggctgcctgcccttgaccacagctgcaattaactaaaggcaccgggtgggggggcgggggggggagaagaggagtcagctacccacagacctttattccacgtaccctgaggagagaatgggccaatgtgggctcaaagcaaaccaactggctcctgtgtaataagtcactctgtcactctgtctcctttgtggcctgcccagtcttttcacagcattccagataccgtatcagggttgtgaaaaccaacactcaaagttgtgttagccatgtttacccctctatgccccccaaacctgggtgagcaagaaagaagccttgaaccccaccagattggaaacccttagctggtttattgtctactagtgggccttattcgggcttagaattcatgatgcttccctctgactccctatcccagggaagacatggaagaggaaaaagaggacactttggctctctggcataccctcattccattctgacaacatgaaggacgtgttgagaattctaaaggaaaactgaagcacagtgctgttcacaagcaggtttctgacccatgattcatgccttccctcctgatccctgagctgggcacttcatccaaacgccttttctttatatccttgccaccttgtctctggggatccatcttggaagcgtcggcacccaggcctccacttggtggcacatgacatttgaacctttctgagactttggggatttctggcattaggaggagggttgagcacgttagggctgaaaattaaccacgttctggtccatgtctgaatagcccgagcttctgtcctgagtgctctagatcatccgtctcttattccatctgcatcgttctctgctgggatacacatcccctgttcatacccgtgggtcatctctgaacaggaacgaatttctgcgttacagtaatttgtgtgttcttaacacccgttggagggaactccttaggacagagcttgtttgccttgtgctatatgattaataaattccttgtgagcttggattgcattgattttttttttttaaggaggaaagtgccaaggatgtctttaacgtgggtcttaaaagggcctggtgctattactatgcttgtgatactcacagtgaatgggctgttctttgttattagtgaaggtgtacgtgtgtgtgcgtgtgtgtgtgtgtgtgtgtgtgtgtgtgtgtgtgcgcgcgcgtgcgcgcgcgcttccctttcagcaggttgccatgccacatgacttcatctttgagtttccattctcacgactgcttttctcttcagaggttggattgtcctnnnnnnnnnnnnnnnnnnnnnttgtgtgtgttagtggaatggctgcaagtaatgagtctattagctcacgtttgtgtgtggggaggacatttaaaattctaagggattttcatgtatacaacgcattataatgaactgaagccgccatattggtgcaagagatttcttgctggcgatcgtgctcctgtctcgccccctacacacacaacctgtctctggatttgtttctaatagactcttgttgtgtagcccaggcaggcctagaactcaaatcatcttgcctctcagtgccttgagtcgtgagattgcaagcacagacagcatttggagcctttaaccagtatcttccttgcctcctctctctatctctctgtcttgctctgcttctatgactgtcatgattttggattccttgtgcacgtgagatcgtgtgatccgtctctttctgagcctggcttatgtcacttagcgtaaggttctccaggtttgtctgtcacattgtcacataattccagacatgatgatctgggcccacagtcctagcacctgggaggtgaaggcaggaggaccaggtgtttaaagccagtcccagctacatagagcatttgagaccagcttgacctttatgagactctatcataatgaaagcaaacaaaaaagggaggtgggaggcaaaatattcatggggaaatatttggaaaaaaatatttttacagctattaatttccggattactatttagttgagcctatcccctggtgttataactgtatcttaattttttaaactgaaaacagaaatacagtggaagcccacagtgaggcctggcagggggaggagtgtccttactacagctccgtgcagtcttgctttatgtttcggcagaggctgccagcatcagaatgtcaactatgcacacagagaaacataaattaactgactttggaagggaacacactggacctcagatctcacttttttttttttgaaccctgacctttagaagaaaaagacaatttttaaattaaaacaaaacaaaacaaaacactgtctgagttagtccaataagcagctctccagctgtagcttacaggaattaggcttgtgttttacatatgaaaaacatgtcctttagttggaaaaatgaatttttggctttggcgtttacattgtgttgtttgaaacaaggtctctctgtgttactcaggcttgcctggaacacctagggttaatagctgctcagactcttgagtgctggggccgtaggtgcacacctggcccagatcttttaaaatgtaatcttgatgtagtaacccaaacctcccatttccttagcttccttgtgggtcatcgttcaactgtgcactgatcagtgtggtgttttttctggacacttggacttggagtgatcccccttggggcattgctaactccccgtggagataatatgccaccatgccagcatttgctttaatgaaaatgcagtgatttagtcgggggggggggcttgcatcatgggtacctaaatgtttaccagtattaagctagtgtggtgacctgtctcatctcatcttaaaaattctgcttgatggatggaagaagagtcaggccagaaagggaaggctgaggtcaccagcagagtctgtactctgtaccggttgggccccttctctccactgtcagcctggccgggggtgaagctgctggcccagagatgaaagcggacatgtgccagtgaataagcaagtgtctgaggaatccaaggccaaaggaagcaaaatactccattgttccccgcatctcccccttggcgcctcccccatacccccctcctctgcccactctcctaggccagctcacaagtgtctgtgggggctggtggactccccatcatgggcttcctcccaggaaatttcctgtggtggaaactctggggaaacttcctgttgggtaggttcctgcctgcgactgataaggggaactgcttaaaacccccgccagccacagctgctgttaaagggtggcatggtctttctgtttcctcagtctgaaggaacaagaaagggcaagtaagcagaggcctctgaagtctcccctggctagaatattctggaagctgaaagttccacttggaatccgcaagttccttcagagagttggtgctcattgaaacatgcacttttgagtatggggctctacaaaccttctaaaaaaaaacccaggtctgagtgtttccatatcatttccaagccttcctcttagtcttcactgtcatgcatcttcgagtttcagtgatagtgtacagggaattttaattagtcctcgccaattacagatacagtcgatgatgtgaacaaagtggttcacatgataccaatgtgtgaatcgtctgaggtacgctctgtacgacagtctttagcctagcacagaattctcagtaggcttcatgattctgcgacctggcctggacttgtagttgcttattgtgttgtttgccagcccttaggcaaagataattatccctaaaccatcccatagggttaagctcagctctgaatatttcaatattgggaactctatagttacctttagcagttcccgctgccttgctgtactgtaagtttggttccctaattagcctggtttctccctaatgacctgtaagccccttgctatttgccccactcttaatgtataataaagataattgaccctttgccctctgtctgatttcatataggcagtttctcaaatggtatgctttatggcttcatttgctctaaatctatttctctccaagtgtggggttttttttttccttcctggttcagggtttaacatacacttccttaaagttaatggaaatttctaccagccacatttatccaaacttccaccttggtatggtttctttcctggttatagaaaaggaagattttggcctcagaataaattatgaattaaacgtgcattatgtgggggttggttatgtctgatcggcactgccgactaaggagccatgaaagaaattacagtgaaccgggaagaaaaatgccggctgataaggaaccagcctgttcgacttctcaaagacaaagaccattattcatctttgtccatatccatggtatcttaaaatgatttggcacataatcttgcaaccatgtttgctgagggaatgaatcttaatagtaaaaaaaaaaaaaaagacctggttattagacattagttccttctagaacatgtaataaaacctgcatcttatatcttatttaaagaataagctgtcctcgtgaactgagtattgatcctcaaactggcaaactgctgttgatgtacgtacgtacaaaagctaaagaataatttctgtttaaaagagagagagagacttgtccaagctttacgtacgattacaaaacagtgatttaatttggggcacgcagaagaatagggggcccgtttaaatggttcacagtataattacttttggttttagatctgattttattttatagaaaaaggttgactggaatatgttgtaaacacagaagactgttgtcataaagactccattcatctacatgataatagctatttcctaggcactctcactctaaaagaaactgtagtgaggccctagtgtttatagacccagccaaggtactgtcgtcactgccactattatctcatggtccttgtcaagtcgtattaaagtatttcaggaccctgctatgtgctgtgatcatttttggaagtctggccagtgtagcagaaggaccaggcatttagatgctttaaactagtggttctcaaccttcctaatgctgagaccctttaacacagttcctcatgttgtgatgacccctcaaccataaaattatttttgttgccacttcataactgtagtggttgagagctgtctagatctgtttttgctattgattagattctgggtttgctatgtatgtatgcatggtatccatacatgtgtatgtgtgctcacatgtgtattggcacatgtatttgcatgtgcatgtaacagccccaagttgacattgaatgtctttctcaattgttgttcacagtgttcatagagacagcatttcttattgagtccagaactcaccagttctgcctaataacttgcctagggatctctgtctctaccttccaagggtgggaacaggaggctgtcatgccagcccagtttgtatgtgggtgctgagaatctgaactcgggtcttcatgcacgcatgctaattgctctatccaccgagccgccaccgcagcctatactattaagttcttttgacatgtatttattgaatggctactgtgtgctgtgaaatgacagtgagtaatctaggtttgaagcctatctttgtggtatgagccaaagaatgaacactagttatttcctaccgaactacagacatctactgtaaaatgtaaatcaggtcacgttattctcctgtttctaaacttctaactggcttccattctgacctctcagtgtgaaccatacttatgagatctgggttctgtaatttctataaccctctgtctccatctcaaatgcgttttgttctgctcctgccttttcagccatgctggttggaacatgccagtcactatattacttctgaacaagctagatgtgttcctacaacagggcctttgcacttgcttccccagctacaaaactgtcctgccagagaagcccacaccataatccttcactctgtataaaatatcacaatggggacttcctcagtagctctttccaagatgccatcttccttcactctctgacctatctgccctgcactatcttccttatttagcagttttcagacttgataagacattagtaatgtcttcatggtaatccttgtgcatctgtttggaataagctctgtgtgcagagatatgctttctacaggagggtcctaactatctcaggcaagaaggtgtaccaggatctttcctgtagagtagatgaatttaagctctttatggaacaggactgtgatttctgccttgtagttatgaccattagatagatcaactacatcctttgtccacttaacactgtcacattcattaatgtatttcagtcttctcagacgatgacaagtcactgtagccccccacccccaggagaactgtgtgttcagtgtgtcggggtgaggggtaatcttttcaaccaagtgaaccgcctaaagtaagaaacagccaggaggcattgttctggaatccggaatctagtaacgggggttcagttgtccacacttggggtaaggtagattgtcatggagcatgaaggacaagagtttaataaggttctaattgtgtataggacacttgcaagctgaccaagggtggttgagtgagaactcaggcagcaaggaccacagcgcagttctgcactattttgtctctaccatagaagtcatttatagcactataagctctcataaaaaaataataataattttccattcaagaagcagagacaggaggtttgcctcaagtgtggggccaacctggtttatcaagcaagtctgagccagccaggtctcaaaacaagctagggaggcatttggggtgtggctcaaggtagagcttgggcttcctcttcataggcttcttccccaacagcagaacacaaaggagagtgtgctagaggaggcaggatcctctgttaggagcacttattgtgacaaggtcccagggttagctcccgcagtacttggtggttcacaaccgtcgattactctagctctatgggatccattgatctctcgggcctctaccagcaccaggcatgcacatggtatacacacatacatgcaagtaaaacactcatatacacgcataatgtaaatctaaaataaaatcttaagaatgtacacatggatagcatgcagtaacttatgcagacagctacaaatatgccaaacgcatagatggcatacagtaagaggtaagtagctcttgcttcaaagaactctctccctgttactggcacgctagcgtagcatcgcacaaagccctgggctcatggtaaatgcataaatgacatacagtgagttattaaagaggtagctcttttctttaaggaactccaacacctttagcagtgtggtagcccagcattgccctgggctcagctctgacaaagccccgtgaacttgcaagtaagtctcacctctccagtcatgcgcatgtttgctaaaggagagcatcagaggactcagctgatgaccacccatgactccaacatgaagttaatcagagtgattatcatggaggggttctggagcttctcaaatccactgtaagttttcaagatgtagacataatcacaggcccccagatttccagttgccagatatatttaggctataaagttacccaccaaaaggagtgtggctcgggccatattgatgcactgtaaggttattatattattctttacagctccgtacaagcttgtgataataaattgtagggactggcacctgcctactttgtttaattgtttttgtttaacttatttaccgtgtgcatttgcctatctgtgagtgttcacgtctagtcacaaatcacagcttgcatggatgtgggtgtcataggacagcttgtaggaagatgcttttctttctggccatgccctgaggtcatcaggtcctcatctgctgagtttttaccttcaagaatttcgaagagaataaatgtactagagaggtagtgaattttaataaagtattttaacattattaatacacaggtatatggtggtagagagacctgggccaaatgtctggaagctgagaccaagatacagtagccttcagtgaatggttctgtggtctggcttccaggttgggaacagaggctctgggcggggacgattccatgacaggtctcatcaggcagcaagcaggtgatctcagggcaatgaggctgacaacctgccctgaaaactcaaaacggagagctctttatttttatttctggtgcattcaaaagatggaggaggaaaaggaaaaggaccatcataataaaataatatgtaaagagtatccaaataacactgggggccagcagcagccagtatttaaagccaggaagcctcacctaaatgggtctatgtaaatcaaccagctcactgaaacacgcacctgtctacatctgcctgcgtgcatactcggttggactgaaatactcttatttccttttggggagaaaattatatgggtttggctgggaacttagttggcagagagcttaccttgtgtgctactcatcctgggctccactcccagtaccacattaactgggtagggtggtctataatcccaacgctgaagatgtccaagcaagagaattgccagccaaaggtcatccttggcttgatggcagatttgagcccagtctgcgatacatacgtctgtgtgtgtgtgtgtgtgtgtgtgtgtgtgtgtgtgtgtgtgtgtgtgtgagagagagagagagagagagagagagagagagagagagagagagatgacataattacagctatatatagaagggtggtatcaaatcctgttggtttgtccccccccccccccaagaattttttttggaggggaggggagaggagttaattcttgaatttaaggagccagttatttgacctatttttttttccatatcataattgacaccttcttgtaaagcagggggaggatatatttctcccctgtagttcctttccccagtcagcatctgcaacacatccacccacaggtcaatggtggcatcatgaaatggacacatagtttccttgaaaataaatgcctgcggggcatctcaggagttggggcatctcaggagttttcaacagattagggggaggaaaggatggcaataaatgtaattgttttcaaacgtttggtaactcagtagcacccagttcattcccaactcttagctgggtgggatgtgagaatggaccctagacactggttgccagatgagcgactttggtttttacgtacatttctttttccccgtaatttgagccatcaccaccttgccccatctactgcccattttcctcctgggatacaataaggagaaagaaattctgaccaaatagtatagaaaacaaagaagaacttcagcaaggaagacgggagcagacagacagataacagtaaaaagaaaggaggcggtcagaaaatggagactagagaaaagcctgggcagagaatccggaggtctgaggatttatcagtgcctgaaggtgagacacacaggaacgggggaaggagaaggagaatgtgggaaggaactgaagaggatttgagaggggggagattagtaagatgagagtccagtgccagagtgttccacctgagccacacccgtgggtctgatgagagtggaatgctgggagtcatctaaggtaatggcttatccccatcacatggataccgtctaacctaaggtgcttttctgtaaccagcttcagctacaaatgtcttcttcctgggtggttttaatttttattaataagacaccgaagccttagatgcacacatggctcagtagaacccactctgccatagttcagtttcttcttgccccctcccccctgtgctaggcaggactgtgacctgcagctgtccattctgctctgcctcacgtctgcagacccttccagcctccactgctcacctaaaaactctagtttggcctcttgctagaagttagtaatggactagaacagttaaagtgctgaccaggtggtcctgagtatctagtgagccccacctccgctcctttaattccttctgcactctagtgtctacagcaagaatcagctgaggctgaaactgacgtagtagctccttgggtctatgttcttatagatccaggaagaagaccacatttttaagggttttgttgttgatgatgctgttgtggttgtttgtgtgtgtgtgtgtgtgtgtgtgtgtgtgtgtgtatgtgtgtgtgtgtgtgtgtgcatgcaccatgtgtgaacatggacacaagcgccaaggtggaggtcagaggacagctttcagaggagtccctctcctcctattgtgtgttgcagggactgaatttagatcatgaagccaactcaaaagccacatctttagaacaagaagggcagccattttgatgcacttctgaggacctggatggacatgggtagcttatgtacgccaaggatggagggtgcacgtgcaagtatctatgggtgtcagtggctctgcagcttagaaaagcatcagtgcgtcaagactcatgctttctaaatgtcaacggggagaaaaacaacgctaggtatggtggcacactatggacttcaggcatttaaggacaggagacaggaggatcaggagttcacagccagtctctacttatgcttgaggccagcctgggttacatggtaccctgttaaaagaaaagcaacagaaaggaaagcatgaagaaatttcaggcagtggttctcatccttcctaatgctgtagcccttgaatacagttcctcctgctgttagccccaaaccataaaattgttttcgttgctacttcataactgtaatgctgctactgttatgaatcataacctcaatatctgatgtttctgatggtcttaaagggatcatgactctcctgttgagagccataggtttaagcgaaccgaccacaatttttaaaaatgcctgattctagctcagaagatccgatctgacaatatgttaagactaccacaattagtgagaaagcgccacgtcagattttcttctccatgtagaagtggttcaagcacatctttaagaagagcctacaacttccagaagatttcaagttaggtttttttctttgctgctgctttcattgatttacaatagaatttgggatttgggtagaaccgcacgtcgtccaggccttgcacggtgcaagcatgctgcaggggcatggccaccagggatacagagcccttccccaaacagcctttgccaattctaaacaccattttcagcaagtttgtattgagccggtgcttacatgactgtggcaaagtgaacgtggatcttcctggttctcttctgtggctttttccagctctgacaatttcctggaaattatttctgaaagacagatgtcagcctcatctccctcagactgtcgtgacgtctgtattatcagtctcatttaggatccaactaaaaaccaagaaataccctatttttatgaaaagagagtttggcaatcaatggggaagagagagacctcttagccttggccagtgataattccaagaaactgtgccttttttaagcattttgtggtgaccctgctatccaaagaatttgcttatctgtctaccttaaaagtttccatagaaacctgctgtcttcagaatattcccagctcttcctttggtgcccacatttctaccataagaagttcattattgaatgtgaattttatttacgggataggggctaggagatgactcagtaaagtgcttgtcttgtaagcccaaggaccagaattctatcaccagcccccaaatataaaccaaacagcaaactgaaaaaaccatgggactgggtagtgcacagctctcaactctgggaaggcaggcagctgggtcctgggacttcagaggctggccagactagcctactctaaactccaaggcagaaagaagacactgtctcgggaatcaatgtagatagaacctgaggagcaggacctgaggttgttctccgtccccacactgacactggcacacatcccgtgctcacatgcagtatatacacacctactcataatacatatagacacactcgcgtacgcaaacacacacacacacacacacgtacacacacagacacacacagagtacagcaagggccaaggagttggcttattaagcaattggtagtcattgcattagaacattaatcatttttagatcctttcctggaagttcatcttaatggacgtcagtggagagaagaaatgcggctatgtagatcaaggagactccttgggttctggggagggaaatgggtcatggaacaggaaataggaaagaaagaacatctcagagtaccaggtaggaacagcacctcgcagcagaggccgatttttttcaccacagtcctgtgagctcacatgtatttttacatataatgaaataaggtgacctgcccagatcatcggccagggaggaacaggacttgggatttaaaacagagctgcctgatctagacatctcattccctgatgccaggtgctgtccttgagaaaagggcagagaactggaaagctgagattcagttgcctccttcagaattttgcataaggctgaccctggctgaaagtctcgttttgcaatcacccatgtggagctagaaaaatctcctaatgctaactcattttgagtttggctttcttcttacataaaatttatgtaacatcacaaactagtttacatggaatgcgatacttgtttataaagagccacttgttcggaatatttttagcgcccccccccaattgttatggatactttcccggctgtctagaaaaactgggctatgtccacactctcttcagaggcttgggcttgcacgatgctcacatgaccacctgaaagccggtgatgtccttcccctctaagtcctcacactaactattatagctctgagatgtctcctaagtcaggatacgtgcaggttcacctaggagatgataaaagaaaaaaaatcttcagtttcttcccaaagaagtcacttaagccaacttggcaaagccattttaccttccccatttaataccttagtgggcttgttttctgtgtctcgctcttgatggtttgtgggggacactcagaggtagaggggtgactttatgaaggtgggtgtcttctcttctcctttccttcagtgttctttcccagctaccacagaaaccacactttctctactgagcacacattcctgggactagaacaaaaggctcctgtgagctaaaaagcagcaggaagggtggggcaaaggcctgaaggttttgagggcttcatttctcccttgctgggggctgtattgggataggatgcagtttggagcctgcttcttcaccacaggggaaactgaaatgagccctgaagcttcataggggacccctctaatctttatcctcctaacatagtaacttcctgaccctggagtgacttgagcatctcccagcactcagcaggcccaggaaaccagccgtgaggccgcagaccaagaaagggagccctgtcagtgaggttcgtctgagcctcagtttaccctgatggcctttgctttgctgagtgcctccttccttcagcctgttcgtgacagcagagccaacagccatgggaacctgccctccaaggacagtacacttcattgttataggagagaaccaggaaatcggaattttccatccttcctattgaggagaattggattccacagagaaagtaacagctttaaaaagaaacacacactcgagagtgtgcgcgcacacacacacacacacacacacacacacccaggtccctctgctctgagctggcagaccttcttccctgcccggtagttccagacactatgaaccagggcttggccacgctgctgagctcctgcactttcagtagcgagttaatgtggccatgactcagaattatcggaccccagatgccagagaagtgaactaacttctttttggctcacagtggactcataggcaacaaaataggtttcgtgttgtaatgaagcagtgtagagtgtggctcccaagctgtgtgttgtctgcccctgcccgcttcattgcttgctggatcattctctcctatccatcctccctcagagccaagagcccgaaagccagcccaagtcgtttgcaaataacactcctgaactcagccttgaaaagacttgttacgataagcttgtccagggtgcatattgtatctcgagtttgggaatagctgggaaaaccttctactccatttagggagagcctggatggctagtgggtggggctctgagcacaggattaacaccaataatacaaagaaatacacgtagaaagtgcaaagttgatcttgaagaacagcttacaattattatgtaacaccttccttccaaggactaccaagaacttccctgcagatttcacccagttctcacgcagcatgaattatttcccagaaatgatttaggctcttttggaaaatgcattgattcttttaaccgtcatgatcccacttacagtaaaaccactattatctgattttctgagttgtaaagctattattaacgggcacattatatatgttaccagtacagtgacagctgatgtgtgtaatggtgaccccaaagttctataagaccctcaatttgcccactcatgaatcaagggagattgaaagtgtattcaatccagttttttcatgttaagagtcttattatattcaaatcctctttaaaggagttcaagtatgtgcccgccgtgatttttctatggctgcaccaattcagaatgtcctatccattcttgcttggtcttgcgattgaacccttatttaaaaaaaaaaatacacctttttagtaatggggtaaaaaatacaaatgatttgatctcaaatctgaaggtgaatcagtttactttggtttttagatttttaattttgtttgtgtgtgcacgagcacgtctgtgtctgtgtctgtgtctgtgtgtgtgtgtgagagagagagagagagagagagagagagagagagagagagagagtgaatgaatgaatgaatatgtttgtgcaccacagagaccagaagaggtcagatcctagatctggagcttaaattgattgtgaaccacccagtgcagaagctggcaaccaaacctgagtcctctgtaaaaagcagcgagtgctcctaaccattgagctatctctccagtctccaaaatctaccttctaaagtgtggtcgcagacataagtgacataaacacatttaccaaagtgtgagacatcactccgagccctctccactcttactctttgtaccttagcccagcgtgttgagtttgacacagttaccccagagctgttgtcctttagcatctacctgctgtgcttccgagtcctcagagttagtgcttcaggtctttctatgttcattgtggtcggtccctctcccaccctctcccatgccacatgatgaaggcatcaagccttcataggaagtgcacatcaaactgccagccaaggaggaagctgtggctcggttgcatagtcctggcatggcttctgcagtctgggtttagaaaaccaagagcttaggccaacaggatcccacaggagaaggaagcgaagacctagagcaacagaaatgggtgtgccttcctctctcctggttcatcagtttccacagctggctggagaagtcaagccatgccacaaactgggatatctgccttacacttactggtgttttatggtgatttcaaagaaccatcatgtttctcattcaatgaaaggtttctagttctgtatccagtgttcctcaagaggaggggactgacttttaccgtgacttgttccccgtgtaaatgggataattgcctctggagcatcctcttgaaagaaagacacagaccaatggtcttgggagtcttgtatgtttgctgggccctgaactaaaagctggcccaagttcttactaattaggtgactttacaggaagtcacttatctccttcccttcctggtccttaccaggaaataggaataatcttgtccattctgcttcctctcctggctaatgtgacgtcagccaagatcaggtgtgtgaatgctccctaagccagagtgctgccatcatgcttgtgatttgggtctaaggagtacatccaggagaaggctctggtaggtagagggacttgtgtgtgacagttctgtaaactaatttcccctgatagtctgacacatagcaatgtataaatcagatttctattaaaacatatggcaggtataagatgtgttcagctctagtactcgaggagaccactcagcccttgccccaggcctggtgacctgagtccagtccctgggacttacatggtggaaacagagaactaactcctgccattgttctctgacctccacttgcataccatggacttctaatcctcctgctgcagcctcctcccaggtagctggtattacaggcatgctgccaccatacctggttacttgctgaatagttctttgacacttttcagtggctgcactagtcccgaccagccgcatgccaacttcaagcgcccaggtccttactgaaacctgttcttcgctttagttatatttctcttgttttgataaaacgccataacccgaagcaacttgaggaagaaaggatttatttggcttccacagtacagtccatcgtcaggggaagccaaggtaagaacttgaggcagaaacccggaggcaggaactgaatgaagcagagaccatgatgagacatagcttattggcttgctgggcttgctttttttttttatattacccaggaccacctgcccagtggtgaattggattctcacacatcaaattcaaatgaagaaaataatctccagatttgcctacaagcaatctgattaggcattatcaattgaagctcctcttcccagatgactctagcatgtgtccagttgaccaaatccaactaggacaagagcataaacggtgttttaattgacgcttgttgcctagacagataaatcactaacacaccgacagcttcaacacgttgttctagaaatcatgcacactaccaagtgcactggaaacaaggcaggaaggacgtcactatggaggcttcttaaaggtgacctcagttataggccttagacaagagagaggtgagggagggctggggagggctgtcgttaagtatgcttgacgtacaagtgtgaaaacctgagttcgagtccccaggagcacataaaaaggctgggcacagccatgtggccgtaaccccagagcccgtggccactatacttactctcacaggcaagtgtatgcatgcaatcacacatgcgcacttccacacatcccatgttgaagggatacgtttcagcaggcagagatgcaggagaagccaggtagagcgtgtgtgaaagcaaaggaatgctgaggagaaagcctggaccagaccaagcatgataaagagctggggaaaaatctagaaaggtgcctggagggatcaggttagaatgttgtaggtctgtttaagggacataactttcagccagggatatgtctataatcctagattcttgagagtctcatataagatgatcataaacctgggcaacttactaaaactgtctcaaaataaatttttagagaggctcaggagtgtagctcagtagtagagtgcttgcctgtcacgtgtaagaccttgggctcaatcctcagcaccacaaataataaagattaaaaggcttattttatccagtagtagccatgaagttttctaaccaaaacaacaacaggattgattcctaaagacttctccagacaacacagtgtgttttgttttgttttgtgaataattggcatgcatttagttttacgccaactacagtatagtatctctgagtctgaaacgtcacttccacaagagtgtagaattgtctaacagagagagcactgacaagattcttcccatcggtgaccctggaatcatcaagccttggggttccctgacaggtttgccccactcgctggagttatttgcgcgcagacaccatgttttctgtctcatcagtcccaccaggatctctgcactctagctagcctcactgcctgccagtgctcagcgggctctccccagctctgtccttggccttggctcaccttactgcctcctctatctcagtgcaagtgggcttcactacctgaacccagagggtcttctcctgagttcttgctccacagcagaactcccccgctgcctaaccccattctccctctgtagtcagccttgtcatttgcacctagctctctccatcgtccaagaaacctgtctggattccacggtgcccgttgccatctcacacagccgcatgtttccgctttcctcatttcccactcactcctcagatagttgtagctgtgtcctctgctgattctagtcaccaaaggctagatgcatggagcacgcatacccagttcctctttgtcttgacgctcctctctgactcctgcctgcggtttactctgccttgacgtataactccactctcctccgacttgtctcctgctatcttcttctctacctaccagagccttctcctggatgtactccttagacccaaatcacaagcatgatggcagcactctggcttagggagcattcacacacctgatcttggctgacgtcacattagccaggagaggaagcagaatggacaagattattcctatttcctggtaaggaccaggaagggaaggagataagtgacttcctgtaaagtcacctaattagtaagaacttgggccagcttttagctctgaatacaccttttatatatagctcactccctaaatgttttcttgggggaaacccatctattataatggcgttggcaatcagtatgatggagacaacccaaaactgactgtatctatgactcaggtctatgactaggcaaggacacacactgatatgactgccttctttactggatgtcaacagaaaaaggacaaatctttccacatccctccccccagtccccatggcctggcatagaaaactctagaagcctgggttctgtcatcagctgcttccttcccactgagttcctgctctgctttcatctcctcttccactgtgataccttgagtccaccccttcttcgttccttctgtttccgttcatgttaacaaagtctgtcatctctgtttctgcaggagcctcttagctgctcgctctcctcctcgtagcagccttgccctgatgtgattcattctcccctgcatatctggaacgatcctttgaaacaatatctgattatgttactccctcctttaacatccgtcagtgactccacgtagccttaggataaagtctaaactcaggacagcagacaaggctcttcttaataatggccactgtgtctcaagttctcaatccatgccaggttctgttgtgctctgagagctttatacatatcccatggctccctgatgaaggtcagttactgtcccaattttatcattgagggaactgaggcccacgtgagcgtgtaccttgccaaaggtcatgcagctcgctagcaggttgaggagccaagatttaagccccagaacacctggctcaggacctcactcctgaccaatgtgctaccctgcctcctttgtatgggataatttctcattcattcagaaatatttgttgagtctctgaagtgagtcagaaactgcttgaggcattggaggtgtagcggggaggaaagcagaggctgcctacattctggcgaagactaataaacaagacaaggctcaggagatggctcagtaggcaaagtacctgctgtacagcatccaaacatgaggatctgagtttatatccctagcacccatgacggggaaggcatgagagagaacatgaaggcagagacagattccctaaggttcaccagccagtcaggcgcaggaaagacctcgtctctaaataaggtggagaatgatagtgactgatggaaaaacctgatatctaactgactccacacacagtgaataaccaaccaaacaagacaagcagtggaactgctagaaagagaaattaatggaataattaatgcaagaagagaaggagaagtcagagaatacaggctggctgttttggatggaaagttaagagcttaaaggaagtgagagagtcccaaaggagtcgccagtacaaaggccctgggataggactctgtctggtgtgggcatcagtagaaccaaagcagagggaggcaggcaggaggaggcaggcaggaggaggggtggggtcagagcatgtcaggctgcaatcatttggacgtgaactctgagtgacatagaggagcagtacctttacacatggggcttctctgcagctcttctgagaacagactacagggggacgttgatggaagctgggagacgagtttgggtctatgagagagccaacagtgcctgggacgaggatggaaggaagcaacgggaatgaaggaagctgttggatctgtattcggaataaaggcagagccaacagtatttgccaacagactggaaaggcacgtagcagagagtagaaggttgccttaaagcaaagggaccttggccactgacagcatgggcttggccttctctgagactgggccacgggtgacggtgagtgcttgtctagacgtacattcaagatagatgatgttcaatgaactgtagtgacagcacggagacatcacctcccaccctaccctttcaaaacacacacacacatacacacacacacacacacacacgcatgcacgcacgcatcttgtgtaacaactgtcatactgcttggtttcccaaactacccgcgcctgccaagctgtcaccctgtccttcctttcagaggctaccctggcccggttctaatgcagacttgtaagtgcctctccacatcccccgtttcccagccagactggctatcattccctttgatacccaccccgcccccacccctagcccaaggcacagagcaccatgttagacattggatggatgggctgaggagccagtgaagggaactgtgggtagatggatgctgtgcagttagaccacactgtgttcagctgatgatggtgggaattcccctggaccgctgccaggtgggacgaacactcagctgaactgaaagaaacagcagatgtcaggagtctgagcgctaatcctgccccgtgttgcgaacaccacagtctaagtccccttccctgaatgctggtaccccccacccaagcccagccctggctcctggtttggttcatctctgacagtagtaagcatgttctcttccccttgtacatccaggtgtgtaggggggaattttgattttaaaaccggaagacacatcgaatgcaatgacgtgctgcaagcctgctttccacaggcccctgggtctgccaaaaacgatcaggcctgattatttaggaagctgcctcagccaggcattactaattcggatgcctattcgggcaaatgagcaatgtatcgcaaagtgcttttgtcagtgaattgcaagtgaaggggtggggtcaggggagagtgatagaatgtttgccttttgcctcatttccagaaaggacggacatttcttcctggaagctgcacttggcagcaggcttggggaatgggaaagatttatttcctctgccaaagctcaataattcagcttgagtatttcagatcgatacatttcttgcaaagtttccaaggaccgtgttctttttttaaaaagacatttaaaaaaattatcagtagggcacaattcttcagtgataagactggcggatcaagggtgagtctggtcttccaaaaagacagaagcctaatgagaaaggagaggtgaagggggagagcagggttggggctaacaaggcagtagggtacccgcaggccctgctgctaatcgcctcactggatttgtgggaccgcttcagagagcagctgctgacagagaagctggagactgaatctccttatatctgagactatggcttgtcactgctcctgaggaagagccactcacagaggtcctcaccatcacttaggactgctgaggtgtgccacccacagcccgcatgggtcacattcttgtgaaattttcagatgtctacagctctggcatggaaggacagtgacaggatctacaaggcccttgttgttttagaaattccttatgatgggagagtctatgttcactgaaacaggtcctttgtagtcctgtgtcctgggtctccagtgctgtgtgcctcggagtcttgtgcttgacacacattgcgtctgagtcctgtctacttctcctatccctgtttctcaggatggaggttcctttgctctgggccacacaggtgtgacctcaaacccctcagattagctattatatttcttttgcttactgtcaaaaaaatccagcagtggcctaccaacaggtgaaagaagcttaccttctgtctagtaagactccagagctgtgcagtcctttcacatagaaagtattatgggatagtctgggatgtatgacagcataattctctcaagttcctataagagcacagcgatatggtagcaagacaaaaacccagggacaatacttaaaactcagtaacaaggagtctccaagacggtggataaacctggggacaagaaaaacccaaaataaccaagaagttgtcaccaatcctataagtggcctctgagactcagcaagatgcaggattccctggtgcctgctaactctgtggctggctaccaccttcttccacagtagcagaggagtgacttgggaaagaactccccaaggaacagagagccaagtggtttccgaatgctagctgccatctttgaatagaagagtagctaggtaaagttgaaagtaagtcagttcctaaaaacccagaaagattaacttgggttttaaaggagaaaaaaaagagagagaacggtagaaaagtgagactcaaacacactttataagacagaggaaaatgagaagcaggataatagctcttcataagacaacaggcgttccagagcatcttaaacagttcacagcagccgtctccttccatgtgagcacaaacattatgaaagtagtacaacatgggagggggaagcagggatagtgctaagtcagaggtaggacatgagctggtaagagcacacaagaatggatactgaagaccaggttttgaagagtagtggaaaatgcaaataaggtaaaataagaaggaaacaacaaaaaataactcaagagaaagtgacaaatattgaataaagacaaagacatttcatcatgtgggtaaaaaagatcccgtgcaaagaaactcaaaagcaagcccagtcctgcagaacacttgagtctggacgtggccacacctcctgtcctctgttcccttataaggatacttgacactggacactggagtcgtggtccctgaagaaccctcgtgacctcgtctcaagatccttaagttatgtctgcaaacatgtttctcataaaagttcccatgcacaggctccaggggtcaccgtgtgagggtatctttggggaccgttcagttgttgatagcgtccacgctagtaggtcacagaaacggtggaagtggactttgcattttattttctaagttgactggtggtagttcctagtgttccctaccaagtcagccatacttgttaagaagtaagagtggacggtgggctttgataaacagctgcctggtgagagacctcaccagagcagaggccacaagaaagggctttaactccaggctccaaagacagggatctcctttcagaactcacagtattcttagctataaaataggcatggcagatcgtgcctgtaatttcaggccttgggaggtagaagcaggagggccaggaattcagggtcatccttacccgtagtgagctcaaggccagccaagagaggaatgacaaactccatgtgacagtaggcagacagtgaattcaggtgtctttctttttggtgtcccctgcctttctgccacctagccgcacaaagtataccctgccctctggccactagaaagtccaccttcacactctggggctgccagtattccttgagactcttcttactgccgaacaaaaccaagcatgagttgaatcatgtctcgtgttatcttatcagctccctctcccacaggactcctccagcctttatcacaagctataaatgatgtagaatcccagatgagcaaaccaggagagaaaggtgttccacataacgtggagcgtcccggctcccttctggccccctgagcccaaggggagtgaggcttgtctttctcattttcctaccactgtgtacaagtcttcagccaagggcatcagcagccttcacagctctcatgctgaaggacaaaagctagggaaagaaacgattctctctccagtgtctgtgagtaaagagggaatgggtcagggacagaaaagtcggtctcgtatgcacatgccagaaagtgtaacacgaatgcctttaaatagaagttgctggtccaaacgtgatgttccccacccccaccccccgtgaggcatcagcgtcagcgatgccgttaaaattaccccatcctgcttgtgatgtctgtcttgcggccctcagatgctgagttagcactggctgcctggcctcgcagaggacactcaattccacagcagagggcagccaacctttgaaaacacttggagagagtcactgtcaactagagtcaggaggaggaatagagcgtatgaaaggcatgacgggctggaatgaaattctctctctcgaaaaacacatccaagaaaagccttgaagaattgtaggttcctttgaccccacccctggtacaacctggggtccatgaagttcttgttgaaactcccctttcaaaataaaacatagacacacacacacacacacacacacacacacacacacacacccttcttgtccccgcatgtcaccacctctgggattccgtgatgtcaggcactgtctccatcttgagaagaggcagcttgctgtctctaaattcctaaggataaagagggaagggaaggggcagctgggccgcacaaaggctagcctctctcccatcccactgattggatctctcctggcccatccagaatgaggatgaaggtcactcttgttgcgctctgtaaatgaatgtctgtagatcatagctatagccagacaagagatcatctgtatgtggctcaaatgggcaaaagggaaagagaaactgttcattcactccattccggcagcccctgtcaatcatctctaggatgcagagcccacagatccagatctttgtgctcatgtccccattaaatgtactcatggaacctgttggaaacacacagtgatttctagtcgctagccgtcttatttttcttttctgtcctacagttggactcattgttggcataagtattgataaagttggtaaattaaaacatatcttctcccaaattcaggaaactctgtcctttttgcctcttggcttttgaagctcctctctctgtgatatctcttcattcctagtcacactaacacagtgttcatagactaagataagatgatgatgaatctttactaatatgcataccaagtttcagtgtgttagcaaggtcttctaacattcccggggaagggccactctcctccacccctgccaatgtctgctgccaagtgcctcccttattttatcttgccctgatatctatgtgaaaagtaggcaagctttctaattctatattctattttcctcccctaaatttgagatagtatgtgtatttctctttcaaatctagtttgctgttacattctatcacaagtcatcagttagaatcatttgtatacaagatgcttaaaagcactaaattgattttccagtatccaccaatcaactccagtggtccacagacattgaaagggtgggcactggtggtccctgtgtgtgcctttcaaagaaaggataatggctgaccctgagttcacctacagatctttaactccaaaagcccaggagatggatggaattgctcaggttagtccccattctctgaggttagcatggagcctcctcaccatgtctgttttggaagactgacttgaaacattggtgttgagtttgctttgatttttaaaacacattgtcccattatgtctgtagaacatgcattccagaacacatgctgacacccagctaggactctcaagtcccttttgtaatggaatagtgtttgccggccatatactttaaatcactagattgcttacaaaaacctaaggctatgggcaatcttcttatatcattactctgtatagcttacagaataaagacaagataaattgtgaaagtccagtacgattaatgcacttgctttgttgttatttgggggtggttttatatattatatattctacatatatattatactgatatatgcataatataattttattatgtatatgaaatatatgcgtacataataactctatatgatatatatgttggttgaattgtacatgtggagcctattggtatctgttgtactaaactataagtttaattactgaatttaaaaaagaagcctttttgtttcccactctgttgcctggacctcctttctctgcccttctactgcctgctcttgacagtctcagtatctccaggggagatgctgtcccggggcctgcccatctttttcttccctccttcagggcgtctcagagcttacagaactgttgctttagcttcctgggctccagaaagctgctgaatacattgttgtctcctatagatccatgtcaaagcttgggcactcaattgccaagtctgtgtcctgcaaaacccctaaaatacgcagagtattcgctaaatactggaattattgtgtgtcatacttgaatttgtgttagtaagtagaatgacatgttaaatataattttattaatttctagagaattttacacatgcatacaatgtattttgattatattcattcccctccaactcccccaacacccaccctttgctgacatagcttccagttctcttggttctaggctcattgtaaccttgggacatctctacacagactgtaatattctaccagagtctaatttggtgaacaaatgagtttggggagattatatgtttatgaatatcttaacttcatttctactgcagtgataacataccctgaccaaaagccccatgggggagggaagggtttattttactcacaaatccaaattatagtctgccattttgggtaagtcagagcaggaacaaaagcagccagccacatcacagctatcgtcaagcccaaagaaagaataaacatacccttgcatgcttgtcctcggaaagcattctcccctctcatgctggttaggactctgcctatggaatggcgctgcccgtagtgactggatcttcctacctcaacaatcaagacaactcccagtcgggtgtggtggcgcacacctttaatcccagtactcgggaggtagaggaaggcagatttctaagttcgaggccagcctggtttacaaagtgagttccaggacagccagggttacacagagaaaccctgtgtcaaaaaaccaaaaaaaaaagacaactccctaactgatccctaaccaaactgatctacataattccttatgaagactctttttcaggtgatttttatattatgtaaagctgacatttaatacaaaccagcacaaagggtaagagttacttataggagcagagatgactctccatcatggaaaagcccagcccagtttcactgataacttaccaaagctgcagccctagaacttggaatatgacttgtaggcagttcagcggctcggagagtctttttcctctccagtagtttagtttacttgtagcgtgggacctgagatccttattgatttcaggaacttcctgagattgtttacttcctaaggctcatgggcctcccccctcatttctggaaagaatgttttatttcagaagttgctacacaatagggtagccagcccagaggtgagtcatctagcaataggatcttgagttgtatgccagggccttagtgaaggtggacctcttgtgttctgagtgctatgtaaacaccactgagaagtgtcacatacacacacacacacacacacacacacacacacacacacacacaccattacatgtatgtacattttactcttagcacatgtaccggatagttggaagttttatctttccaaaggtagaagagaccgagggaggctctgtcctttgatgcaagtctgacagaaattggctggcaaagtagaagtgatggggacttctgctggggatggaagcatgaacttagaatcacggatataagacaaactagaggtattttcttgatgtaactagaaacttttaaacttcagagagaaactccctagaaccccctgaatcaaaatgctacaacacagctcaggaaaactggagtgcactcaaaactgagactctgacttagtagttgcacatggctaacagatgctaaaaggatgggaaaacaaaacccaaatcatcagatacagctgtagagggaatggtccctactgagcgcaacttttcttttttattttctttcttttctttcctttccttttctctttttgtatcgaataaagctcaggctagccatgaacttctcattcttctgtcttcacctcctgcatactaggatccaggactgaaccacctcaaccagcttctaaacttctacagaacattacatcttatgtagatgtaataacgccactggagcatgctggtgcacgcctgtaatcctagctgctcgggaggctgtagcaggaagatttggagttcaaaaccagcctgagcaatttagtaggactgtgccctattcagagaataatacttaatacaaaaagtaaaagagacagtaaatgtcacctataattctactactaagtgacagttgctattaatatttctataaaacatctgtgcattatttgagagtctgtgagtatatacactattctagttttccgtatgaatgtgtattctttctgaatactgttatcaattgcatcactttatcacaaatgttgtcagtaaatgactgctctctttttaatgttctgttttctactattaaaaataacacttgatattaaaaaaactaacatctttgtgcatgaatttttctgcattcatagccatttctctaaggtagattctcagaagttgacattcatcaagctcttaaaatatcaccgagttgtgtgccagcatggtatgccagcttctcctccgcaatcttgtataggtctaatgagctccgacttttaaaaagccgtgtagtgggtaataaaacaagtctctgaaaagaaaaacaatcaagaagaaatgacataggtataaaatattaagacaaggtgagcggcaggtaacttcagacagcaatggacaaagttggggactttgggaaaaacctgttactggcctgctacgacttacatggtaacagcaacacaggcaaagagaaaacagtattattgacccctgacccttccctctcatccatccagggggatgaccatcattcagagcattcaagatgggtaggctcgttgggagaaaagcagagttctatgcagagcagactcatgtcaagccagagaactctacagaaagatcagttatcccaacagttttccttgaagcagtgggaagaggaagagacacaagccgagctgatctgacatgaggagtagatggggaggaaaagtgtgtacacaaaccaaaacagtgaggctggttgggaccctgagtaccgttcaggacagactgtcagacctgtgtgaacactcaggagcaagttatccccatggggccagacaccagtcctcagtaaagttgctgaaagttttatactcgctatatttctgagctttggaaaagcattccatcttattgatgagtgtgtagatgggttaatagctaagaaattaattggagggggcctagtgtgtcaccagatgctagcttctcaggcctcacctggttggcgctttcactgacccatgggatgatggatgcccatcaaagctttgtaatagggatgatagtagaaagagatccttatctgggtggcgtgcagcacgcaagagtgatgaaattgacattcttacagtgggattattcctaataccaggtttctatgtgcaagcaaaggtgtcaccattaatgtcagcatagaacacaggggcgagttcttaggaaatgctttctcagtaccaagcattggtttttcatgttgctaaaaaagttataaacatgccatatgtgactctggtgctttgcagctggaaaattttccatgtttttcagtcaggccaaatagagacagagaggctaagtaacttgcacaaggtcacacaggtagaaaatacaagttccacactggtgctgagagctacaacatcaccatgcaagttttattaaattgttaatgtacctttctcttctaccaaagtacgaaacggtcgcatagagagaggcaggtgtgtataataattgtgagctttggttgtatcagatcagaccacttggttccattttctgactatgtgactttatccagtcactgaacttctctgtgctgcactgctcattattgtcttagggggttaagagaattatggggatggcatatatacagcgtctcctgacctgcagtaagtgcttgtgtttgctgctattattaatctatttgagaattagtattgcagatgtggaatccctaagtggatgaaggagccaacagcacaagcattacctcttccagttctgtgggccggaatgatctcacctgttagagcaagagccatagtcatcattgtgatttggtttgatttaagtgttcactgcctgtccgcctcattgccctggcagggaaaagcttgagtcatgctcctatgttgtcagatagtacagatagtacgggacagagatgcggagagatctgcaaactgtagatacgggctgcttgttttaaggcaggatagccaagcaatcaaggaactagtcactagacatgactgggtcaagggtcataaagttgctgtcattgagtcaggagatgaggtcacatggatctctggtgtaggttgaccaggcgtggtatggcttagcttttccaggccttggtttcctaataagttatggggaccagggttgaatcagagcattgctgtggcgtctgcctctcacattctggactctgccttccagtgcatggggtccagagcaagttcttgtaaatatgaagagtttaacatggaaggatattttcaccaatggctaaagtgttgagaagccttgagttgggagttagggtttggctcagtaatagaacacttgaatttgtatgagttccagtgcaaacaccacacacacacacacacacacacacacacacgcacaaattaaaggaacttgagcataataatgctcaaacaatgtctaccaactcagatcattcaatttcaattaaactgaaatgagaacccagccaactgcagggctcctgtgagttaggagacacacaaaaagcagttaagggcttttttaaaggggcaagctgttaggtttagcattgccatggctggctgacaactttgcaaagaattagaacataacactaatctcccttccatgactcagaagagccttcgaaaagctacagaatcttaagatcttgatcacgagtgtggagtagttttatagcaaaagaaatagcatcctggctgtctgtattgtttggtagttgaggttcaaattcagtagtgcgtgctggctatgttaagccatgcaggaacttgttgatcacatactcttcagccccatattttacagatggagccattgagcaacagagaaatgaagtgggttgcctagaatcccacgctcattagcagcttatgtaggaaggaaatcccggcccctgactcctggtcagctttctcattagtttatgcataactcagaaagttgggcatgaggttaggatgacctgatgaatgtggtggccaatttgaacgtggaattgaagaaattatgagaatttaagagtctggatgtatcactgaaggttatgtgtgagcccatgaacttgatctcgcctctgaggaaagaagggagtgggggtcttagtgattttctcattcatagcaattcagttcctccatacaaaattctcgccgtgatgaacgctggtcatagttaaatggttctcgtgacacattggcacacagaggctaataatatcataaggagctctctctgtctccctcccatctccccctctctcccttcctctcttcccatccttctcttcttcctaatcattaacatatatattctttctttgttgagtcaaattgccagaactgacaacgaaacaaatcctacacatccctcccctctcagcagccttggacccacccacagctgggagttgggcagagagtcaagagcaagtgtcgctgagcagcctgtgaaagcagcgctttcttcccagacacatgcaaagtatcgttccacctgcccctccctcctcttcctagccataaatctgtctccctgagatctgcagattttttttcctatcttcaatctgctgataacttgcctgggccaaggatctcagtgttgggtgggaaggagttggtttcctccgtctttttgaaagccagtcttaattctgagtgtggatggaaagtgcctgggtaagaaaacagaatctggcatcggattgcctggattcagatctcagctctacttgttgctctcaccgtacaagtgtggggtacttccctgggacgcatcaggtctcctccatcttctaacgtgcacttccatctcaaatgttatacgagcatgcagttaaatgaactgatgcttctgaaatgctctgaacagcactaagtgcagagaagtgcttcataaatgactgtttagtcaattaaattatctccatcacctcagcgttacctccaggtacctgctctgttccattcctcaacataggggctttagggcccttgaaggaagtaggctctttttttctcagttagaattccaaagcatatgctatgtcccagcccttttacaccgttgaattaaaaaagaaatagctgagggatttgacatgcagcacccgcaatgtagccagcctctctctggctcagtgagctgcccaccttctccataggctaatggaagtgcagtcaagctgatcgatttactgagtgtcctggagcaggtagcttgcagcgtcagggtcactgttggttagctgccaagtgctctctgtaacctgccgcccagctgtacacgtgccgggagcctccttgtgggctcctggtaagggggtttccacggtgctgtggccttggttgcttcaaggctgagctgtgggagagattaatgggaagtgagaagagaaactgttattcttacccagcagtgttgttgggagtgtgtgactcttcttgtatttagggaaaagattactcatgacggttttcttccatcgaacataaagaacctcaaattactgtttgtgtcccccgcccccttgtcacccacctctctgctttagtttgtcctcggtagaaacgtcagcatttaactttctaactttcgtttcccctcttaggcaggcttcagttctgtatttactttgacacctcagcaagctggccccatccacttacttccctgcgttacccagaagctctctgctcaagccctctggccactaggtgctttcctgtggccagccggattggaacctctacccatccttgatagaatcatcctcccacttacccagtaacatcttaaatcacaatttggtatgctgttcttgtccaagtggacactgttgagagtaggaaatagccgaaggtcttcccaggatagcctgccaccattcacactccactaggaacaggcaggcactttctgtgtccataaaccattttgaatgggcattgccagtaacaacccaaacatagaacctcaaatcctttagtggtccagttcccttctaaaggttataaagtggtcacatactacagtcacttgtttgattatgtatgaaaaagacattgccattagatgtaaaacaggaaaacacactcaaatgcttagggtttgaattggcttggttggttttggtttcatggaagtgaggttgaacttgggacctcacgtatgctaccactgagcaatatcatcaggcctcatttgacttgagatggcatctcactaggttgccaggctggcctggaactcactacgtagcccaggaggcccatgcattaccttgcattattgtcgaagtagctgtgttatctacctggcccagccaattaactggctgtgaggaatcttccttggacttagaagaaactgacttcggctcttcaaaaccgttttctgcactagagcctgttagaaggctctgcaatcatgttcacagcctggcgtggtctccctgggatctgagccaatcgtttcccccctctcagcagcctatcctggtgatcatatagttcaaaaagcagtttcttccagaattgagctgaagagcacatttgaaagacatgtaccacatatcctccaaagttcaagtagttcacctgcagagactgaagccccagtgtgcaaacactggtctcacggagctctctctctgaactcttgattctgtgacttccgaggataaaacctgacagactccctgtcaggattcaagttgtaaataatcatcaaagactgccctcctcccaaagagcttttgctcatagctacgtgcaacaacttataacaatactgagcatactataaaggacttttaaaagtatttgctaacttattgacaaaccagccaagcatatattaatatattatctaaagtatatttttcaaaagacatgtgcaaacaacagttctatatgcttctacaaacctcttcaatatccaggttaatagaagatgcctggattcacatctctgtttctgtattccgagtgttgtgatagcacaggtctgtaacttctagaacattctgtatgtgctcatgaaagaataagagtaaaagaaaaaaatgttactattgttatcaaagagtctttgctgtagataacatgcaaaggtcttgggaactctctgggtcccatgatcacactttgagaacaattgtcctaatcacttgaaggatgtatcagaattgcccacagcaccaaagttaaataaacatacagacgacctgcctcttagagtcccagcctgagccactgtgtggcccactttgagtccatctgcaagacagataggaaggaaaggactttgtgtgttaccctggccttgcctttgccagaggctagcctgccacttcccagaggctgagtaaatgtctcttcctggaaaaagtttcaagaccttcatcatttggcagctctggggagggacaaggtcagctctggaacactcccatttcaaagctctgagtctccagctaaatgcattgagacttgtcatgcttccaggcctccttgcataccaccccaccccccaccccccagggccacttttgagccaacctgaaagtaatacagcctcagacctatcgtcccctgaaacacatggaaagggggttcccctcactttacctctaagtaaaaagttcatgtgactccacacttaagtacttacaaacctggccgggccttgggactcaacccaagcgctcttgagacagagagactccgttctgttaattattctgcgacctttccccctttgttccaactgtgcagctgacaagatcttttctctctgtcctgtgttgtccaacaggtttgcagccgatttactggagcagagatgacgtagcccagtggctcaagtgggcagaaaatgagttttctttaaggcccattgagagcaacaagttcgaaatgaatggcaaggccctcctgctgctgaccaaagaggatttccgctaccgatctcctcattcaggtaaaagagtctggttcttgcagaggctcagcatggaacgatagctgatcttttccagactcatcataacccatgggaccctccccagaagttctcctaggaacactgacatcataaaaaagggaggtctataggcattggccagtgtgtgggaaagacgaagttttcaagtcaaagagactgttaatttagaagtcactcacctgtgcccagacactggaactttaaggggtctagtgtccaatcaataacaaatgacagtagtcgaataagaaagaaaagagtttgggcattgccagtactttgacagaatcattttatctagtccttgagctgttaaatagttgccccattaaatggatccaggctgattgaaatgcagagacacgtttgattactagacacggaaggaccaattaataaaggtgaacagatatgtttcactttgtattcactcttaataatttagagttattgcacgcatagcattcaggtagaatagatttacatgtccattattttatatgaacaaaatcactcaattcattatcaacttaattcatattatgctcgctagacaataaaaagaaactcactttcaaggttcctttaattcagttaagaatacattagcaaaccaggcatcgtggtgtacacctgtaatcctagcgctcagaagcctgaggcagggcgatcatgagtagttcactgaactacgtcttgagaccctgtctccaaaacaaaagtgtgtatgtacacgagtgtgtgtgcgtgcctctgtgtgtgtgtgtgtgtgtgtgtgtgtgtgtgtgtgtgtgtgtgtgtgtgtgtgtgtgtataagagagagagagagagagagagagagagagagagagagagagaacgtgtgcatgtaatttcttagatatacttgaaatcgcggtttttgatgttccagtatgcttttgtaaataatttcgacgatttccaacttaacactgtccttatctttagaagaacgcttttcttacatttgtccagtttagaaaagtttcatttcaaagtgggactgagaattccctgcactaagctcctcagatcagccacctaaatagaaggtggcttgcaagaccgaacggctgtgttgtagaattaagtcagagaatcccagaatacaaaccacaaaggacaacaactgcatggccttgaccaaagacatgaacacttggctctttcttatcttactgtgtctttgaacaaggagtgaaaactgtgttagagagatgtttagggaagtcactcaggggaaaaatgttagctccccagctgatacatgaaggtagtgctggcgtcgggtccttctgtcctgcagagagatgtataatagtgtgcagcgcagttgatgctttctttaataaactgcatgtgcccttaatggtatttctgttttctcacaagcttatcatataccttactttatattctgctttcagctgaaagtaattatcttattatatgtgttttctgattggttctcaaatacagcgttagtatatttctacaaactgcaccccaccccccaggatctctgtacttaagtcacaaatatgaagctaaaatgcatttactcctttttaagtaaaagaatgttcttttctcattattttaagactcagaggaaatcttttgacttcattttcaccttccccaatgtgtgcagttatcagcacaaacacgtacactgggaagcagaggccacttgtgaaggtggagcccagttaggtgaggcaggtcactgaaaaggattactcttccccgtaacaaatgaaaactttgtaactaagtttagctaccagaatagattaaatagaactagagcctagcaaagttcaaaactcacattgtcccatcacaagagtaggcatttaggagccaccctccagggctgtttgcactactgaattcacagtggaactccacagaggtgagctgcagtctccatttttaaaattaatttatttatttattcactttgcaacccaatatcagcccttctttttttcccagtaccccttcacacaagtcctcccccgattccacattctcatcatttgagaaggggaagcccctgtctaggtgtcatgccctactcagggtgtcacacacacccccataaggagctcgcacacacaagtgtgcacacatacacacacggccagactaggtgcatcctctcccactaaggccagacaaggtggtccctttagggactcaggatctacaggaagacaggtaacaggctcagggacagccgtgatccagttgttgggcaaccacatgaagaccaagcggctcatctgctgtatatgtgcaagcgacctagctatggcctgtggttggtgatttagtctctggactctcccaagggtcctggttagttgactctgctggtcaccctgtggaatcgctatccactttgggtccctcaatccttctctagactctcccataagactccccgagctccatctaatgtttggctgtgagactctgcatctctttccatctctactgctgggcggaggcagactccattcttaaaccatccacaagcagaaaggacccagcaaagggagtttctgacaagcctaaaacgtatgcctcccacaccaggcctgcttttacttatttcattttctctatttcataattggtcaaaaggaaaccaaaatttctaagtcaaaatgaaatagaaacaagaagtgtttgcgaactgaggggtatgctgccggagatgactatccgtttgccaagagtatgggcatagcgaatcatcgcctgcaaggtacacacttcaccagtgttaaggttccacgctccgcccactagcccagagaaacggcaagctcaggggagactctcaagtagccgatggcacttacgtagtggccatccagtcccagccttgtgatcaccagcagcatataatgagagcttccgaactaatcacagcctttcaccagtaattccattcctaagaaaatatcccaaggaaattatcccatagtggacaaagaaaatgtccttttgtgcttctatttataacagtaaaaaccagaaatagcccaaccacccccaatatagctagacaaccttaaaaatggtcaatataacgggatactccttagcttaacacctaactccgtttgttcctttgtttattatttcttcatcacgtcattcagtgccttgcagatcctctttaggatcagaagcagaggatgggcaaggaacagatgtcgggcagtctggctagagccttggaacaatgaaaatgattagaaccaaggaagggccaacagagagaagggacaatcccaacagtaaagtgggcagagcccccaggcttggtggctgattccatgttaggtgaaagggaaggaagatgggagaattaactccaggtttctgacctgattagataactgagctagggaaccccttctggtttgtaaagatttctgtgttggacactttatctgtaaatcattcacgaggtctcggttttgggagtcagaaggcatcgtgactggaaccgatcaggctgacgacaagcggagtcttgggaagaggtgcagtgctccaagaggaactggtgaagatgctggaaacgtcagtattaaagggctggagaaggaagaaagccacaggagtagtcttctgagccaggaagcatcctagggtgggggcagggttggcaggggagccacttaagattcctggcagcataggctgctaaggtggcgctgttccctaagaaccatggctgccctttgagttaacaccagggaggggacctcagcaagagcagtttaaggaaggcttcagagggaaaaccagaaagcaaagtgaaggagtagagatgacagaattgacagctcctggggctggttagctgacagatgaggaaagagctggtcctgacctggtaggggagataaggactgaaggatgaggggggagtacaggaacccctgaagctgcttgtatactgaaggatagaaacccaaagattttgagatgagactgcacggaagggagggttttagagagacccaattatgaactagaggtttctatatgaaattatgtcagtggaaggacaaggaaacttgcacacacaaaagtaacattaatgaaactgtgtgggggctttaacgcagaaatattgacgctgagaaaatatgacttgtctgttaataaaagtcatgcccacaagatggccatccatccagtgtgtattctgtgaggccagggttaggtaccatcccctctgtctcaccagctctgtggcattattctcatgttgcacaaaagcgagctgaactgatagtgttttaaaccaagactcataaggggtgaagtaatttgccctatcgcatgatgctgatgggagatgaacctggcatcggattgggctggccttgctctatatcccaaagtcctttcgctaagagtaagatcaatcattttcagcacctgaccccttcaagtagcatccctgggttcttcaccttcaggaaactgttagcctggcatttttcactttctcttctgtttgttttaaacaaccaacccatccctgactgaggatttaacctagcgcatccggagccaagctccatccccacccctacccaccagtcccaccccagcatggacagggtcatgctgagttatcctggcaggtcttgagtttgcaacctttacctcggttttcggaggtgtgtagtgggcattagcaggcccagcttttaaaggaaattccaaataaaataataaaattggtgtctgacgagtggccgcagtagctccggtgttgtgttagctggagatctgaactgccaccttttcaacactcagttcaaaagttgagcatagctgtatctgcctgcaaccccagcaatgcgagccggtgacagcgatgtaccaagaattcactagccacctagcatagccaaaatggcgagcttccggttcactgacagaccccgacccagacggtaaggcgaaggtgatggaagacacctggtgcagtcaggtgtacacaccccgacaacccacacacacacacaaagaggggaacacaagcagacattcagattttcaaaattcatgtcaaaagacaggattcaagctgttttgagtttcgctgtgtatatgtggacccaggataatataaaagtgttagggcataaaactggagggtacagacattttcagttcccagcactccttccagggaggagcataagggaagcccccagcttcatagtaaatcatctgcagcacgaatggatctgggccttgcatagaaacacgcgcattggcagctggaccagctgttgactctgagtgcagagacctgggttccactgcctaccactgtagaagtgccagctgtgaccagttattcctttcctgagtctgagattcacaaagttgggcacacagttctatgggtcaacctttgttttcagtaggcgaatggagaacttactgtaaataccctctgcgttccaaagatctcttccttactgttaactttacgtctgtgatgcagagttgaaggtttttaatacaggcttaggcttattcaaaagggttaagagaggtgcagggaagaaagtaaacaatgcccaagagcaaggatgtgggattctcaaagaaaagtcacagaaagcaggatgtacccaagtgtgcacagattcttcaagggagagttgccagtgttacatatgatatcctgcgctggcatgatggttcagtgggtaaagactcttgcttccaagcctgtcactctgagtttgatcccagacacacgtggagggaggagagaactggcttccacaagttgtcctctgaataccacatgtgtgctttgctttgtgtctcttctgtaggcgcaaacccacaagcacacacacacacacacacacacacacacacacgataatattaattaagaaaaggtaaatgagattgtctacacactggagaatttaaggaatccatccacagagcatgtaagtgttaaaggagcaaagggtagtagtggctgtggagggaggtgcggggccacccttgcctatttaggaagttgtaggcaagacatgtttttgaacactctggaaactacaaccagggtataggaatttcaagaaggccatattccaactcaacacaactttctaccaagtagaatcatcaagaaaaatggttttcttatgccagggctggctgcccatcataggacttacacagccaaggctttttcttggcaggggaaggggagagaggggactcctagagagcagaagtttaggccaatctcagacatttctagaattctctttaaggcctaagactccaggctcttacaggtacttcgttattgacagtccaaacacagagcatgtatggcacactgcctcttccgtagtgcttagccagccacttcctctgtgcaggctcctggttgctgcagacccaggcctgattcagctgtgcccacactcagggtcaaagttaagtgtgcctggcagagctagaactcaggctcccacagctcccagccatcaccacgaaaggcattggcatggtaatctaactgctgcttatggaatagggttcaagtaagcagccagcagagcctgctgatgcgcatgcatccctcttctttcttctgtgggaaggtctctctgcacagccccttcccctgccagctgctggaagcaaggttaaagcatcgtgaaggcagagctcatgccagcagtgctggggttagctcagtgtgggaggatgaggggcccaggcagagtggccatggaccaccttccctttcctcaagtgggaatgaagaacccagactttcctcctcagttctccacccaagacctgagtggcctgggccactcaaatgacctcagtagtcagaatggtatcggaacagggcgggtgccactgaagcagtgctggggagctcttcctggcaagcctgtgctggtctcattgtgcggattacctcaaaggacatgtttaaggaggtatctgtcatacccaagagcgtcagcaactacagagaaatgaaaactccaggggccagcaagatggccctgcaggtaaataaatgtgtggaccatgcaagcctggtgacccaggagaaggtgcaaggacagaacctactctacaaggttacctacccgttgacctccacacccgcactgtgtgtgacaggcacatgctcgcacaggcgcgcgcacacacacggtaacagtaagtaacttcttttgaagaaatgagaactcagacatgaaagtggcttcttcctcctagcccttgttttaggtcttctttccggcctgaggaggtgtggggacaccagctcttttccgggtgctgatcttcagtatcctcgttgaacttctatgatgagcgggagaggtggggcggtacagtctgcgtcttatagagaaacccaggagcttgctcaaggtgacctggtccctaggctggcagtgtctgcagtctgtgcccctcactgagggaatagcgctgaacactcttcgcagtcactaaatttacatttcctggcctccccttccaaaatggatacactaattgcagccttattttttttaatagtaatcatcaagaacacatttctttaatgtttgcattttctattctgcataatgccaaaataaaacattgatcagatctacaagctcaaacccagtatggccatgtaaattaggaagggttaggaagacattacactaaatgcgaagaaaaaaagtgttgattagggacttatttttgtatgagattaaaatgtgaatcattaaaatagggactgtattttgggttccgcattcccttcacatcggagccagagcgatgggtggcttatggtttggagcactaaaaccctatccagctctggatcctggcactccggtacaagctctgccttcccacagcatttccaaaaagtgtggtcagaactcctctgtgaccttcctgtccagttttcaggaaaccccctagagactggtgccctagtcttcatttgatcctaatcataaatagcagcagctagctataccaccagcaaccaaacttcagaaatagcgggacagagtgagcagcagctagctgggaaagttccttagggggtcttagggtgggtacttggaagtctgtaaccaaccacagcacttgatttgttacgggggtgggggagtggtagtagatgggtttgcagggagaaacctcctgtgaagtgtttctgcagttcatgctcaatttggaagaaaaaaagtagcaacagctacagcccaaaatatacagttaaattaagttgttaattgaagtgtctttaaaaatggctaataccagagacaaaggctcattgtttggtacagttgttgactacatctctctgtgtgaggaagggtgtagggaggacagtgagagcgctgtggtgtttttaaacattaatcacccatccttagaattccgaagcacaccccccacccctatcccccacgcattgtgaacttgtatcaaagccagagagaggtggagccatttcttgctagaattagttaggttggtggtggtaggtgtttttgatttttgttttttctgctaatgacctacatgggaagacacttaacataccaagtgtgcagtagcccaccattgtgcaacagacagcatcttgagataatttttgtaaagcttgtaagaccttggagtgatgcttagatgtatatttaaagaaggatggaccccagactataccagttctttatagagagggatcacgaattaacaggtttggcctacactactgacccccaacttccaaccccagctttgtgtaaactagaaagatgtgttctccccctaagaaaatctgtgcttgcttgagataagatcttgctatgtagcacaggctggcttcaaatttcccatcctcaactcctatcacaatatctagattatgtgaggttaaaaaaaaatgttatcaagaattggtgatccaagagcatcaataaatagaaaaatgaaaaaaaaaaaaagaattggtgagccattttgtacatttaaaatttggctaccaaaagatgtcattttctttgaataattcagaagtataggcagggcaagtgagagagaggagagggacaaagagagaaagagacagagagtcacagagagagatgttaaaagggtattttcacaaaaataagacattgcgacggtttaaatttcgcccatggtctctctatcatcaaactacactatcactacagcaacataaaaagtcagtaatgtggggctattttcaaaacctcatggaatcattgacccattgcttgtagcgagctgatccatgaatcccagctgatctctggaatatttacagtgttaacccatctgttgtttagatgcttttatttcggctgagtgagtttattaacaatgtaaaacaattcatattgtttagagaggaggagacaagtaagatggctcgttggatatagaagaaagtgtcgcacaagcctggcagcttgttgattccaggaacccatataaagtagatagaattggctccacaaagctatcctctgacccacacaagcatgctgtacgagcacgcgcgcgcgcgcgcacacacacacacacacacacacacatacacacaccattttatcttaagtgctgggaactgaacccagaacctctgtaagaacaaccagcgctcttaaccactgaaccatctttccagtcccaaaactcttttatgttgctttttttacttttacttttcgttgccgtcgtcgttgttgttggagacagggtctcaggtagcctaggctctccccagaatgagctttccgaaggctgagatctcaggtttgcagcacagtggactgctcttattgttagcatgtagaaacaacttggttgatatctgatgaacccatgaaagctgtataaagcatataatttgatcagtttggagataactatatatccatgagaacaccactgtaataaacgccaaatccatatccactgcctcaaattttccttgtcctctttattattataattgttactaatttagttatgagtacatttgtcccaacgtctcctcacttagcaagctctaagtgcactgtccagcatcacgacttgacagcatcatcttctgacctctgcaaactcccatatatgcacatggcccacacgcacctaaatcaaacttaaactaaatcttaaaataagaacttttaaaaaaccacacagccctgacatgtagagtcatacataggaataggcgctgtgtcctatccctgtcaaaggtcaacaatccgttctgttagttaacacagttaacgtagctgttaagcaacgcatcccacctcttcacttcttgttcctttttctctccaggcgatgtgctctatgaactccttcagcatatcctgaagcagaggaaatctcgaatgctcttctcaccattcttcccccctggggattctatccacaccaagccagaggtcctcctgcatcagaaccatgacgaaggtactggaaagagacttctctttgcttgcttgaggtgtagacaaagcaaggggctgaatagttcacttgatatgctgtttttattgctggtaaattcattcttcatttggaaacgtggcctgggtgcccacagcatgcctgcactgggggagttgcctggcggagctcccggatgctccgaggaaacactgattacagtacgcacacagggggcatgatgggaggggagatgacacccaggtacaggtagcaggtccaacttcatcaaaggaggagactctggaggaatccttgaaggttcttgtagacaacaaaagcgttccagttcagcagggtaaggccttagaatagaaggcggtaagatgacttaattggtgagtctgttcattataaaaactttcgaatatatagactccatatagaatcaaataaataaagttgtgtgagccatgtcccaccctgcttcagcaaggataagcttttcccactgtatagctgatccaagttggtctgaagctggagtgtgaagaattgagattctgtgacaacgaagataggtaaccgggagctatctgaccaaaatgtccataagagctggtggaaggagaaaacccaatgtgggggaaattggtgctgggtaggggctttctccatcatttcaccaaaggccatttgctggcgcgagctccatagcaagctttctgtcatagttactgtttctcttgggactcacgggagccagaacaacatcagtagatagctcagggccatgaagttctggtcgagtacagaagcaggtgttggttgagtgcagggctataaaatgtgactttgtgcacagtgccactgaacagctgggtgtgcaatagcctttggatcgagtcatatctcccagggccagcaagtcctcatcctcccagcccagcaggcagccagcgttgcagatgtgcaaacactgcagtgtgggacttttctaaacttattttccttaaagccaatcgcaaggccctgttccttgggaagttttgacttgtgaatcgtcctcaaacacagggcttttctgttgcagtcatacaatttaagagcttgtgtttggtgctctcttaattagcagttttttaaaagaaagcctgactgcaggtgaccccaaggcctccttgtctctcaggcagtcctctctagcgtatgagatagagaataatgccagtgtttttggcagactccctgactctcatcctctcctctcccccagtaaccccagttaaatttagcatctgccccctcccatcaatttgtgtttgatgttcctctgctcttctggcctcgctcatttccagcttgcataatagccaagagccactccagagaagaggtgagctcactgaagcttgacagtaagacagacattgtgttatcagcctgactctacagacataccaattatgggatgggttccccctacccccctcctccttcctcttaatatttaaaaatattttttcatttggaatttttgtctctattttctttctgaatgtggtcgaaggtatgtgactccttccttgttggtctgatttaatatggaagtaggtatgtgtgagttgttcttctgttcagaggttaatccttcataaagaaagctgactgcctctgagagcttccctcaaagcaaggaggtggaagtgggtcccattgtgcactctaaagagctttgcacacatgcgctgtgatgtccgtggtgagctcagtcactatgagaacagagctaaggaggccaaggtcgagggcttcctcaccctgcagatcaggtagattcacttcagagccagctcttaaaaataccaagtgtatccactgaggccatctttgatgccagaggtcaagaagcaagatctgagagcctcttccctcccctgcccctgttgggatgtcgtgcccagctaagatgaacagtcgacaccatctctaccaggtggtgtcaacagaaagccacgtaagacacagaggtgacaggaggaagctacctcctgtctcatactttctgaatggctgctcgccttcccctccttcagcctctttcattccttctcaaaaaaaaaaaaagaaaaagaaaaaagaaaaagaaaaaaatgaagtttagcatgtggtgtctcatgaaaacactgctgtttgtgaagacaatagctcggttaaggtcaggtgaggatatagagatacgtgctaaaaatatggagagatcaagcccaaaggaaaaatttctattagatgaaactatgcagaccaaattttattcacggttaaggatacacagaactatattgacccaaactacttacattgttactgacttggcttcagtgtgtgtttatgagttaaagctgagtgtctcttatcaaaattcttgggaccagaaggggtttgcatttcaggcgttacaatatttacatactacacacaaacacgcgcatacgatatgtcagaatgggaccgaaaactagccatgagattcatttgttttatatataccttatatacatgatctggagatgatagtaggttggtgggtatatagaagaagggaggcagtggaacccatgatgctggcacatgcacaagacccagaaggcaaaactggtcttcagaaaatgtggaccagcaaatggtcgtaaaggacagctagcttgttagatgtgattgtggtggcagcttaagtctctggtttccaaagtcagccgccttaatatcccatggagatgaaagtatctcagattgccactcttgccaaagaaaggccctgtccccaagatgtacatgcacttgacactggtcccctaaaagctccttaagtaagctgccagtctgggctgaaatccaagtggggctggctctgcagagtgacctctataggcgagttcagacgtagtcttgtaaggagaaagaaggagatctctgtttctctgatgctctccccatacacctgccccctctcagttaaattcttcagtttcactctttcctgaggtagtgagaggtagtcatttttaatcccacctttggacacatacctgctcccctctcccttccacaccccccccaatgcacacacgcactgatgagtgtttctgtggtggttggtgaagtgtttccctccccctcccccgctctcatgcacacacacacacacacattgattgatgagtgttgtttttgtggtggtttggtgaagtgttgagaggacaggggctctcctggcagctttctgtcatgaggtacatgtgaaattctcccgccatactgaggaattccacacatcaaaacacagtcccatttttcctgcagttagtaagtggaacagcccagaacgtagatggcagtctcccctttcggggttgggggagggggtaaaggggggaacaggaaggggacgtgcattctgatttggcccactggagtttcctttgtgtggtctcgctcttgaggggaacattgctcctcccatcactaccaaacccaggtttctaaggaaccaccttggaaccatatacaggtttggtgaaataactaaagctaggcgtgtgacattgagtcctgcctgctatatgtcagccctcctaagctctgaagtgttcaaattatccagtcttcacaaacatccttaaaacaagttatagtatcctagatttatagatgaggaaagagagactaagcaattaaggggcaaaatggagggttttgtatgtgcatgtgtgcttttgtgtgtgtgtgtgtgtgtgtgtgtgtgtgtgtgtgtgtgtgtgtacacaggcatgcatgtagaagccaggggttgatgtcatgtgtcttcttcaatcactctagctttgatattgaggcacagtttctcacttgaacccaaagctaaccaatccacccagcttgcttcagggagcctctgtctcagcctcctacttgctgggattaagggtgggctaccacaaccacccagcatcacagtgagtgctgcagtctgagctctggtcctcacactttcatgccaagggctttttacttgctgagtcctatctcccaacacacagagctaaaatttaaatctaggtgaggttcacaacagaccagagtgttcttctcgtggttttttggtaagttttcagggttcatgaagcctgaaaatagaggaaatggttggaaagtgatagagttccatagagattatgatattaaggcaatttctaggaccctacgagggcacagtggctctggtgaccctttgtacaatcaaatgtgaacaacaaaatgtcaaagagaattttgcagaggtcttttagtccatgacctattccatttctctgaatcaacatctcggtagcacaggctggcctctagatcaccatgtagtaaagtaggcaaggttttcctacatctccctctccagagctgggatgttagaacatccccgtgctgggttttatgtggtacccgagggcagagcccagggctttgtggcctggtgggcaagcactctaacatccaagctacattccaaccctggttcatgattttaaaagcgtactcaaaactggaaggaataaaccttctgggtggctggttttcccaggatgagtagacttggcatggggaagacctcccggccagtgggtggataaggtctgaatcagatgctgaggtggacgtggaagccggtgcctctgtgtagctcccttttggaagccaggccttccctacagttgcctcagaagcaccacagagagagagagagagagagagagagagagagagagagagagagagagagagagagagagagagcttttatctgcccctggccatggcctttactgattatggaaagaaaaaaaaaacactcgattctctagtcttactggaatagtattgataaatgaagtgtcaaagatgccaccaactacgatatgacatctttgttgcatattttaactgtgcaatgcgtgaaggagccagagagcaccatgaacatgtgacaggccaactatgttcaagggcattctgactccccagtttatctgcactgtatccctgggcaagttagttcctccgtgtgtcagagaaggaaaatagcagtccctgccttggaccatgcaagaaagaaacggattactgtgagaagtgttccaggaaaagcacctgtcaggaggcacccagtaaatgtcacccgtcgtcattatttggcacggcttcccgttacttagttaagtttttaatcatccttttcttgtaaactcttaattgtgataaaatatgtataagccttataccctggtctgtgtttcagtacacttgagtggggttgagtaactccaacttggagtgaaagggtccttttcttttttctttgcttccagttccatgtttcttaaacttcatctttggaacctgtgcttggctcaggtgtcagatttgtgcctcccatgcatattaaaggcccatcacctctcctaggacacctacctctctagactccaccatctctttcagaactgctctgggaactgtgtcagtcttcattgttggcctgtttggcagtgaatacatgttgcatcctgggacctggggggtgctaggtatcgtcgtcccccacccccacccccagaaccttctgtgaatctctggctgtctcatcttacatttagtataagatctacctctccatgctgtgattctaaaagctggtggcaggtcatcagaggtccctggagaataagagcaggcctgatctacacttcctgcccccaactaaatgatgacaaaatggaggcaaaggcccttccttcctgtttcagggccatggctgacttgcccttgtcctttctgaccgccatccctcctcagcagatgctagccacagcaaaggaaggcacccgacagtacacttagtcccttgctatctcccaccagccctcaatcttcttcctctctgctgtggtctgagcaatgcatttaggtctgggatgagtctagcctcttcagccaaaagtttcatgggtgggagattcctatatgcatgagtaactccagggaaaggcaggaagcctccacgaaacgttggggaaatctagccaggctcttggagatcaggctctggaattagcggatttcaactccaaagaaggaagttctctgctgaagggctgttgattggctgtcccccatgctaagactctttcttcagtcttagctctgtgctgccctctccccagtctctgatagctgttgataaattttcccacaagtctagttggatcatttctgattctgccccttaggatctcctctttttttaagacagggtctcatataacccaagctggcctcaaactcgctatgtagccaaggattgccgtgaatacagctatccacccccatccctcatttatttaattttggggatctgtgtgcatgttgggcaagcactcctcaactaaactccctctgagctcccctttgtttatttgaggagttattttttgcgcatgagtgttttgcctgcatattgggtatatgtatacccaatgcctgcagatcccctcagaactggagttacagatggttgtgaaccctgtgggtgctgagaactgaacacgtgtcccctgcagaagtagcaagggctcttaaccactgagccgtctccagctggcaccctactcctgcacccttggttccttacatcgcttctttcggctgctgtgttgaaacctagagaggcctctcgactccaccactgagtgtgtctgcaaatgtgtgcatgatctatgctggcccactggaggagacagcccacttgcaggcagcatctgcctggcctgagggaagatgagtgaaccgttttttttgtttccttcagcccatgttaccaaatgcttatgaaaagcccagagttcgttgttattgaactattccctccaaccagaggtatttacttctttaggccctaaaggggaagtcagtggaggtggctaggtaaaaggtcagtagatggtctctgaccaagcggaaaatgaaccttgaagaaaagcaattggggacagggaagtgtagcattctgctaggctgctataacgaacatcaacaccaggcagctgtagacacagcacttcagtatgtcctgctctggaagcccatggtcagggttggtttccatgaaagctgagggaaggaccaggtctaagagtcagtcttagctacagaggtctggtgagcagttaatctgtagtgttgtttgtcttggaggtcccgccttgcctttggcgtagcattcctccatgtgtgtccatgtccccaacctcctttttataagggtaccagttatattgaataataagatattgtgtttcccctctgttgctgtgacaagcaccatggcctaaaaccctgggactggagagatggctcattgattaagaaaccttgctgttcttccagaggacccaccaaattcagttcccagtccccatgtggcagataacaactgtctgtaacacccattccagaggatccagtgcccccttctggcttccgtaggcattgcgtgtatgtggttcacaggcaggcatgcagtcagaacacccatacacataaaattttcgaataaataaaaataaccactgagaggagaaaagagtttgttatcagctaacaggttacatttccatcactgaaagaagtcatagccggaacttgatgcaaaaagcatggcaaggcagtcacatggagcctctgccatcagacagctctgtggagcctctgccatcagacagctctgtggagcctctgccatcagacagctctgtggagactgtgccatcagacagctctgtggagcctctgccatcagacagctctgtggagactgtgccatcagacagctctgtgtatactgtgccatgcagtttgctcacttttctgggttagaactaagagcgctacttttctttttaacttctctttataccttttttggttactgatccaagggctaagcatgttttctctggtattctgaagccctctcgaagccacacgagtgcttattgccctcccttgcaaatggcagctttccttccttcccctctccatcccccttctcctggcagctgccaagatttatagctagcctacccagtttttttcactaaacttggcctatttttctttcacaaaaagaagaagacaaaccgtggaggtgtgcttattgctggttttctcgcaggctcacacctggctttcttatatagcccaggatcatctgaccagggaatggtgctgcccacagtgggctggaacctgtaacacataaaatggcttcctcttaactaattatgtcctcaaggatctccttttcataaaggccaccttctgggagcctggaagttaaaacatacgaacttggtagtgggaaggcacagttgggaacccaataatagggctaagaggacatgatgtgtgtgtatgaaatatacttccacctcatgaatgtttcactggagccttttgtttggctcttttacaaaactaccgaggtgtggttctctctggaatcctgtgaaacacagtgccctgaggctggtgagtcccctgactcgtttcatggaacctggggatgatgcagggtgacatgtaatgttgacatgagatatatgttgacatgggatatatgatcgtgagatgtttgccataacctttttggacttcctcattgtttatttgtgactgaattggggcgtttggatgaattcaagtaaaaatgatagaaagaggagaatcaggaattcaaggtcattgttaactatgtagtgacttcgaggttagactggtctacatgggattctatattggttacttttctcatcgctatggcaagatggcaaacaaaaacatgttaaagggaaagcctttttggctcacactgtgaaggcacagtccattgtggtgtccaaagcacgttggcaggagggtgaagcagccgatatggttaaatccatagtcggagcagagagacatgaagactgatgcttagcttgcttctgtgtcattgtgtccgtaatcccagcccattggatggagctgcccaccattcagagtcttcctcttaactaaaaccgtactgagaacacccttaaacatacctagaggtatgtttgcatggtgatttcatatcctatgaagttgacaatcaagactagccatcacagacccggtctcacacacacatgagtgggagttgagggtggagctaataaatgataggaaagccaataagactcttctcatcgaagatctgctttacatttggttcaaagaatgggtcctctgtgtctgaagacacttacaaagacaaagctctgtgctccgaaagcacacagtcagccagagtgaatagtccttactgggcttagggtttctcctcctgtgcctcagtgcccacgctcattctatgtagttttgcctccctcttccctgtgcattctcctcccctatcaagaccttcagaaccagggtggcatggacagtttcccagttttccagttgagcaacttaccaagcacaaacatcaaggccaccccctcccccacaccccctccaaaaaaaaagacaacctgagacagaagactcccacatctgagggatttcacgaactcactgtccaaaagcagtgtgtttcctgtgtccagagctcctctgcctgccggctctggcctcttaagtttccacactcggctgccaacttagaataacagagcaacaggcagcagggcaggatcagagcctactccattcctgggtgcaagctttgtactgagacaaagcttggaaggtcttgttgcagacctttcggttgtgcccagaccaccaggagccgggaattaaataccctcagatccacttgtctgccattaatgttatcagcttcatcaaatgcttcctctttcagtggtgtctgcagagaaataaataaatcaagctcttccacatcttgttcctgcccaggatccaaagtctgaagtccactctgagttgaattatctggagcactgtctccctccttcattgttcccgaagacctgggcaggaacgagagtgaaatctccccaggacattacatcagttcctcttttccccttggcatgaaagtgcttcctctcagagccctccctgacttcccaacccttgtaaggcttgccccaactacccacccacaccccagccttgaagccaagacatcaaagagagcctgcaggtaaccagattatcggccaacgcctgcgtctgtgttgtaatttagaagacgggaaatggattccggagatgggatatttttctagtgcaaggtccccatgatccttaacagtctttcaagaaaagaggggcatcttttaagcaaagagtgacatttagaaaatatttgtaacccagaatgaaactgtcccgagtaattgctttccagtgaccttgcactgagaaataaaaaggaaccacggtcagtttgtcttttatggatggcaaaatttaggtccattttagctacaaaaagaacagtcagtgccctagaaggaatatgagccaagtggcatgtgccattccaacctctgtctaggcaacacagatcaggacttctaaaagaaacttttatgcagacacagtagctcatgcctacaatcctagcacttgggagactggggcaaggcaattcctttgagttaggattgctgcagcgtaagaccctgtctctcaaaagaaaagaacgaacaacactttcctaacagaaactatccatcccctatagagaagaagaggactcattaagaaagctccatgtggccaccatcactctcaagaccctgtggccaccaaactgttccctctgtaccccacctggctctttttcacctccccagagtatcatttcatccataaatacttctggataggcctacaaagataaaggctgcttataaaatgagagccacataagccagtgttccagctccacaccagtaaatgcctctgcccgcgctttcagtggtcacctgctggaaaaaaaaacatatacagtgtgaagcaaagtcttagaaagggcctcaaggttgcaggtggttggtggatctccccccgctccctctttaaaagcaagcagtcataactgaacaactgcatggtgcatgttggctggctttgactgtctcttagaagaggattggatccaaggttgagatttgggtagggggtgcagggtggcagtggtggtggtggtgattgtggtcggttggttggttgttcttttgttcccccagattttggagtgttgacttatggtgagacaggttggtgataagtcccaagtctaaacctgagttctctttgtatttcatatatacactacacttgtagcctgcagggaatctgatgggatgtttttcagttgttttgttgatgaaacaaatgtcacagtgtggtgttttccactggcagcattatatagacacactcagcaagtttcagattcggtgggggggggggggaagagttcaatgagcaatgattatgcttatcctgaccttctctcgcccaccccataccggtagccttcaggattcacaccccacacactctgatttttgagacaagttctcactgtgagacccaggctggccttaaattcaccatgtgatccaagctggcctgaagctcctgacagtcttcctgcctcagcctcccaaatgcgaaaattacaggcttacaccaccacactctgcccaagactgtccttgacttaggactttaagtggacttgctatcaagcgcctgtgtgccgttccattgtgtgtaacctgcttgggtttgctgagcttctggaattttctagtttcttgctcatattgtgtctctacttacttaaacttgaccattatctcttccctttcccctcccactcttcccttgtacactttagacagatttgattagttgatgtcataatttgtttttaatttgctctctcatctccaatatgctattaagtccgtccagtctactctttcatttcatatattgtactttttggttctagaatcttcatttttgttttctaagtttctgttttgatagttcctgtatgtcgttacttattgtgactgtggtgtccctgaaatgctaacagcttccttaaattcctttaaagtctctttagctaatcccatcattgccacagaatctgtttctgttggtggccttttaataacaggtcacatcttctgtgtctagaaaaagctgtgttgaggctgaactttacagtcagcacgttgaaagagactccgggttgtattctattcctgtgaagagtgttgaccctttcgcttgcaggcagttgatctattaaccagtcacttttatcatgtagcagctggtttacatttttttctggggcaaatctgtctcagctttgcctttagccctcagtaaggaccctttgtagtgtaacacagagctttctacactaacatgtggccatgctggggtgttgacagagccttttaacttagtgagtctctagctctgacctgtttctctactacagtggtcaggagcccagacttctgtttgtacctctcagccacacaacccctgcttttgcgtctccccggggtgtgtattgttcaggagtcagacaagaatgcgagagaactttagcttgcccttttggaagttctctctggtatgctgcccttgataaggcttctttctgcaggtttctccatttttgttgcctccttgcatcctgacagctcacatgagttcttttcatcttcaaactgccttgtaccgtcactgatgagggtactcttggagaatggagatatatatatattttaagaataaagtcccttgtgttttcatctatttggagtcattgtccagtatctttacatggattttttttttagtttattacatccattttctgtgaagtcttcctgtaggaagtttgggttgagagggccactctgccggtattgaacctggaactcctctttctttcttaggtgaatggtggctggctttaaatcctttcctgttcctgtcatatctgagataccatgttgcctgaacaccagtcttcagcaagatactgacgtatctttcattcctttttctagttggttagaactcttaccgtttagtgatctaggatagtaagtaagtgtcctagcatagctgtcccagtgaggaaggatgcttgaatccgtggcatcagatcatacagcaatcatgaaataggccttcccttcccatgagtctcgtatgctgtggtcgttacagcttttgctcagtgcatccagtgatgaggaaaatctagtagagttttaaaaagaaaaagatcgctattttcatgctaacctaatataaacgttacatgagccccatctctttctctgaccctggtagcgtcccatttccctttcttgggtttctcacataggcaaaagtgatgtctttggcattgttttaacacttagaactatgagtaagtttgtggccagaatagggatcaacaaaaagtgctcattttcctgctgagactgcctcagagacacccgtggccagggtgtcccatgacgatagatgtctacaagttaaatctagctcatatatttctgtgggcagatacctggcctgagcttcagcagggaacccagatctccagtgagctggaccgtcctcagcccagccccgcagctacttctgctctagagctgtggacacttcgggtgtcctcagcagcgtgtaaatccaagggccataaggagcccgccccccttcctacttccgctataactcagagttcacaatgatctgcacgctgagggacacgctttcaagtacaaaatcaccattctacaaaaacctcagtcattgctgctgagagcaggtttctgtttatgatttttgttcctggggtctgtgtgacaagagcagtagtacttgcagattttagaatctaattctgatcctttacccactggccacgtggtgcagggaaattgtctgtggttcacttctataatctgtgaaatgggtatagagtgtatttttctcctaagaatgatcgaagttttaaatattaaaacccaggacatagagtagagtcatcatgaatcgccattgctaacagcagtaacaatacctggagatagagaaaagaaagtttaaggtcaccagagcaactggagagaaacccctaaaaacacctcacctctgaaaactacacagaggagtcaattgaggagaagacagagaagggcattggattcctcgtgtttttcaggcactagcagatgccagatagaatgttgatggacgttcctaacttgtccggggtaggaaggcgattcaagtgtgtgctctggagttttgtctgagccacgggagagacagagggatctgggttgagagaggctccatgcttcaatccagctgcctacagagcaacggtgaggttgcggggctgcagactcacagtggtctgtgattgtcttttcttctgccccacagataactgtgtccagaggacacccaggacgccagcggagagcgtgcaccacaaccctcccaccatcgaactcttacatcgccctaggtcacccatcaccacaaaccacaggccttctcctgaccccgaacagcagcggccccagcggtcccccctagacaacatgagccgccgcctctcaccagtggagaaagcccaggggcccaggctacagcaggagaacaaccaccaggaaacgtaccccctgtcagtgtctcctgtcgagaataatcactgcctgccctcaagcccctggcaggagagcactcgagtgatccagctgatgcccagccccatcatgcaccctttgatcctgaacccccggcactcgcactcggtggacttcaaacagtcccggcactccgaggatgggatgaatcgggaagggaagcccatcaacctgtctcatcgggaggacctggcttacttgaaccacatcatggtctctatgtccccaccggaagagcacgccatgcccattgggagaatagcaggtgagtgagctcagccccttcgcgccccctcgcgccccctcgcgccccctcgcgccccctcgcggcccctcgcggtccaacagtaaccatgctgccagccacacgccactggcagtgttatgagcccaccctcccgcaaaggtttggggaggacaaggggaagcttctgcctgcctgagaccgagtccctaatggcctggttaatgagccactcggagagagtagtagttaatgagcctcagaaatgttaaggaatgaatgtcctccatccagctcacaaggagagctgcctcagaaacacgatcacggctgagggaaaacatttaaaatcaaaggtttatgaagtgctctaatgggcccatcctgaagtttccaggtgctaattaatgaccagagacagcctaagagaaccttggtctcggattcatgcctgtaatcctgtcctgtggacagcagctcagcgctgctttccccttgggagaggggccagaattgggatcggggtgttagtagacaggtgttgctatgtcatttcgacagagaaaactcactcccaaattcttttttcgattatgttggaaggcccaaatgtgctcttctaacaagaaaccaaggagggagggtaagactctaccaattaaaacttcgccatcctgcccaaattttacgtggaattccatggggcacctacgatgcacagataaatacatccgctgtgctgtatacagcggtgatttaacatccagcatcctcccccttgtagaactgaaagtttacagggagaagcacatatgaaccccattaagatacagggcggatgatgaaaggttcaccgcttacccgggcagagtacaagtgttcatcgagcgagcgccttctgtgcagcagaaagccaaagcagcgagaagctgtgtttggactggaggagcccggcggcttcacaagggctggggaaatgggaagcaagtggcggtgcttcccttggtgggaaaagactcagagttagggtagagccccgtgcacgtgatggggataaacagcccttctccgcagctggtactgctgcgtgtagcagtacccaacgagagccctgcttcacctctgccttagcttcttgtctcctcttaagtcatccatttctaggtgtttgcctgtccctgagtacacctccaccactgccttggatttattgctataataatttacatcgaggttgttgaattaagacaataaaatggaggggctgtgggggagatagtgcagtcttaacgcgctctgtttaggccccaggccccaggggtcatggcatacacctgtgatcccagtgctaagggcagagatgcacttccctgcgaccagttccagactgaccctatctcagaagacaaagtagatggcaccagtgcagtgacgcccaaagctgtcctttgtcctctgcgtgtatacacatgctcgagcatatccgtacacacacatgcacccacacacacatgcacccagatcaaaagaaaatgggcactaaaagcgcagctcggtggtagagtgcttgcctagagtgcataaagccctaaggtttgatggtcagaaccataacaacaacagcaaaacagcaactgtctgcggcttgcatgttttcaaaggctgtgcaaccaggagtgtgcttcagattccattcaaaacatgtcaaaaatttcgtgacagaggaatgggctatgcagtaatatggggttagccatgaggtattgggtgattatgtgggtgagtggatgcatggtggttcataccattgttctgcttatacacaagattagctttaataatgaagaaacctcgggatgagtggtcagggggcaaagaaggaaaaaaaccttacagaaaaatctggatttcctcagacagctagaggaaacgggatggggtgggaacttctaagcaatggaattgtccttagctgcataccgtctgggtccttcctctacgcagtgttttcagatcctattgcttgcctataattctcaggacagccctctgaggttggatccctgtaatgtgcatgggtcatttgttcagggggaaccacaagagagatccagccctgaagacaccaaggctttccccaaggtcagaggagggtttggtgtcactcggctgttgtctgcagtgcttctcttgagggtatagcttgcttccttccttccttgtcaaggtcgtccatgtccactgtcatttcaccgcagacttcttgagaatcttaagataagcatataggtccagaaagaaaacctgcatgagagaaggaagagggagaaggaaagggaggaggagaggagggaggaggactgaaggaattatgtagacatacagcactatcttccccttgtaagttgcacatctgtttcatcgattctaccactacttttaaaaccatgtaccccaaaaacagcagtagatggaggaggctcaacacttcagatgcaactggaggtaaatatcatattgagcaattttagtcggtcccacaaaggcaaattagcacatttatctctcattggtgggtcttagattttatggagatgctcaagctcatacaggtacaggtatgaaaaatgtaagaaactgtagggtaacaaaggaaatgagcaggaagggggagggaaagaaaagggaggcgcgtggtatggccgactgctcaagcacattttatacttgtgtgaaagagtctttatgtaacccggtgccatacagatacagggagcctggtggaaatgttcagccagtccagtgacgactcggtatccacaggtgccttgtcttgagaacacttagagagagctagtgtgtgcttttccttgcctctaagaaggcagagtgttctagatgattatgcccgggtcagatcttctggggacaatgcattcattcctacgggatgattgagtcccatacaaatgtatattaatgttcttatgatctttgtaaatgttgtaaaatccctaaatatatacattacctaatgcactcaaattccagatgagcccatttaactgtcaagcattgcttttttacaggggtgaaatgctggggtcatggtcaggttgggtggtcgttcaggtcccttcctgctctgcaagtccacaatctaacagtgagtcttgattctacagccctctgcggaggtggttcatagccccacactcctttggcccctttggaggaccctctactcctccctcccccaaccctctgtctttctgggctcctaagatcttagtaaaagtgattctgtttgttgaaggtcaaattctgtgagtcactgctgtttacactgtaaggttctgtctagtgagcagccgtagatgcttttaaatctctgcaaagaggctgttagatgcgaaaacgtagttccttgaagccctttaattgagcacaggaagaaatgaaagtgccaccaaatgtcacaccgatgagtaactccgctggagggtgtggacagaaacactgcttaccagtgtagagcaaaacacaagcccagatccttgccattcacggggggttggcttgggtataggaggatttaggtgttcagacacctaagaggagtctgcactgtattcttgcagggtgggagttcacgaaaacgtaagactcaaatctttggcatgaaagagctgaggttaactataaaagcaaagcgcatggtgtacagctctcttaggactgccactaagtaccacaggaggtcagggctgcctttcagatgggcttaaaagaatgcttaaggaatggggtgtggggagtctgcctttaatcccagcacttgggaggcagaagcaggcacatctctgtgggtccaaggccagcctgttttacagaatgaaaccttgcttcaacataaatattttttaataatgtatttacttctattttatgtacattggtattttgcctgcatgtacatccgtgtgagtgtatcagatgccctggaactggagttgcagacagttgtgagctgccatgtgggtgctgggaattgaacccaggtcctctggaggaacagccaggtcctcttaaccattgagccatctctccaagcctaaaatgaacattttaaataaataaataaataaataaataaataaataaataaataaataaataaataaaattaatgctcagacacgcgtgttcttgtctgttcctagtagagatacaaggccaagagcttgtctctccgagtcaactaaaaaattatttttcataaactcttcttttcctatctctgaaaaaaaactgatgaatcatgcaaataaaagatcacataaactcccaacaatttacccttggtcttaaccatacgggaaaactaatttaataggaaaattcagttaatgattagcagtttaaatacagattaaatacaagttaagtctatttaaatataacatgttttaattttactttgcaaattagaaagaggtcttggaaattgtcctctggataaacatcaggctgtttgtgttggagtcctttcttaggactgagtgagttcagtagaagcgacttttacagggaatggaactgagagtcacctacatcggtaatgcagcctcaagcctgtgtccccatcccaccccaaatacttctacccagagacgtctcaacaaggattggaagccttggccaaagtgtagccaccacctgattctgtaaatgagtttatgggggaaagccagccacatttgtattaaattatcgtctatgtctgctttcaaaccatgacccaggcatgaatacagttgagtcacttcagggcgcctctggccaaacgtcttagatatttgccaattggccttgtacataaagagtggggtgccccccatgaacagtcagtattctgaggacctcaggcataatttaggctgaggatacaggaagtatagttcttgctggggaggaaatgcacactttaggtgacaggcatgtctgagtcacgtgaaaaggacaataacaaactatgtcagccagtagacagttcagggctgcaggccatgctcactgaacagtacggcacagccgcgatggcaccgttagaataaagaaaacagctcagtaacgtcgcttctttgcacatttgaatttgtagtcacatttgtttatttattcaaaaatgatcatgtatttacaatgtgcgagacatttctctatgtgaaagacacaagattgaccagtgctttgatcctcctgcctcaacctcctgaactgggattacaggtggataccatcacactgggctcagacaagtcttttttttttttttttggtcattttgattttctcttaagtggattttatatttgtccctttcgtgaccttaatctaaatatcttccaaggaaagattcattagttctctgacattcatcttataacccacaatttgtctgttttttaaaatccagtagcccaggctgaccctaatcctatgtcagcctcctgagtgctgagatgatgggcttgaaccactacatccagcttcatagctcattcttagctcatttgctaatttagtcaaagcccttgacatacggtggctgggttcttttctttcttgtgagcacctgataacttgtgttgcagtatttcaatcttgtcaaacttgagcttctttcaggatgccattattcagttgacttaactacacccaataagacttagaattccttcccacttcagggtcccctcactccaagctccccactaacacacttcatatatatatttaacagtaaataaaatgacttctaatgacattctgctatgctcatagatcagttccttgctcagccatcatcaaagaagttgtctcctgcagcagatggggacagatacaaaaacccacagacagacagacaggcattgtgcaaagaatgagagacctcgggacacacgctctaaggaggatgtctctgtcagacccctcccctgagggcttgtggaaccctgtggagaagaaggcacagagagtcttagagccataggggatggaagacaccaagggaacaaggccttctaaatcaagagcatcagtgcacataggaattcagagacggaagcatcaagcacaaggcctgaacaggtctgcctctgcgagtgtgttatggcttccagtttagtgttttcatggggactcttgagtgtgtgaatggatgggtccctgaactctgtgccttctcttgggctcttcccttttgtttgtttggtttggttggtcttaattccggtgtgttagattttgttttatcttattttattattttcccttagaagcctgttttctgagagactgaaagggagtggatccggaagggaggggaggtggggagaatcagaggagtgaagggaggtgaaaatgtaatcaggatatagtatgtaaggggaaaaaaatatattttcaataaaggggggggcttcaaggaggatggtaggaggtgtggcctcagaggccctggggcagtggaggatagaccaggtactccagcctcccgctcaccttctctgttaccttcctagaaatttgaaggagagtaacttcaagtgaggcttttgaattcttcccctttttgcaaatgagcctcggtaatagcctttaagataaaataaaaagagccatagatatgagggtccacgtcattcctaagccttcctaatgaggggtgaggacagagttgtgggatgtttccatagttgtgttgcacacgctgaaagagcaactctctctcccctgcactgtcttagggactaagtaaacctctggagccctccgcccagatccctgtcttggtagggtcttgtactgaagagctagggcatccccaggaaagcaggacggacctgtgggttcccccagcctctgcagtcagcaggatggaatgcggttcttgccttccaaggcagggcttaatactccaggcttaaggctcctttcttatctgtagcattgggaatactgcccgcttctgagcgattttgattgatgtgacacacaagtgggttaatttaatgctcacaggtcctggtccctcctctgcttcactacagagctgtcatactgtgggactaagagattcgtgcagcactcaggtgtccatcctgaactggcaggggtgttggcaagcagtaagtgatgccacgaagcaagcacaaccctccaaatcccctccccaacttccttcaggatttgcatctgtgacctctgtcccctatgctttgcccactgtcccttttagaggaggtgggtaagataaggactaagattgttcactccatctggaatgttctaagtgcttctgacctctcacattctatcaaaggcactgtactggtttcagcgtgaaatcaaagagctctagagaggaggaatgtttcagggtggtgtttagaaaatagactgtttccccatgtccccacctctctgctgtccctgaatgtgaatccagaggctacacctacctgtagcaaaaccatggtggggtactgctagcctcctgctgtaggctgtatctcacttggtctgagcgtgagtccagtgtctgccttcctcctgctgcataactcaccagtagcaggaaagagtccgtttgtttgcaaggcccggaagcatcagtgtggttcctgttacctgcctgtcgccaccgcacccttccccggcatgccactgcacactcacagtctctgctttcctccaccacagcaaaacacaagcagttgtccattgtacacacacagctgcatgtcaacacccacttggcagtgctggatttagagactctgtacttctgggcagtagctgatgtggcctgggggagggaagagcagctggatagcagaggatcccctctatgctgggaacctgtgttcctataaagggcaccccagctttcacactctttgatatttatgccaaagagtgctttgtcgtagggacttgccctatgcagccttagccaaaagcacctccatccacccctgttgtcacaactggaattgtctccaggcacagtcacataccagctcagatggaaaaatcactgcccagctcagaacaatggctgtggcaagctggctgccacttctcagtttatatcttactgtacctgctctggtgctgggctttcaataaacttagcaattttgaggtcatcagtgttaaaagtgtaaccaggaacactgaacttcgcgtcccattggcactataaacttaaacccatggtacaggcagggttcgtagaccatcacttaaaattccatttgagcaagtaaaacaacataaaaacaactttcttagaaactttctggaaagttaaattttattctccatcattacacatcccctttgtctgtaatttgacccgcctactcagaattttttaaagattggttttgtctaacagggatttttttttttagaagccatattggctatgtgtgaattgcccatcttttttatattctctgtcctgtgagtttatacaataagtctctagtaggagacagacgtgggagtgaaaatattcctccctaaccacaggaagggatttttacaatgcttcttagagccaggtacctcacccagcaggaaacagggagctgctcttccctgcagttggaaaggagctttatctgagataatccattctgtaaacttcctctagaagaagaggtgatccaactgacgagcatttctttaaaatactcagatttccctatatggaagaaaagaccttggccctagtttcctttccctttgctttgataagagagggtttattctggctcacaaatcaaggtacagcccatcacggtggggaaattaaggcagcaggagcttgaagcagctggctccatcacatctacaatcagaaagcagagaaggataaataaattttactgctcagctctttctccacttatgtagtccaggaacctatctagggaatagcaccacccacggtaggcaggtcttccaatatcagttaactcagtcaagataatccatacacacattcccagagcctcatcactggtgattctatattctgtcaagctgacagttaacaccattgtctccttaggagagacaaacttagggctggagagatggctcggaggttaagagcactgactgctcttccagaggtcctgagttcaatttccagcaactacatggtggctcaaaaccatctgtaatgggatctgatgccttcttctggtgtatctgaaaatagcaacggtgtactcagatatattaaatgaataaataagtcttctttttaaaaaggagagataaacttaaaattaataagtaacttatggtttaaaaataataaacatgcatgttcagttgctttataggatggactttgttaacagaatatagcctattttatttattgaattatagcatttttattattgatcaaagaacattgcatctgtacagacatggcatcagacaaagctagaaaattccaggtggtctctgataatagtatccaaaagatctagagaacaagagattgtgccttttacttaatagaaatattgaaaagaaaaataactcaggtggcttatacttctatagtaaataagaaagaacatggctgtgtggtcagacagttatttttatcatctgggcataatttttaaagaaacagagaaatcaatagtgctataaaagccacttacactctgagcttgaagcaactgctttatgccatgaaattccccttgctacttccgttagtggctgagtaattcagtgtggcttgaatgtcaacgtttttattacgcagctaatgttggctttgctggattaaatgtcatttaaagtgatcaattgggagcttgtttggggttactttcaaatttatgaaaggggaaaaacactgcaatatacaaatgttcttgaagcttacaagtacagtctgttctccggcaagccctgtcctgcattcgccatccagtgggcacattatacagtcacattcaggaaccaagtttgaggtctctgaaaagactacctgacaccccagggctgggtaagcctttagctgaagaaataatccaagggacagctgggctgtgccatgatagtaaaagaaagtgcagtggaaaatccctgtgcagatggaaatggaggtcaggagagctgtctgctctgtgcctacgtctgagctctgcagcggggctggagcccagagctgtgcttaccttctgttaaccttactgaggtggatacagtagagctaggcatggaggtgctcacctgtaaccctatcactgggtaagtgaaggcaggaggaccctgggacttaccagccagccagtcaggcttcactcactgatgggtgtcaggttcgatgagagaccttgtctctcagtgcatagcagttaaagagatgcccagccttgatttctggcttccacatgcttttcctctcataggtatacacacatgattgttaccacacaggcatgcagaacaggggccgtgtgcacacttcattttttcctcactgaatagcattttatgtgaatagggcttggtttgggggagatgttttccagtcaggtaagacgacagaaaactcaagtgtgcctgccctttgattgtggcaccaaagccagactagagaatcacagctcaggtcttgtcttaggccatccaggctgctgaaacaaaatgctgtaaggtgaccacagacagtgggaattagcaaaatgtggtggtacatgcctgcaacctcagcacttggagggtaaaagcaagaacatcaccatgagtctgaggccagcctgggctacgtactgaaactctgtctacaaaacaggaagtacaggagaaggagagggaagaatggagggaagaggaaaaggaaggaagtgctgcccccactttctggagactccagggttgaagggcagagctctagtgtcaatttgaggtctgctaatggatgttccctctctttcctaggtagcatcttcttgctgtgtcctcacagatagatacgtaagggagctcttgcagttatcttttataaaggcactcactggggctggcaagcccgttaggagcactcgctgttcttgcaaagaccccaagttcagttcccagcacccacatggcagcccacaactctctgtacctctggttctgggggatccagcgccctcttctggtccctgtgggatcctgcatgcctgtgctactcatttgctcacacaggtgtgcctgtaaatacgtgaggtgcacgttcagggagcagctggaaagggcaccgcctactcttaagccaggggtcaatccagcatctgctatgcccagaaggtgcatgtttgtctctgctgcgccttggtctgggctggagggcaaaccaggtaccattacagcactagaaaccagagattcacagccaaaactctgagctgagcccagtgcaggacaacactaaatcatcttatgaatgtttgctgtctgaccacttaattgggtatgagttctccaaatgagaaatgatattcttgcacgaagttcctttctaccatgattatgataaagcaacttgaaagacctccaaaggatgatttaatgagaacatctgtatttttttaaatgctagccacagtccccacagccaacgtcaccaagccacatagtttttaatttaccatcatttttcatttcttgctgttttctttttagcccctgtcttccactatcccttcagcatcttccaccatgtgcaaaatagtctactcttttaattttttttttatcatactgttctcattggaacacaagattttctttctggtcttgaggaatggtcggtaaagtgtttgcatggggacctgatagtgacccccccagaactcacataaaggcagtatgtatctgcaaacctctgtaaaaacagtcctagggaaacagagacagtctagatccctgctcagtgagagactatatctctaaataaataagatgtaggtgaaggggctggcgaaatagctcagtgggtaggtgcttgctatgcaaataagacgacctgagtttgaatcccaagcggtggtgtaaaagtcaggttaaatgccatgtaaaatgcacagctgtaaccacagaattggggacggtggtggatacaggtgggtctttagaacttgctggcctgccagcctagcagaagtggtgaactacaggttcactgagaggccctgtctcaagacaataaggcagacagagcatgataccagtgtctcctctagcgtctcagtgtatatggatatgcccacacacactcacacagagaaattccaaaactagtaagatggaaaatgatgtatgaagacacttaatgtcaacctctggcctccagaaacacagagagagagagagattctctttctaccatttatccatctaccctctctgtagcccattatcaaagcctatttattcatttgcaggtacagcttgggtggtacaacttcaagttctgtcgtgactttgaacaagtctgttcctccttggtcctcatataaaggtggtagccttggtcaacaccgagtctccctgggtcaaagggtcaaaggtcggcaggagctccccggctctctcaggacccatttcacctgtgaaataaggaaataagacagtcaactccaggcccaagctgtggttccacaccccttttctaaatcttgtgactgcctccacaaaaacactctcaacagcactctcctctctcctctgtagactgtagactgctttgggattatgtctatcagttgctgtctgacagccggtacgaaaacttcatccgatgggaggacaaagaatccaaaatattccggatagtggatcccaacggactggctcgactctggggaaaccataaggtaaaagggccaaatatttgttggggaagctgttgccagaacacaggcttcatccttgaattggagggtgattgtcttgctgcctccaaagcctgcccatgattctttggtttctcctcactgggcacacaattaggtagctatgaaggaaggaaataattaaagatccctgtttttccatgtgttacctctgtccggggcccattaactcagcagaactcagttcagtagacttataaatgttccccctcctgaccacgccccttgacctggatctgccacccctgttgtccttcagtactgaggaacagagaagtagtgagagctgtatgactcacgggggacctttgggaagtgttacttctgtccccaccagttggaaagcccccttttcacaaaagtccatttctgcatggaaaatatgttctgattataaaacaccccctttgcaagcaaaagctgcaagaagcctgcccccacagttttccaaaggaggaagtggaagtggaattcaaaacatagtcctttatagtaaggaaggcggttcaaatgtacagatataaaagagataatcatggtccaggccagttgacacataaggagattagaccacgctgaggacaccgaggagacacagccgagcctcaggcctcctaagaaggcagccagagctctttcccaattgagaaagtccagtcaaaggccacaaacagataggtcaaggccccctaaacagatgtttgggtacctgagtcactgagggaccttctgtgcactgcccatcaatagcaatgacagtaagtgtataatcgtcattgcaccccaaaacgaaacttgatgtgaaccagacatgaaggcctcccacctaatatagaagaagcccagagcagtctgcagagaaggaatgaggtcagttgccatagtatgggctaggttagtgagtacttctagccctgacaagccagttcagttttaggaggagaccttggccacagtggctgtgagggtagatagcagaaggcggcagaccagcaaataggtagcattcccaggctggtgaggccatgtggagcgactcaacagcctttattttaatagctgcctggtgccttttctgaagttcatttcattgtgtatttgtgctttttttttcctctctctctcccttcctcctttgaacaaacagaacagaacaaacatgacctatgagaaaatgtccagagccctgcgccactactacaaactaaacattatcaggaaggagcccggacaaaggcttttgttcaggtagcacttcctcttttccctttccttcttttgggaggacattattttctttacagaagagggaggagctctgacatgccaatctgaggcccagagccatgactgcaattggattggaaagttggttggaaaccgggtgctggcttgttaggatttaagggggaaagatgactcctttcactgaagtctgtcctgtatgaaagccaaagctaaatgcgatctgactcatctttaaaataacacagtggtcaaacagcattatctgacattggtgtccgatggagttaaacggagcaatcagaataactattgtcaatagcacaacgaaggattaagctttggacttccaggtcaccaaacctggaagctgctttgtcaagcttcaggtcatgacccacagtgagtcactcactgtgtgggtgtacttggtcaacaacagccactttcttagtgaaataaagaatgcagtatcacagagttggacacaccaaattatagctcatcaaagagtgaccattaattcataaaaattttgtttggcttgtgtgtagacgtgtgtgtgcacatgtgtttggaggccagaggtcaacctgtgatgtcacttctcaggccctatccaccttgttttttgagattaggtctcactggcttagggctgactaagaagctggggggggggtggtctgcctgtccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtggtaagcactttaccgactgagccccgcagattgtatgtcttacaaacacaccaccgttagaaaagtatgacggccactgcggtcgggagctctccctccctcctgccagattctccatagctaatggttctggctgtttcagctaccatggagattgtgatttccggaagtagagaagaagaaggatctaaagggataatgaggatggcatagggggagccctcactcacaccattggtcaatgaagtgacaggaggaagccatattgcaattaagactttaggttgtaggttttggcaaatttagaacaaaaagcgcaacctctgggtctggagatgtggatttaggatcatgtatgtgcaggtcatgtatgtgcaggtagggaaatgtcactgtatatgaggagccgtggtgcactcgacggtagtgctcatgaggagagcacagaagccacacattagcactgaggtagagtggtaatggaggaccaacgttggtcacgttgctcttcaaaaggaacagagaatgcatgaagacatgtcagtggaataaataaatacagaagagccctccttgcctccggcaaggatgaggttgacaccttcatcctttaaccccaaacctttagctccctgttctttgaccctagatgagcggatcccaccaccctcgatctcatttttcacctcagtctttggtcttaaatctgaccatgaaacccttcatgggatttcaaaagtatgtataatatgcctgctaaaataccacattagtgctccagatatgattcctgcaaggcaggccttcatggctgagaaattcttcccagaaatctcagctctcatcagttgacgccactgtccaaagtaatggagggtggactcatatttgattctttctatatccaagtcagttactgggatgcaccatctgctgtctcggcatcactctccctgtctagttttatgttgaaggcctgacgcctggcagctgcatttcccagggttcgtaaccagcctgtctggggttgaagtctgtggcaagcacattcatggaatgtgtatgacggacatgaatatcccttaccttctcacattcacacaccctcaaggccacctcaagttgcctgcactttatgaggccctcctcagttgctcactcccaggtaggcaccctcttccaccatctcctgtgtaccctctgtcctcaaacacaccataactttcatttttagtagtctgtgtggagcaggagagaccacttcccagcagcagctacatgatggcccacaaaccatctgtatctccagtgccagggaatctgacgccctcttctggcctcttcatgctcctgcatgcacacggtgcacataaactcttgagagacatatgcataagccaaaataagtctttaagatatcttcagtaatcgtgactagtatagtttaataatatgtgtgaagtcttcctcgccacaattcaatcataagttcctagaaggtagaggcctctgatttatttcattttgtatatactttagggaggacctcagtaaacatttcatgaccaactggtgtggtatggagttttaagcttaccaaggcgaagtggtatgaaggaagggtcagtttgggcctcaggggagctttagcaacttcagatgttgaggaagacgttttaccgagaagatagcagtagaacacagagagaagcagctgtgacgtggagctgagcagccatgagcagaaaggaatgtcaccccactgccacatcacccattgtgagggaagacaaggcatttgcaaccagatgtcccacctgcacatacaatggtcgggacatgtcactgtggctcttccacgtaacacacagtgatcaagaatgtgaggctgctgtggactccagccacaaaggaaggaggacacgaagtcagctctgtcagctcaggtagatcagtggaaacaagaggattcttcttgcttttctaatttgcagacgcttcctgccctaacctgcctgttcatcaaaagtatccacttgacatctaaagtatcctctgagttaaattcaagttttaaatactgttctctgggctcgctctcagattagaatgggagtaggtataggactcctgtgggtctctgtaaaagtctaattcttggggttgaggagacggctccatgggcaagagtgcttgctgtgtaagtgtgggacccaagttcaagtctccagcactcacataaaaagccatgtgagaataggttccctttttccatgtaagttgctctaagggttggggtagagagagtggagggacatctttgggaacacagattcttttgactctttcatttcctgctccaaaggttcatgaaaaccccagatgagatcatgagtggccggacagaccgtctagaacacctcgagtctcaagtgctggatgaacaaacgtaccaagaggatgaacctaccatagcctcaccggtgggctggccaagaggaaacctgcccacggggaccgcaggaggcgtgatggaagcaggcgagctaggggtggctgtaaaggaagagacccgggaatagcagggacacttctcctgccgatcaagagggacccagagcaccttagacaagccaccgagcaatggcagggctgaagttctggcggagggcacaagcctgagactcacacgtcacgttcgcttctccttctgatctcttgtctgtaactctcaccctctcccttcccctgcacctgttgtagtctcatggtgtttctggtttcgttttttgtttttgttttttaagaacatgcagtttgactattcattgttcatacagggaagacatcacatgttgttttcctatggaaatatatctattatatatatattattaatttttttgttgttgttgcaaatctcaccgagtacggccagcttggctggtcaggaaagagaaaacttgcagaaggaatcaggttcctctttttcctgccacatagatctggtgtgtcctgtccaagtcaggtcttagatgagaaaggaaaacaaaatgagagagatactttcaaacaatggaaaagaagagttctgtctccatctccctctctcgccgctcatccccgcccctttctccttcccccttctctgcctgctatgcacttcacaggcttttcatcagagctagcctcactagcacctgaactacacagtgacccggctgctctgtgacagtcagaccccttgggcacccatctgaggaaggccagacatctccccccaccaaatgctgctgtattctagaaagaacaatgggaggatcgagcataagataggacagagggtggccacaggatttgcaaggcccaggcagtttgggattgtcctgaaagtgctacacattaggaaaatatgagagaccacacaggcctggtagtttaggagcaagaacaggtcaccaatgttgtcccaagacatcatgcccttgtgggattgtcaccaccccacacacacactccaagtcctagcctttttcttctatgctggtcctcatggaacacagaacacacatgagggaggatgctggaatttagtctcagacacagccggtatttgcgcagacaggaaattcctcagatttagacttttttcttttttccgtctgtcatggctgtatttcaggaggacatatctgtggctcttctccacctcgacataaggtcagtagtatcttccaagatgagggtaatgctattccttaggatttttgatagcagggattttattttatttatttatttatttttgggattttttttttttgagacagggtttttctgtgtatccctggaattcactctgtagaccagactaggactcagagatctacctgcctctgcctcccaagcactgagattaaaggtgtgcgcccccatgcctagctttttttccttttctagccatctaagtggactctttgaagttcactgttttaaaacccagataatgaggcctgcctttcaaaaccaccccttgtccttcctgtgttctcccacatcatggaatgagcctctcccagccctcctgggtgtgtctctgcttggtcagacacaggacacaggtgaagctgacagaccagagctgacctacaactactcctaagtggggcacatagaggctaggaggacctggacaagtcactctcccgacgtcagctcacagacggactgtggttcacagacactggaattgagttgactgggtatctttagtcttgctgtgacttccccgtgcctcccccacaacccacaatctgccttcaaagaggtcagtgacctgggtgagggcttccgtcttaatattcatggggaatgatgagagtcacgtgctatgtgtttcttgaaagcatgacaggggttcctttttttttggcctctaaaaatgactggtaccttatatcaaatggggagattaagccaaatacttgtgttatatgagccactgggaggaagagcaagtgagaaagggtgtgctttttgtttttgttttgactgaggtcctttgtgtgaatataaaatgagaaactacaacacttcatactggctggccactttgcccatgcgtagaactcagtcctttaactgcccaaagaattgtccatatgaactgtggaaggaaattcctctgttccctaaggagtcttggatgacagctttggccacttacgttagaaatgctcatggcagtgccatctttatttcacacctggtgttgccataattgatttctttgattctcttacctgcaaaagcccttgtttgttttttggagagaaaatatggccagggttgtctgggttgtcagggttgtgcagtgctctcaggcttcagactcacagaatttagatttagccaatcagaccttgaaggaaacaccacaatgggggtcctgttttgtctttttggtttttggtttttagttttggttttttgtttgtttgtttttttacaatcaactatgatcttctagatcgacattaaagcgacattaagttcaagaggtgatagaaggaatctaaaagctcctttagtggcctttttctgcagccattgtgggttgagtcaggaaaggaatttgcagggaagcattgccatgtggaggatgggcattgccacctaggtcctgggattctgtcctgagtcctcggccgggctgtcttcgggtctccttcagcagaaaccaggggcagctggttagatgttgacagcagcttctcttccgataattttcatccaaggccacttagtgccacttggagacagggtccctgatgtcccatatctggttttggaaagagaatggtcctcataagaaaagaacaaaacaggcttcttgcctagtacattcaggtccctctgatccagcatctttttacactaataccttgtccagataagaatgtcactcgagctaacatctggatgtctgtgaggagtccctggaatgaccactcttgtcttttcacactgttcgggatccaaccataaacacagtttggcccattcactgttgttggcagaagacaacctgagagaggtcatgtcactttccgtgggagcagacagcatgacacacagttgggatcagtatctagccggcctgcacttagcagcaggataagcgttcagaaggcagttagaaattattctggtttaaacccccatttgatccatccccagcaaagagacgaaatgccaagggtggttttcactgcccagtcattcggtgctagttagagctgctgtgcattctcagcctgctcctcttctgaacagaaaccaaaattggacgtcatgagaaacccagtggagcaggggtacagagggacaccccagaaccctgcctatcaacaaggcacacaggactcacccagcactcttttggccccatccgcatcaacactaaacaacttcaaatgcgcccgactcttttcaccctcacaggtgaaccctcttctggagacttctctttgtgacggcacccacctgcaagccagatgaatctagaatgactttttgttgttgttgttgtttagtttctaatctcttgtttatgaggtgtggggtttataagggactgaatcaaatgaatgtaacaaaaaaagaaaaaaaaaacaaaaaatgccttttctcagggccagtgagttgcaaataatttttaaagaaaaacctataattacatcatctcaataaattttttataaaaaaaaaatcaagtcccaagtctctgtttttaataatatgaaatggagtcagacaggcaaggcactctgatgatgcaaatcctgtctactctattatggaataaagtgcactcccggtttctcctggcaggaagccgctgttacccggtgttctgcaggccagctttagacaagaggccccaggaaggtcacagcagatcactctactctgagctgctgccacaggtagaaaaatctgcctcaaggaactccagccagagatgccaaggatggaccaggtcccttggtgacagcagggattaagttaccctggttgatttcactcctgcaaggtagtgaagacataaatgtgagggtagcacccacagcctggttgccaaagactttgcactcaatgtctctggcacactggtccctgccaccaaccagagggcaactgaaatttcaaactccaacagcatagcaggtgatgccggtgcacagctgtagacgcagcacatggaagctggagaaataggaggaccaggagctcaatgtccgcgtcctctgatagcaagtgtgaagccagcctgagttgcacgagatctcatctcaaaaaaaacaaacttaaagatccaacgtaatagtcgccacaacgatctgtttgccgtcatgataggtagagcttccgagtgtgtgagaggaagcagatgccggtgcccggcagcagcacggcagtaggttttggaactcgggaatataaaactgatggcagagtacattagactggttctctcttcacacagtctgggggcatccctgtactggattgctgaaatcggcctttagaccctaaactgtcagaatactcaatcaagtaaagtttaggagacactttctgggggagctaatgtgcctttgaaacaacgatttccaatcactctcaatttgaatcatctgggaattcctagcaatgcacattgtgcgttgggattccataagccaaatcaaagctttggggttggcacctccaagtctgcctttgtgagctaaggtttgacattactctcaccaataggttcaccgtgctacaaaggcgcacacggcatcagataagtgatggtggttcatttgcattacacgtactcacagacagtcaccccacatgtctaaatggacacggactacagaatgaggccagccagacacaatcatgcagagagtcggcatgcttcgccatccagacctctttagcaatcaatctgctacaaagacgtgcagtttaaaggtcagctcagacagatgacctgcccttgcaaactgcacatcgatttatatacttaggcccacttgcctgcctaaccgccctaatctaaaagggaaggcaaagcacgtgctgtcatctgtcctagcattatgcggcagagccggaatggacatgtgaccaggtgttggaggcctctctgagcacaaggctagatcagaactgggccaacctgaactggaaatgcttcataactaactacctgaggatcttaaaaaaacagacctgtattttgttctgtttgttttgttccaacatggtctcgtgtagcccaggctggcctccagctccctgtgtagctaaagataaccttgagcttgtgattttcctgctcctgtctccctagtgctatgattacaggcatgaccaccatgcttggtttgtacagtgctggagagagaatccaggactttaggcattccaggcaagcactctagcaataaaactctagttattatgtccagatttctgcttccataacatgttagaaaccatgtatgctttggtacagtatcctagatagaagatctagtatgctgtattcttcggttgggactgcacccagagagtacaccctgcccccttgcatgaacccagggcctcgtgcatgccaagaaaacgctctaccactaacctccatcctcaacataactgcatttcagacaagctctacatcagtggttctcacccttcctaatgctgtcacccttctatacagttcttagtgtgttgaccccaactgtattagtcagagttctctagagtcacagaacttatggaatgtctctatatattaagggaatttgtcgtgatgacttacaatctgtagtccaactccccaacaatgggcagctgtgattgggaagtccaaggatctagtagttgctcagtcccatggggctagttgtttcagctggtcttctgtagaagctggaatcctgaagacgtcgattccaacagatgtgctggcaagtaaatgcaagcaggcaagaagggcaaatcttcctttttccaatgtccttatgtagatctctagtagaagctgtgtcccagattaaaggtgtgtaccatcatgcctggatctgggacttgttttgtcctaggctgaccttgaattcagagatctccttgctttagtctccagggaataaaggtgtatactaccttgcctgggcctcaacttatcatggccactttgtctcaagatctccatgccaagatccaggtcagaaacttgtgtcttgcagcctcaagatctggatcacaggtgagccctcccattctggattgtagttcatcccagatatagtcaagttgacaaccaggaatagccattacaccaaccataaaattatttcgttgctgcgttataactgtaattttgctgcattatgaattataatgtaaatatctgatatgcagacccaaggggtcaagacccacaggtggagaaccaatcccctaggtgatgctgatgaggctcatctccagagcgcactcttaagtaacaagagcttcgtgatttccactcaagcccgagattctgaccccactgaagaatcccaagaaacccacctcttcactgtgctccctcaagcagactctttcctgtgagaagtagcattgaggaacagttactctcgtagctgtcacggtgaaaagcagctttgccaaggggaggacagcaccattttcacactggtcctggatacagctgtccacaaccagatgcctaacaaccatctccctgtcactaaggatgagaagtccaacgcctcaggctccctcgtaatcactgagttgattacattataggcactgtgtaccctacagtgctgtcctcgatgatctaaaaggcatgagggttgatgggcagatcttccatctagactatccgtgatgttggcatcgaaagctcacatccttggctcagtgtccacactatcaatacttactgggctggggagatggtccagtggagacagcacttgttgtgctagcactaggttccagagttcaggtccccagaattcaaaaatgccccatggtagctgcctataatccctatacttagaaggcagagggtagaggatccctgagcaagacggctacctatattaggtatctcagcaagctctgagttaaactgaattaaacttacctttatgaatcatgtggagaatgattgaggaaggctctgatgtcaactgaaagccatgtctatgtgtgcaaatgcctgtacacccatgcacattcaaatgtgtgtacatgcactgctgatgtacataaaataaatgaatatatatatatacatacatatatatatatatatacatacacacacacacacacacacatacataggccctcacccctaccacaaagagaaaatctccagtagtaaaaactaccaaagaaactgcctgacttctcagacaagagaccattttctcttcaagctatcttaaaactgccctcctagaatcttctgaggtctcaacaagaactttggtcaggtgatcaagttctagtcacatcacatcaaggaacaaaaagagaataggtacatcagccaatgcaggaagtccccattgagactcttcccgggtcactctaggctgtatcacattgacattaaatctaaccatcccagataccacatcagagaatatgtggttcatgagtctcttgcaagatctaagatctcatttctcaactagtaagcacattaagtagaacacagaatagccacacaatggaatactactcagcaaaaaaaaaaaaaaaaaaaaaaaaaaaaaaaaagtgaacaagttatcaccacgtgccataacaggcatgaacccagaagatggcagcttaggttaaaagaagacaggcaggatggaggcactgttgcatggctcccttcatactgaaattccagtgaggacaatcaaagacgtttgcctggagatggagatgggagtgaggtgaagtttaagcagaaacacaaaagaactttgggatataattgaaatactctgaaactggatctttgggacggctgcagaaatctacagatttactaacattcattgagtttgctttggggcaaggaagttgtctcataagtagagcacttgagatacaagcaggaggacctgagttcaaatctccagtgcctctggggggaaaaaaaaacccttagtgtagtggccactgtctataatctcagtgctggggatgcagagacaggtggaccccttgggctcactggccagtcagcatccctgagttgatgagctccaggttcagtgagtgagcttgtctcaaaaaaaatgaggtagagagcaaaggagacacctgatactgtcctctggctaccgcacacacatacacatgatcatgtatctgtccctgtccctcccccccacacacacacacacacactcacacacaacgaaatgatcattgagaaagatccacagtatagatctgtggtattcaaccccacatgcgcaggtatgtgcatctaaacacatacatttgaacaagaccatgtagaccatgtgtgtgtgcacacacagaaagagagagacacagagaaatgggggtgaatattatgctttaactgggcagagtggaacacaactcacttgggaggctgagggaaaatgatgaagagtttgaggtaagtttgagatacaatgagatatggtattaaaaaatattaaagtgacagtgattgacgtcaaccagttcacgctggctttatggtaggtggatccatcttcaagagcatcacataggatggcaataaggaaaccccaggcaaaagacaccagtgctgtagactgagatgctgctagacattatatgacataacagcaatcattctccacatcctgaaaacaccctcacggctgtgatttttatcagtgtggggtgtccaaatgaacaaaagctctcaaaactgctgccagctactgacaccccaaaagggaatcccagaagctcacagcctttgttggagacccagcctcacctttgcgtggctctaggctgttgtggagacagggaggggtacttatgtgaactggtggctgttaccagggaaggggggttgctgcggggcttggggtggttagttctaagacaaaaacaacagtaacatgtcatgatgtgaactgatgtgttctcagttgtgctgtgtgtggcgggaggagttctcacagtgagtgaaaggccaagaggaaatggcccaagaacaaaagaggaggcagaaaaggcccattctggaatgcatggtgtcagttcagggaggtggcttagtgtacctggctactgtctgattgtttaattcacactaacttagctgaatggaaagcaagtctaatctactgataacaagagtgcttcttttatatacaaactaagtttgttcacctctgtcaagcattccttcatgtttttacccaagactagctcaaaagacaattatctctccatccagaactggatggtgttcaggcactcacacaaaaaaagctgagacatactatatgtctgctggaatgaaaaccatcatcacaatgtattttaaagttacttcttgcatgtccgtgaaacattttttcgttgttcagtgatttgtatttcctctttcttctccttcgggaatgtctaatcaaggcaggctcttgggaagccaaggaaagggtttgtaaattagcataaacctagcacatgagaagctgaggctggcgtatcatcatgaactcgaggccagtctgggctacatagtttcagatcagcaaaaagaaaaattagggtcagagggatggctcagttgttaagagcactgtctgcttttcaaatgaacaggatccatttctcagagtctacgtggcagctaataacagtctctaaccccagtcccaggagatccgactccctccaagggtacatagtacagagacatgcacataggcaacatacccatacccattaacttaaaataaacaaaggttttgatgtgtgaaccataagcccaatcacagagctttagcccctgaatcatctagcctcagaatgtaagcagacttcaactagaggcaaaacacatctttagacgatggtccttgggctagggttgtagctagctcacatgtactcctggagaacttggacccatggtcaagggcaatgtgaggagttaaactgtcatcagagatggaacaagcttgtgaagagactgtcgttgtccactaggaagtgtcatcttcgctgttcacctgcatgtgccagttccgtaagcaattacacacagagccctgagctcgttggcac

SEQ ID NO: 1874 - DNA, 1791 bp, Mus musculus
cctaacagcaggaacgaatttcatacacgcccccagagagtccagtggcaagccaccgttcctcgactccgcttcatgttcacacagtgcctcgagcgctcaggatggaggaagactcgatccacctgccaacacacctgcgtgagtgtttaccttcgaggaggtggaagttgggaaggggaaggtttgcagccgatttactggagcagagatgacgtagcccagtggctcaagtgggcagaaaatgagttttctttaaggcccattgagagcaacaagttcgaaatgaatggcaaggccctcctgctgctgaccaaagaggatttccgctaccgatctcctcattcaggcgatgtgctctatgaactccttcagcatatcctgaagcagaggaaatctcgaatgctcttctcaccattcttcccccctggggattctatccacaccaagccagaggtcctcctgcatcagaaccatgacgaagataactgtgtccagaggacacccaggacgccagcggagagcgtgcaccacaaccctcccaccatcgaactcttacatcgccctaggtcacccatcaccacaaaccacaggccttctcctgaccccgaacagcagcggccccagcggtcccccctagacaacatgagccgccgcctctcaccagtggagaaagcccaggggcccaggctacagcaggagaacaaccaccaggaaacgtaccccctgtcagtgtctcctgtcgagaataatcactgcctgccctcaagcccctggcaggagagcactcgagtgatccagctgatgcccagccccatcatgcaccctttgatcctgaacccccggcactcgcactcggtggacttcaaacagtcccggcactccgaggatgggatgaatcgggaagggaagcccatcaacctgtctcatcgggaggacctggcttacttgaaccacatcatggtctctatgtccccaccggaagagcacgccatgcccattgggagaatagcagactgtagactgctttgggattatgtctatcagttgctgtctgacagccggtacgaaaacttcatccgatgggaggacaaagaatccaaaatattccggatagtggatcccaacggactggctcgactctggggaaaccataagaacagaacaaacatgacctatgagaaaatgtccagagccctgcgccactactacaaactaaacattatcaggaaggagcccggacaaaggcttttgttcaggttcatgaaaaccccagatgagatcatgagtggccggacagaccgtctagaacacctcgagtctcaagtgctggatgaacaaacgtaccaagaggatgaacctaccatagcctcaccggtgggctggccaagaggaaacctgcccacggggaccgcaggaggcgtgatggaagcaggcgagctaggggtggctgtaaaggaagagacccgggaatagcagggacacttctcctgccgatcaagagggacccagagcaccttagacaagccaccgagcaatggcagggctgaagttctggcggagggcacaagcctgagactcacacgtcacgttcgcttctccttctgatctcttgtctgtaactctcaccctctcccttcccctgcacctgttgtagtctcatggtgtttctggtttcgttttttgtttttgttttttaagaacatgcagtttgactattcattgttcatacagggaagacatcacatgttgttttcctatggaaatatatctattatatatatattatta

SEQ ID NO: 1875 - protein, 491 aa, Mus musculus
PNSRNEFHTRPQRVQWQATVPRLRFMFTQCLERSGWRKTRSTCQHTCVSVYLRGGGSWEGEGLQPIYWSRDDVAQWLKWAENEFSLRPIESNKFEMNGKALLLLTKEDFRYRSPHSGDVLYELLQHILKQRKSRMLFSPFFPPGDSIHTKPEVLLHQNHDEDNCVQRTPRTPAESVHHNPPTIELLHRPRSPITTNHRPSPDPEQQRPQRSPLDNMSRRLSPVEKAQGPRLQQENNHQETYPLSVSPVENNHCLPSSPWQESTRVIQLMPSPIMHPLILNPRHSHSVDFKQSRHSEDGMNREGKPINLSHREDLAYLNHIMVSMSPPEEHAMPIGRIADCRLLWDYVYQLLSDSRYENFIRWEDKESKIFRIVDPNGLARLWGNHKNRTNMTYEKMSRALRHYYKLNIIRKEPGQRLLFRFMKTPDEIMSGRTDRLEHLESQVLDEQTYQEDEPTIASPVGWPRGNLPTGTAGGVMEAGELGVAVKEETRE

SEQ ID NO: 1876 - DNA, 72083 bp, Homo sapiens
gtcatgcaccttccaagaatgcttgctccagcttctgcagctccagggagctgctgaaagtattttggtcttctggagacacgggacaaagtacaactcatctactatccagtccttgtcctacccaaccccccaaaatgcattgagcacttgctctgtaccaggcactgtgcaacatctctatagggatcacctcatttcatgctcacatttgccctaagaggtaagtactattctggactccatcttaccgctggagaaacagattcagacgcataactaacccagcgctagtaagtggtgcagccggtgttttaacccaggacaatttgactgcgaaacccaaggtctgatctaaaatgctacatggctctcaccacattgggcttgctacccagaagcaaaaatgagaagaactcttctaagtcacgtttgtgaggctgagcggcaagctctgggtcagttttgctgtcaacaggttttctgctaaaaacccgtttgtagctaaaactagataaaagtcagaaaaatccacaaaatgaagtttataagaaaaaacatcattcgagggaattgactgtgactttggatctgaacatgaacatagagtgttcttgttcttggactttgggctgaaagacatgagtataaccttccgacctccacttggaaacttagtgctgagatacaggctaaccttgaggacagaaataggaaatgttttggaacttccaattccctagtgacaggatttgtttgcagaaagcagctttggtcagatagcacattcaagattacaggcagacccagaggagtgagatgtggagcttgtcagaatgcatccaaggctggcctgggggttttgagcagatttgcagagagcaggccggtggggaagggaaaggaggcagaaaagtctccggaaaagtgcctctgggaagcagcttgaagggctctgaggacacttggttttcttttgaagggcagagtacacagggaagaactctaagtaaaccctgccctcggcaagcagaggtcagaaggtgctctgtgggcaccgagcagtattcgggatctgcagctagaccaggcctgccatgagaagttgagtttatggtttattattcctcattcccttaacatttttacagtgcattttagagtgcaaggggcttttacatccattatttcctttaacccaggggaagttcactgggtaatacagaaagcctggagctggagttttggtcttaggttcattgtgaccttgggaaagtccctcgatttctgaacttcagtttcttctgaaaatacagttgtgccagctttagctccctcgcagaatagatgatggcatgacatggatgcggaagcatctggtaatgttttgaactgcacagagctgagtgtcctgaccatcaaagccagagctggagtaagtgatcagatgtgtcggggaggagaggggtgccaatcacagactgcagagctggctcagatgtggactgcctaggaatggaaatctttggctgtacagtctggcattaaacctggggactgttatgtgccaggcaccgtgtgcaaatcactgcaaaatccccttcagctacatgcatggacatgttaactcttaacacatgtacctaacaattcacaatttcatctcccagaaggtggaagatgcattgaggagcattgctaatttgcactcaaatctgacaaatgaggaattgtctggaaaagtagaaatgatagcagagggtgagaataaaaacatgattttaggattggggaagggaaatgagagacaagaacagatgtgttttcttgacttaagacaaatttttaaaatgtagggaaaagtatttatgatctcatgatctgaatgctgagacacaactcagagtcatttgggctgctcttgaaaatgaaatcctgacttatcaactgcatatgacccttattggaataagaaggaagggagacaactaaagaaactgatgaggcgatattggggatattctctgattagctcaatttttaaatagtttgtgtgtgtgtgtgtctgtgtctgtgtgtgtctgtgtgtgtgtttgtttgttttgaaatagagtctcactctgttgcccaggctggagtgcagtggtgcaatctcggctcactgcaaactccacctcttgggttcaagcaattctcttgcctcagcttcccaagtagctgggattacaggcgcctgccaccatgcccagctaatttttgtatttcagtagagacagtgtttcaccgtgttggccaggctggtctcaaactcctgacctcaagcaatccaccggccttggcctcccaaagtgctgggattacaggtgtgagccaccacacccagcccttaaatagttttttaaatataaaagtaaaacatgcttaatagagaatgagaaataagaaagaaaaaaggaaaaggagacagggaatatcacctacaattttactgagtgtcaattctttgaatatttttacgtttcattgtatttttctatgcattgagattattacatatgtacacatactatttttcaatatgaatacatactcttcatcatgttactggctgcattaattttctatcatagatattgtcagtaactattacttatttccttattgctgttcctagtttttcattattaaaaataacactgcaatagacatctttgtgcatgaaagattcttccacatactaagttatttctttaaggtagattctgagaagttaacatttacagggttcttaaaatatcactaagttgtttgccagagagatgatgccaatttatcttctcactgttttgtgagtaccagtctaatgagctccgatttttaaaaagatgtatataatggatgaaaaagcaacttaatgaaaagaaacatataaaggagagtttctgagctctagaattttaaaacgtaagtgagctgaaaaccatggaatacgcttaagaaaacaataaatgtgggcagcaggataagaataagcatgatgtcagcctgctgatggggttggatggggtaacatcagcaaatggcaaagaaaccaaaactgttcaacttctttctctctcccatgaaggagaatgattgtcagactgaaacaggtagtgcaaacattgacagaagggaattgaagcctgagatgggtgaattgattgtaaaagcaaactaagttctgaataaatgcaaggctcttggcccggacaaatgacatcccagggtcgagaactcagaggggtgaaagataagccactggcagtgatccttcagggttgtgggaaatggaagctgtactaaaagaataggaactgttggtaacctgattttaggaagagaagctggggaaaatgtgggtacgaaataaaacagctaacctgatggaacttccagataaaattcaggacagattttcaaacatacatgttacgagtggaagacattatcactttggagccagccatctgctcctcatcctctctcctcatcttctttaataaggttgctctaagtgttgtagttgctgtatttcaggatatcaggaaggcgtttcgttgaatttctgatgttgctttcatggatgagcttggaaaatgtccaaaaaccagagtatttagatggattgatcattgaacaactcttcccaaaaggagtcaataacttgatcagtatccgtccaaaaggaggtgactggtgtgtcaccagggtactcccatctcagccctatacgatctgcactttgtcagtaacctgtggaggtgacagatgcttagcaaagccacagatgacgtgaaattacagagtatagatgctagaaatcgatggaaatctggagaagactgcagcaggctgggatgatggttaaaaataataagataaaatgtaatatcaattaatatacattcttacagttgggttccaagtgctagctatatatgttcaggtagggtgagattataaaggtgattataacaataacagtacaaaagcaatagctaatgttttttaagtgattgctctatgccagatattggcctgtgtgtttcatatcatcatcatgtgtataattttactctacactagttttatgtcatctgaaaattgtataagtacattatctatgattcaatgatatttaattcacaggatgaaagttgtcctcatttttcagttgacaccagcaagacacagagaggttaagtaacttgtacaaggtcacacagctgggaaatagaggttccatgcttgtgctcagtgcctgcatgctgaactaccgtgaaactttttctttttaaaatttagtcataaatttaatttgatatcctgccaaaacaccaaataagcttagagagttaggtagtttttaacgtgggctcggagccaggtcacctggattcaaatgtcagctcttccatttcctggctgagtgactttgggcaagtcgtttaacttccctgtgttctagttttctcctccataaatggggatcattcctgtcttacaggattgctgcagggattaaatgagttacatatgcaaagcatttagaatgactcctggcacatagcaatcacttgcttacaagtaagtgcattgctgttattaggctacacaaaaagcactatggtggggtgttaagagttgacactgtagagctagaccacctggatctctgtcatggcaccaccacttccatctctgtgtgctacagttttctcatctgtaaaaaaagaataataatcattgcagtgataagattcagtgtaaatgttcagtaattgctagctgttactatcaatagaagtatattgtccagagaaagaaaaatgctagtcctgttcctactgctgcgtttaggaattgaagccacatagatctctggaggaggcaggcaggttggtaagggtctacaaactgcagtggaggagttatctttggaccaattaaggacgtttcatctggaggcaaaatgactaagcaaggacgtgataactgtcctcactgtgttgagggttacaaaattggtgtgggtcattgaatcaagttatgagacaacatgggatgttgggaaaagtcaggggatcaggggcaggttgatcctgagtcagtctcttaacttccaggcttcagcttccatctttcacattttatgattctgtctccagcacgtagaacctagagcaaattcctgtttatacagaaagtttggataaagagtggttttgctgaatggctactgtagcagaaaagcttgaactgagtgttgctcaaatcaataaaatcacctgatgactaagccctgttttctattaaactgaaaagagaatgcaacagacttcactgggcttttgtgagaattacatgaggtaatatgtatgaaagcaccttatcaactctgaagtactaccccgatgcaagcagttatgttgattattgccatagctagattataacttttccaagaattagaatataatgaaacacacttaagcattaatctgtcttctgtgattcagaagatccttcaggaagttacaaaatctcagggtcatggccatgggcatggagtaattctgtagaaaaagatcctggctgtaaggtattctttggttttttggattcaaattaaataggagcatattgactacatgaaaccctgaagggaatagagatcacatactctaagcccgtcattgtacagatgaagtcactgagccacagagaagctgagtggcctgcccagaatcaaatgttaattcatggcagatctgggaataaaatccaggctcctgtctcccaacatgtttgtcatcattagtttaagaacatctcagaaagtctgaaacagggtcaaaatgtactgatgaatgtggctgcccattaaagcatggaattgaagaaatattagaagtaagtttaagggcctgggtgtgtcactgaaggatatgacacaatatactggacctactcgggagaggggagaagtacagtagaatttttagtaactttcttaatcacagcagttcactttctctgtacaaaattcttttcaaatattctctgaaactaattggcattaaaaatgctgatcttagtaaatggccctcaagaggcacgctatgcgcacagggaatagtataatataggtgcagagtaatggtctctctccttctctcctttttttccttttcctaatgatcattaacatctatattctttgactttgttgaattaaagttgcaagagatggccgtaaataaagcaagttatgtatgtgcctccctcattctgcccatgcagcttctgttccatttgcagctgtgagccgtgtaagactctcaagaccaagcacccatgagtgcctgggagcaagtagcctgtgaagggaggactttattcctggatgcattaaaagcagagtcccacctacacctccctcctcttcccatttataaatctacttctccagggatctacagattttttggctatatttttagtctgttgataatttgagaaagtctccaaggatctaagtcttggatgggtaggagtcaattcactcagtcttttttgaatccctaatggatgttcaaaaccagtctcaattctggatctggatgggacatgcatgtcgaagtacagtgtgatggataagagcacagattctggaaccagattgcctgggttcagatctccgcttctgtcattactagggttatgtgaccttgggcaagtcccttaaatgcgttgggcctcagtttcctaatctgaatccctatcatagggttgtgtgagcatgcagttgaatgagctaatatctattcatataaagtgcttagagcagtactaggtgcatagtagtgcttagtaaatgactattaagtaaattaaatcagcctgattagaattgcctccaggtgcaaggctctatcccatttagacacgctaacacacaaggtcttaagggctttaggtttaaggaaaaggggctttttcccccctcaattctacaccacaacctttttattctattgaattacaaaggaaataacagtgggacttgactttgaacaccaaagtttatccagcctctttccagctcggtgaacgtgtccacctacttcactctttatgctaaaggaagagcagcgacgctgataaatgtattgagtggcctcgagcaggtggcttgctctgtcaagatcacttttgtatgactgctgggatcaccacagtctcccctgtaacttgctgggttcctcttgtacataagccgagggcatttgcatcggttcctggtgagggggtttccacacggtggccctggttgcttcaggggctgggctgtgggagacattaatgggaagtgaaaagagaaactgttgtgcttaaccggcagagctgtttggagtgtgactcttcttgtatttagggaaaagattactcatgagtattttcttccatagaatataaagaacctcaaattactacttgcatcccccacccccttctcacccacctccctccgttgcagcgtgtcctctgcagaaacttcagcattttactctcaattcccctcccaagcaggattcagttctgtatttgctttggggcccatgtttccaataagccaccctgtactttttcctgtttctgcctgagcatcttctgctcactggacctctcacctccaggcaccttcctaggcctgaggaaccagaccttcacatgtgtcccctaatgggaactccctgtgtgaaggagaggaaggtccataataacaaatcgcagcgccattcttgttcaaaggtgacaccattgacagtaaggagttaggtttaaggtttttaccagttcaaaaactgagattttgctgagtaaccctcactgccactcccacctccctgtgattctagatacgtgttttcaaggtcattggagagagctggtacttcccatatccatggactgtttttaataggcatcactttctggccagtcaggagtcaaaaacaaaaacttttagtggctgtattttattctaaagatcataaagcagtaatgcaccataaattattatttgaaattctaatttgtttccatgtgaaaaaaaaattatcctaaaaacaccaagaaaaaagctcttaaatgctcatctctaatgatttccagtgcccagtagttctttttttggtgcactacaaaaaaggaattttggttttgaggggacttccacaggtttagaggaagccaactaccattcctcaaaactacactttgcaaaggagccacttggaagacaatcatgcccagaggccctggacattttccagggcatttgagccgtttgttccccacttcagcaggtaggaagagcagccccatatagcaaaccagattgttctttggcatgcctggtttaggatgaaaggtaattttttccaggatcaaactgagggacacttttataacacacttgtgaagtcttcgtagcaagtttaagtaacttatagtgagagacggaagctcctcttagcaacactgatgccattgctctgtttgagctattgattcacaccatgtgattttagagaatgaagatccattgaacatccagcttcttctgacccagcagttcttaaatttggtctcatgtctccttttgattcttaaaaattaatggagaccccaaagagcttttgcttatatgggttatagttatctgtagttaccatattattacataaattaaacctgggtatttacaaaatatttatgaatttagcaagtaaaatagccaactctatattaatgcaaacatattttaaaatatattttcccaaaccaaaaataatttgtgagaagagtagcattgttacacatttttgaaagtctcttaaaatctggcttaatggaagatggctggacgctcatctctgtttctgcattcaatctgttgcaagatcacatcatatgccttctagaacattccacctaagaaagaatgagagcgaaaaaggcaaataattaatattgttatgacaagatgttttacttcataggcaccctacaaaggtctcgggaaccctgatgggtcccaagatcacattttgagaaccactgttctaacttatcaaagatttctcacaacagcaaaataaaataaaactatagacttacagtcaggctcccagagagccaacctgagccaacctctcagcccctgctctgtacccccctcctgcccacttggttcctactcagagttcaagtaccaccccaccaggaagctctaatgtcagtgagtagaataaaaaggcagaagaccttttatccttactttgccctcttattgccagaggccagcctgatggtttcccagaggctgagtgaattgctcttcctggaagaagtttcagggaacatttcattatttggcagctctggaaggtcaagctcagctctggaacattctttcttcagaaggacgctgggctgcaatcagatcagctctgaatctgaggaccctccaaccacactgacacgtgtcatagttctgagcccctgtgggtgctgtgggcaccctggaacagcccctggaactgggcaaggaagggcaggtctctaagacctaccatcccttaaacacataaaagatctttttctcattttgcctctaaataaaaagttaatctgacagcacaccccagagtagggtttggtgtacaaactgctccctggactcctcttggaggctgcttctgggcttcgagaagcccccagtggggcggctcaaacaagggctggagaggggactcagagttgaacataagggctcttgagatgtggagactcattttgttaactattcagagaccttctccctttattccagctgtctaactgacaagacctttctctctttctttctgcctcatgctctctccaacaggcttgcagccaatttactggagcagggatgacgtagcccagtggctcaagtgggctgaaaatgagttttctttaaggccaattgacagcaacacgtttgaaatgaatggcaaagctctcctgctgctgaccaaagaggactttcgctatcgatctcctcattcaggtgagagtctggactcttggcatatgcccaacttggaaagtctcttagttagtggttggtctttaacacccctcacccggcccaagaaatcccaacagtgagtcatcacaaggaagggatgacgatggaaggaagttgaaggaagattatgctagcatgagccagtttgagggaagaagaggaagtgtttacagaccaagggggagaattttaagtttaggagaggaacccagtttagtcctacgtacactggaacttaagggctctaactgtgccactaagaagaaaaagaaggctggccgtggtggctcactcctataatcccagcactttgggaggccaaggagggtgaattgcttgagcccaggagtttgagaccagcctgggcaatgtggcaaaacctcatctctacagaaattttaaaaattagctgagtgtggtggtgtacacctgtagtcccagctactcaagaggctgaggtgggaggattgcttgagccaaagaggtggaggctgcagtgagctgagattgcaccactgcactccagcccaggtgacagagcgagaacctgtctcagaaaaagaaaaaaatgccattttggccttttgactctctaaaagagatagctgagagtgaatgcaggctgtgaactgctcaaccgaaaacaaagagaggaaggagaaggacgtagaagggctagaaaagaaaatagaactgggggaactgcagataaagactgggaaatgggagatcctagtagccaaggccagtttagaaaggcttcaagtggtttcccttagaagtaggactcgtttgaggtaatgcatcttgtagcctgtagaaatcctaaaaaatacaagcagaggtctcctcgggctcatctgactcagaaagcttgtctaattaagggctcctgataatgcattagaagatttccattcagtaacaagcatctctacctgcagagtgtattgctcatgtggataaggcttcaaagatttgtctcagtttcatttcctaaaccctgtggatatttagaaggtacctgtctgggaactacatatgtcaaaggggaactgtggtctcaggtttatgcctcttgcgggattaattactgaagtactcaaggccctccttttactgaatcccactgcagacctcgactctgatgtaacttgacaaagggcgaggatcctgcagaaggtcttggcatagtccctaactacgttcaacctttatttactcctggagacctgccagaagttaataaactaaccgtcatgaggaaacgtccctcattacaggagatgagataaagccccagcacccgtatctccactgttcttcccagttgccacagaccgtttatatgaagaaatgctaaagaagttccccagaagtagagatgttattgaaacttgaaagtttatatcttcaaaattgagtaatttggaagggacacaaacatacctgaaacattttgtctcatatcatcaattctgtatgtaatctcacaataagaaaactataaaacaaccatgtaaataaatcagactatcctaaatagttcttttgaatttattacaaaatacttcccttttctattccagtggaaactcagagatattatactcaaagaggcaacgttatatatctggaggaaaaatccctacctctttgtgttccaatgaaaccattcatgtaaagcaagcaaaggaaaatacagtggtgggttttgacttgatttgacttggaccttgggcaagctttcctcccaagtctctataaatttccccttcatcctatctcaggtgcacttttttatagctggtttattttcctccacagtgacctcttagcattatttgtgaaactgggttctctctgctcagagctatgaacaaagatacgtgaaaatctgtccgcagttccttgccactttgtcgagtctttgtcaggtgggccatgtggaagatggtgctgctctcaaggaagttactgtccagttagaggcaggattgcgttgatctaaaaggccaaagaaggctggaggagggagagagcagagtagcactggtgtcgggagagaaggaatggagttggtttggaccatgaagaatgggtgggattgagtaggcagagggtaattggaacagcatcaccaagtatatttgggtgatggtgagaatgcccacctgatgagtagaagaggcagaaaaggcaggaagccctgataagcctgatgcactagaatggatgtgaggtgctatatagatcagttaggaggtggcaatagaaattcattccatgagtattcaccaagcaactctatgccagaggtacacaggtacaggctaagggagttcagagattagaggggccatttctagctggcttgtcgaacaaacctcatagacaaggtaatggagcctgactttgaaaactttgaaaggcaaacaagaaggagatgaggaagcatgttaagaaggagatgtaggccgggcgcggtggctcacgcctgtaatcccagcactttgggaggccgaggcgggcggatcacgaggtcaggagatcgagaccatcccggctaaaacggtgaaaccccgtctctcctaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaagaagaagaaggagatgtaggctggtgtacatggaagaggaattcagagacaagactgcacgtgctagacactccctttgaaacatggtcgaacatcactcaccatgcctctccggcttgtctgattgcctcctcacatttcaaactggtggactgtctcctggaaggcttctcttgactcccatccctacttccctaattccattccactttcctttctcccatcttgttctacctccatctaggctaggtgctgtttctcctttatcttagagcattctttccctctgtcatggcccttgacacagatacacacacacacacacacacacacacacacacagtgttatacattgtttgctgattgtttgctactccggatccctcccctagagtggaaagttcaatgtgggcagtgattgtgttctattaagtcgccaagtctccagtacctaacaccagggcatggcttccaggtggcactcaacaaatgtaggttgaatgatgacccggtttgagagtacccaggttaagaagtttgggttttattttacaggtaattggaaccactggaaagttttgatcagggaaatatgattggagctctctttttgcaacagacattttccaccagtgcgtagggtagattcattggcttacttaaagcaggaaagctagttagagtgtccttgctgtgatcctaatgggaggcagtgaagcccagactggatcagtgagatcaaaataatactcaggcacaaagtggctagctaagatggggagctgacttggaagtagtggttagagttcatttttaaagcaagcaatgccaggacattcaagaaaacttgtcctgatctgcagttggacatctaaaacaagaggcaggccagggctgggaataatagatgtgagcatcatacatcgtctccattatgtagaattttatgagctggggataaagataaatttatacggaaggtaatttaattaaggcacccactagaaagccatggacagaatttcaaggcgatgcctgccagcagggcctgtaggaaaacttaccacagaacacaggagtattgcgaatgggtttataagacaactaagttggagttgagaagacccatctgatgaaggggtcactcagcaagagggggaaggccacaggcatcctccttaggcaggggcaagatctagattgaaaatcctttttattttccagatgtaacatttgccactgtttcttctgacatgggctttctcctttagcagtttggtgtagtgaaagtcctcaggcctggcttctttctacacctggcccttcacaaatcacgtcacttcacttggccttattttcctcatccacaaaatgcagttctcaccacatggatcctaagctcccttccattcttaacagttcagcccaacttcaacactgaaacagtgttaagttgctagcaaacaatgtagctttctatgctctctatatatggaaacaacattctttaacacaactcctctccaatgtagagaggagagcactggactcaatgagttataattacctggaatacgattataccttaagtcaaatacagtagactccctgaatgccatattctttgaccagcttaacaaatttatcgcatctacttccaggacaagaatcctccattttcaacccctaggataaagcagggaacatttgcagtgtgctttaaataattatatggtctctaaccagaagatttcaaggttggagacaaatggaatattttctttggaatagtctcccagttggaggatataacagatgacaagtttataacatttgtaaagttaaagaataaatggaagggatcccaattttataaaacgtcacctggacagaataattttacaaagaccttgggctactagatagttatcacattaactggttctgaagtgatttaaattcagagaggtatttgagtacttgactactttgagactctgagaaaacacattgacaggagggaacagacaggttggcatttatattaacccttacttagggttatccattgcatgacattcaggtggaatggatttaggtacccattattttctccgaacaaggaaacccacaagttattatcaatttaattcatgttacactcacttgctatcaatgctaaaaaagggaaagaaacatatgttcagagttccttcaattcagcaaaactgtattggggatttgctaaatatattgaggattttagtagactaaaatctgcagtcttttcatatactagagtgtgattttgcaaattgtttcttccctttccaacccaccagaacctttgtctttggaaatatgctttgcttatatttttcaaatatagtaaaattttctttcaaagttaaactgaaaatactggtctttacatagtatttcttgaatcaaaattggcctattaatttctattaagcaatggtaggtttgccagattgaagggctgtgtcaactggctattttagaattaagtcagagcatccaaggatataggtcacagaagggaaattgtagccatgaaatgtgggagttgtagcaggcatgacccttgtctgaagacaccagagttggctctttctttactgtgtctttgagcaagccaaaaaaaaaaaaaaagtgtatcacacatcagagaaatgcttcgataggtcacttacgtgaaagtcattttatttcttttcttttttttttttagatggattctcgctctgtcgccaggctggagtgcagtgccgtgatctcggctcactgcaacctccgcctccagggttcaagcaattctcctgcctcagcctcctgagtagctgggactacaggcgtgcgccacaacacccagctaatttttgtattttagtagagatgaggtttcaccgtgttggccaggatgatctcaatctcttgacctcatgatctacccactttggcctcccaaagtgctaggattacaggcgtgagctactgcacccggccatcattttatttcttagctctttgcctgtcccatttgtgaaatggaggtgggcacccaccctgttgtcatatacttgaaaaatgcaagttttagcaatgttaaggttctactttaaacttactaaacttaagaagttaaaagttggagagacctaggtagccttgcagatgacgctaaacattggttatacaagttgatgtgatggtaacgtagggaaaaccaactgcacagtgcttcctttaaacacatacttatttcataaagttctgttttctcgagagcttattttgtttatctcaccttatagtccatatccagctgtaattgtcttactgtatctgttttctaacagatttattcttgtcttaaatatgatacttaaattttcccacaacctgttccttttttctcagggtctctgtgtataagacataaatattaaaccaaatttcaaatatttgttgctaagtaaaagactaatttatttttgtggtcacagaaggcactccagattaaattaaaaggttaattcaattggcctgcaaaaatgcactgaatggaatgcttagaaactaggaccaggctgggtgcagtggctcacacctgtaatcccagcacttaaggaggccaaggcgggcagatcacggggtcaggagatcaagaccatcctggctaatatggtgaaacctcatctctaccaaaaatgcaaaaaatcagccgggcgtggtggcacgcacctgtattcccagctactcaggaggctgaggcaggagaatcgcttgaacccaggaggcggaggttgcagtgagccgagatcacgccattgctctccagcctgggcaacagagtgagactccgtctcaaaaaaaaaaaaaagaaaaaagaaactaggaccaagcagagttagaaaaccaagcagtcccattacaggaatgggcatgttatgcactggtgttttcactgttgaatttattatgtaacttaagggaccgaagcttagggcttcatcctgaacccatcaaaggcagaaagggcccaacagagagaacattctgacatatctaaaaagtacctctcccacaccaggcatactcttactttaaaaaaaaaaaaatggccagagggaatctgaagcctctgaataaaaatcaaagagaagagagagctgtttgcaaattaaagaatgtgttacttagataatctacgtgtaaggatatgtacatagcaaatcatcacctgaaaaatgcagattttaacaatgttagggttctactttaaacctgctaaacttgagaagttaaaagttgcaaaaccccctgggagaggctctaggtagcattgcagatgatgcgaaacattgattccagccttctgagaacaagtagcgtataataagaacgtttaaactaatcatacactttcactgataattctattcctaagcaaatagccgaaggaaaccatccaagagtgggcaaaaaaaaaaagatgcccttaacaattctatttatagtagttaaaaactggaaattccccaaccacccccactgtgggactagctaaacaaacttggggagagtaaatatcatgggatacacggtagcctcacagccattcattcactcactcactgattattttttcagtagattttgcagggctctgcaggtcatgttcaggattttacatgtttgtttgaagacaagtagaagccatttgttttttgttgtttgtttgtttttgtttgttttgttttgttttgagatggagtctcgctctgtcgcccaggctggagtgcagtggcacgatcttggctcactgcaaggtccaccttccgggttcacgccattctcctgcctcagcctcccgagtagctgggactacaggcagaggatcggcatggcaaggtgcggcggtgaaaagtggaggcggggcatctgttgggctgcagtctacgagcaatagttgtgacattaactaaggtgaggcccactgagagacgaggtggttccagaaacagataaaaggcagagtctgcaggtcttggtgaccactttcatgtgagatgagaaggaagagaggccttaacgattactcccaggtttctggtctgatcatctgagcatttgctgacctaagaaacaccatctcatctgtagagatgtttgtgttaggcacatcaaatgtgtggtgcctatatgacctccaggaggaattacttaggagatcacggaatgtggttctggagttcagaagaagtgccaggctggagtagatttagcatagacgagccgattgaagccatgggagtagatgaggttgcccaagaagaagggcaggtgagagacctggggaaccttactactgaagggctggagaaggaggaagagcagagaagtaggcggaaaaccaggataagtggaaatctctgaagccatggagtattctaagagaagggaagtagagattgctggtgagaatgttgttgagaagtcaggcagttccctgagtaccaaccattgccctttggatttgacaacagggaggtgacctgagcaaaagcagattggagaagggtgggagtgggaaccagaatggaaggtgaggaagtggtgagaatggtgttggacagctcccctgggaagtttggctataaagggaggagagaaacaggagcagttcctaacagggaggatggggacaaggggcatgtacatgtggacaggaaaaaaacttgaaactgcttaaaagctaaagggaagaaacccaatagaagaagttggcaatacgactgcaaatggggacagtaagagctaactgtaaactggaaatgtctgtatgaaatgatgtcaactggggaaaaaaattccatccatatgaatgtgactttgtaaaacttacgcatgtgctttaaatacaaaagtactgaaacaaagaacattttttgccagattttgtgagacatgtctgttcacgcttatgacaattgcaagagacaccatccattgagcgtttatgatggcagacgtggggctggtgctctgcacgtatcatctcatttaatccttataacagccctgccaagtctgtggcatagttctcattttacacacaaaaatattgaactaagccctgaactatggctcggagaagaaaaatagcttccctaagggcatacagctgacaaagagaggaacaagattcaaacttgggactcccttgctccagagcccaaattctttcctctaaaattaagtaacttaaataaatttaacccccctcaacagcatcttgcatgttcttggtcctcagacattagtaagattgatcagccaagtcacagcagtattgttcactcgctctctcctgtccatttggaacacattacaatacaataatggaatttaggattctcaaagaacgtgcctggcttttcatgtaaagatcaccaatgcaaaactgtgttttgtttctgtgtgtgcgtgtgtgtgcgcacgcgcgtgtgcatgcacccaggagtatatctagattttatgggcctgaggcttacggtttgggcaatatgaatctttctagaactcttcccagggacctgcgcaagtgaagggccccgaagctcactagcttcatggtacatcagcctctgcacatgcgtgtgtttacatgaactgtgtatgtatgcgtgaagatagatggaggaaccaacgaaaaccatggttctttgaccagtagggctcagttccattgaatagtacaatagaaatactagttagtaccagtcactgtgtttcttttctgggaagagagagaagatttattaaaaatcaaatgggttaagaattttctgaaaaatgccctttgaatttcagccattagctaagttagatatacagtgctgtggcgcatgctctttattttcagtaggcaaataaatataacatttttaaatatattctttatcccagagactgttttggcgttgtttgtttgtttgtttgtttgaaacaaggtctcactctcatgcaggctggagtgcagtgatgtgatcacagctcactgcagcctcgacctcctgggctcaagcaatcctcccagctcagcctcccgagtagccgggacaatgggcacgcatcaccacgcccaactaatttttgttttttttgtagagatggggatctcactatattacccaggctggtctcaaactcctgggctcaagtgatcctcctgcctctgcctcccaaagtgctgggattataggtgtgacgcacagcacctagccagattcttttgttagtaacaccttttagatgtgatctcctccatatatgaaaattggaagaatacatcaagagagcaggctgggtgtcgaggaatgaagggacactggaaatgaaagaagatggagggctgtcttcatttacttagcaacctgctatagacaagacacatattctgtgttacttcacaagccaaaactaagaaccaaagtacagggattgcaggggaagccagattccacctcagcagagaaactttctatcaactagagctgtccaaaaatggtttgcttgcgccgtgactggctacccatcactggaagtacccagccaaagccacttctttctgggagaaggggaggtgggagactcttagtgagcaaagtttgagtcaatctaggaaacctctagaatcctgtctagatctaatattccaagttattactgggacacactatcgctgccaatcatatgctcacagtgcacgcacagcaagtggtccccgtccgcatggtggtgatgtgtttttgctgagccagccgcattccctgacggagcccctagttgctgaggaaacatgtctgtgcatggactgactcagctaaggccacactcctgggtcttagaactaagttttttcgtgacccagtacccaggacctcgggtccatgttcccacccgtagccgcctcatggatagcatttaagataactcccaataccttattagtctcctaataggcttctggtctaggtaggaaactggccgagtccacttgacccgcccctccccctgcttcctcctgcacactcgggaagaacccctctgaccctgctcccttggccagcgtcagtatgggaggctgaagcaagcccatgcagaagcctgggaggtgtgcggcagaccacgtgtcagacccccagaggcttagcccaccaggtcaggatgagacgtccagagaacccaagactaggagagtggcctcagttaaccttctttaccctttctggaaggggaacgtaaagctggccgtgacccagatattcctctattctccatgtgagacctccttagagatctacacacctgtcccaagccactataataatatcaggaatagtaatgatgggagtgtttgtggtggtggtggtagtggtggtggtagtaaaatcaatgactagtgtttactgagcttttcctgtttgcctcacgccatgatgagcttgttacatagaccatcttattgaatcgttacaacgatctcacaaggtagatgccatcaacactgccattttatagatgaggaaactgaggccaagtgacattaaagggcatgcccgaggaggcaccagtctgactccagagcatggcctcttcaccatgctgctgtctttcctcagtttctctctcatgaaaacacagaaggaaaagtcacctgcctgctctccagcccttgtttgagccaccccaccgggggcttctccaagcccagaagcagccaccaagaggggtccagggagcagtgtgtgcaccaaaccctactctgggtgcttcttgacctttccctcctttaaccctcatagcaaatgctggaggtcggtgttattatttgcattttacagagaagttcagggacttgttcaaggtcacctggtgcacaggagttgggactcccaccgaggcagccgtgcccacctctgcagtcagcacctcccaccaccacaccagcccgcctggttaagtgaaccaagctgaacaccctcacagacactaaatttatatttcctggcctccccttccaaaatggatacactaattactggacctttttttttttagtaatagtaatcatcaggaacacatttttcaatgttttcatttttctattccgcatactaccaaaaaaaccagataaaacccagcaagtgtgaggccctgtaaattagcaaaagttcaggaagtcattacacgaaaccaaaagaaacaaagtgttgattaggggcttatttttgtatgagattaaaatatgaatcattaaaataggactgtatttcaggcttcttatccccgcctcatcagagacatcaccatgactactaggtttggattcaatgaattccgaagccgttctcagctctcaaatgcagtcatgtgtgccatggttctgccttatacatagcagtttcaaaagtctggtccaggacacctctgcatcttcctgcccatctccttttaataaaatgcccaagtgacatggtgtctgcagctctttgaggtattttgctttatttagtcatgatactaagtagtggcagaaagttatactaacagcaaccaaatttcaaaggtagaggtaggaacaaagtcaaggcaaaaacacaaggttctctcaggaatcccttagaatagggtatccgtggagttttatttagtgtcagtgatagaggagcaggagtttgtagaaaaaaagaaattaatatggaacgtttctcaggtccatgctgagcttgaaagaaaaaataatacagcaatatcttcaatccaaaatatgccttgaatttaagttggtaattaaaatgtttgtttaaaaaaagtcgctaaaattagagacaaagacccattgtttgttattactgctgactgcatatctgtgtgtggagaagggtgtgaggagacagtcacaggcctgtgatattgtaaagatttatcacccacccccaaagggttttgaggcacccacctgcattttcagcttggatctaagtcaaggggtgggacaagaccatgacaggttttggggtttgtttattttttgctaattactcgtggacacttcaaataccaaatatatcagaacagaaaggcacccgctcaacccagcccctgccatcctctggcaatggcctgacatctctagatgattttctagagattgtggaaccttggagcaatgcctgtgtgcatttttaaaggagggaagcatcccagaacatgccagttccttatagagtatcttgaatagttaccacctctaaccggacttgtgaatttttttcatgtttattcttttcccgtctaggattgagattggttaaaaaggcatatttttctctgtagggaaaatttctgtgaagaatctatgagttgtcattggagcattacaaatgttcttaatgacttcataattcttcgagtaatctgaagtgcaagctaagatagatgtaaaaagaacatcctcacaaaaaataagagcaataaattgggatagtttaaattccctgccattgttcggcagctactgaagcagttcagtaatgtgggaaaatgttcaaaacctaatgtggagggaaaagaggatactcaactattaaaagcccgcttctaactatagaactatagatagtattaacagggcttctgtatcttagtgatgatgggattctaggtcatgttttgttttctttctgattttctgcctttttaaaacatttttggggccgtgcacggtagcttacacctgtaatcccagcactttgggaggcctaggcgagtggatcacttgagctcaggagtttgagaccaacctgaacagcatggtgaaaccctgtctctactgaaaatacaaaaatcagctgggtgtgttggttcgcacctgtagtcccagctacttggagggctgaggtgggaggatcacttgagcctgggaggtggaggttgtagtgagccgagatcgtgcctctgcacttcagcactggcaacggagcgcaaccctgtctcagaaaaaaagtatacgattttcataatcaaaaaagtttgatttacaacttcacatcgctctgaccttttgagtttcaagtgctgcattctgtgccccatgagcttggtgagggtaggaggtggcaggtgcgctccaattgtatctttggcaccgtgccaggcacttagctgctgctccgtagatcgttgttggaaaaacatctttccatttctcgatttccctttcctttttctttccaggtgatgtgctctatgaactccttcagcatattctgaagcagaggaaacctcggattcttttttcaccattcttccaccctggaaactctatacacacacagccggaggtcatactgcatcagaaccatgaagaaggtactggaagaggtttctcttttcttgcctgaggtttagacaaatccaggaagtttaattgttaacttgataagctggtcttcttcgtgtaagttcacttttcattcagtagacaattattgagtgcttactatgtacaaaatacactcttggttccctgaagctcacgatcaaagcgaagcagtgagatggatgtacacagaagcacagaagcgtaaccatatagtaggcaccgtaaaggtgtggtggaagggtccatgacagccaggtgcaggaagcagggtcttctcataaaggaagcaactctggagtatgccttagagcagtgctccccaccctttttggcaccagggaccagttttgtggaagacagtttttccaccaacagtggaggtgagggatggtttgggatgattcaagtgcattacatttattctgcacttcatttctattattacattatcatacataatgaaataattatacaatccaccataatgtcgaatcagtgggagccctgagcttgttttcctgcaactagacgttcccatctgggggtgatgggagacagtgacagatcatcagccattagattcccgtaaggagtgtgcaactagatcccgcgcatgcacagttcatgatagcgtttgtgcttctatgagaatctaatgccgctgctgatctgacaggacgtgggactcaggcggtaatacgagcagtggggagcagctctagatacagatgaagcttcactcacttgcccccaccgctcacctcctgctgtgcagcccagttcctaacaggccatggactggtaccagtcagtgacctggaggttggggacccccccttagaaatccagcaggattctgataagcaaggatgaagtgaagaacattccaggcaaagaaaatgacgtaagggtggggtaaggctttgaaatagagagcaattagatgacttggattataaagcttatcttctcccactcttttattacagaaaatttcaaacatactccaaatagaataaaataaataaacccttctgagccatcacccttgccttcacaatgatcagcattttgtcattgcagagctagtccaaggagcttagcttggaaccagagtgtggagaactttgatttctggaatatggaggaaagaaatgggaagtcattggagagttttttagcaaggggtaataaaagttggaagaaggaaagaaaaaaaaacccaaatctatgaactcagtgttgggccagggctttctgcatagggcaccaaaggaggctggttagagttcactcagtggcggtgtttatttcaagtgtcccagttgttcctcttaatcattggtagaaagcaaaagaccagaatttaatttaggccctggacctagttccagaataggtgttggggcacagaaatagagtataaaaaccttacttgaggccaggcgcggtggctcacgcctgtaatcccagcactttgagaggccgaggcgggcggatcacgaggtcaggagatcaagaccgtcctggctaacatggtgaaaccccgtctctactaaaaatacaaaaaaaaaaaaaaaaattagccgggcatggtggcaggcgcctgtagtcccagctacttgggaggctgaggcaagataatggagtgaacccgggaggtggagattgcagtgagctgagattgcgccactgcactccagcctgggcgacagagcgagactctgtctcaaaaacaccaaaccaaagcgaaaggaaaccttacttgagcaccattgcattaaacagttgaacagcttgagcactcagtgatggatcgtgcctctgagggtcatgatcctcctgctcggattggtcagaccacagacgtccaaacgtgcatcagtttcttcatgtgtacttttccttaggtgcagattactagggacctcaaaccctggtcccttggggcatttccttaaaatgattgctcatccccaagagcagggctaacaattttgttttgttgttggcaaaccaaaaaatgagaagtttcttgtttttcctaattaacacttcacaaaagagagcctgactccaggcgatgacaccacctccttgtgccaagcatttcacagcagggcccctcgcttccgtgatggagaacgaacagcatttcgtgcacgctccctgccttcctctcatcctttcctcccctcactctacccttgctaaatttagcagctgccctcctcccccaattcagttattcattcttttgctcttcctgccatgtgcatttccggcttgcataatagccaccagccactccagagaagaggaggtgggtttactgaagcttgacattaaggcaaggaatatattacctagcctgcctttcagatacaaagggtatgtgatgggttttctttctgtctcttagtctttctctcattattttttttgttaatctcatttggaatttagccccattttattcctgagtgtgattggaggcttatggtctctcctcctcacagatccttcctcttttccctttggcctgatttgactcagcagtaggtgtgtttgttgttctcatttgcaggagctcagcaatagagaaagctggcttactctgagagctgctcgcaaaccaagtaaatacagatgtgccaccgcatacgctgtaatgagctttctctcaagtattatgatgttggtggttgtgagctcagtaggtaagaggatggagctaatgaggccgaggtcaagggtgtcattgccctgcagaccagttagctctgcttcagacccagctcttaaaagtagtgcattttcagagaccattccttaaagctcatggccaggaagcaaggtctgagagcatgtccgggcgcatgtgctccagtgaacaggtgcacacaacaaggagagaagtgtaggtctttatccggtggtatccagggagaagagctttccaaggcacagaagtgatatgaagaggtggccctctccctatcctcctgcctttcagctatatggtgcccttgatgacaaagagaacaagtagagaggtgcatggatcagtacaagtttcctgcctccagctacttcctctctctctcccttcttctccactgaaaagaaaaaaatccagctcaacataaattgtttccagaatcaatactgttccatttaattatgaaggataacagatgattgatgtgggcatatgttaacatacagaaagatctggttctgaaaaaaaaatctgtcaagtgaaattatacatatcaaatattacttccccagtgatttattttacataactgggaatacagttccatataaaagtatgttaacccaagatgacacatgttgctgccaacttggcataggtaagtaggtaggtgggtaggtaagtaggtggataggtggataggaatgacagaatggaaagagaacaaggcccaactcagctgttaagcagcctggcacaatgaagcatgcacggtcaagtgcaaacagaaggcatcattcaaccgccttgtgatttcacctcgtcgtggccacaaacttaaccagttcagacattcataatttcacaatgggcatttatatcacagtacaaatgtgtcttgctcaatctagcaccagttccccacatgtatcctctatgactttcttacattgaaacttacattgaaatcatgccttcgttagtagccacgtggcagtgctagaagctaggaagttggtgttagctcagaggttcacctccatgccctgacagtagacgaggatgatcatcatgctaattcaaactctctatatgtgaacatttgttacctctataatgtactccattctgaaatcacatcatggcttgagcaaagcagtcctcagattacacttacctctagaaaaaccagcattttcactctttttccttacttattagttatgggaagggagggtgattttatataattaggttaaccttataatttttcacccataccaacacacttatgacagtgacacagggctccagcaataagtaagccaggactacatatcaaatattcaggcaaaaccagaaccagaaccatcctcgacaaacaaactggggtgagtgtgtgtgagtatgtatgtatattttaaaggatgagatctggaaaccgggaaaccaggtcctaacccttcattctgccagaacagatcataagggctaagtttctcattcctctggctctgtctccccagttataagaagggggttaggctaaatggtttctgcagtctcttacagctctcaaatccccacattacgtccaaggaacctgagtcttcctgggtgatatgaagataagacatattcccttccctcagggtcttgagcatctaaaatctagaaaatcatagcagtgtcctgcctggtgttgctcagaagcgggagaaaatctcttctttcctcatttgtctcaccttattcagaacttcagataatgttgcccctctgagagtggcagcaagagtagcgtcattcacttatttcatcataaaaagctcagtttaaggacattctttttccttgactgttgtgactcattttatctttgtaatatgaattagaatgcaggtaggtagttatgtagaaaggaggtaaaataaacaatgatattacttccttcacaaaaaccaggaggcaaagcatctttagaaatatcaaagcagtaaatgactataaaataaatttattttgtcacgtgcagttgtgatgataacttcttttcacaccttaggttcttttattttgggttttatccccttaaatatatatatatatatatttttttaattgtcatttgtcctctagtgttagaactactggaatattggccccccaaaaactcaacggaaacataaaataagcctcccttctgggctaaagtctctgaatgagaccagctccacagaatcaccccatgggactggatatgcagtctgtagggagaaggagcaagatccggatttctcaaacgttctcatcccatcacccccttggagcttgataatttcagctctttagttgcatcctgtcctctgccccatcaaagagattatggggcagtgattcttaatcactttaatttgcagatattcacacatgcagggctgagattgtttctgtagcactggatgcagttttaaggtggcagttctgctctgggacagctctttatcacaaggtaaacatggaaatcgcaagtgatgaggagaactttcaagcatcgaagtgcaattgatctcaatttttcttacaactagcacatgggaatggctcaataattgagagaagtcatttctttgtgaaagatggagagggtggcatgtgttctgcgatggcccacagaagttttatttatatgattgctttattgaggggaatcgtacccctcctgccccaccaccaaacccaagtgcccaaagactgctttggcagaaggaagttgtatacaattttaatgagataattaaagaagatgaggtatatgaatctgctttttttttttttttttttttttttttttttttgagaaggagtctcgctctgtcgcccaggctggagtgcagtggtgcgatctcggttcactgcaagctccacctcctgggttcactccattctcctgcctcagcctcccaagtagcagggactacaggcatccgccaccatgcccggctaattttttgtatttttagtagagacagggtttcgccgtgttagccaggatggtctcgatctcctgacctcgtgatccgcccgcctcggcctcccaaagtgctgggattacaagcatgagccaccacacccggcctgaatctgcttcttaataacaaaataatagctaacatttattgggtccttgttgtgtgccggccctgttctaagctcttatatctttgaatcatttaatcctcaccacaaccctataaagaaggtgatattattacctccactttatagatgaagaaataaagattaagagcaataaagtaacatgccccaaaatcaagtagcaacgctgagatttaaacccaggtggggttgatgccagtgcctgcattcattccactgcgcagaatgaggagaccaaaatacattttcataaatatttgtagtgtaggcgccctgaaaatagagcacatgattgaaagacgagtagcagtagtggagatgagaacgccaaagcagttttcaggtcagctgactggggctacagtgtgtggcaggtcctgcttacgttactgccaaatttgtactaaacaatgtcaaagatgacttctgggactccaaagtatgtctagttcataatattaaaaactcatgctgagttggaccgaattcacccttctagatcattaactcccttgggatgggccgtcttagcatcacgaaaatctcccagcctgtgagaactgtgggttctgagccaggcaccggcttctgagagcagacacactggctgtcacctaccccctgaggagccagcccctcagtgcaggtcacgccttgaaagctggcccctctctacagcggcttagtaggtaacaggtagacgcattctttagctgctcaagtcacatcctgtcactggttgtaaacccactcgattctctagtcttgctggaatcgtgttgatgactgcagggtcaaggaggctgtgggctggggtttgacatctttgttacacatattaaccacggaatacatgacagagccagagagcatgccggcacgtatatgcgtgcactctacatcccccgactacctgggttctaatcccagctccccagtttaccggctgtgtgacttcaggcaactgccttgggtctcaggtctctacctgtaaaagaaggaaaatgacaggacctatctcaaagggttgacataagaaagaaatgagtctccagcctgggcgacagagtgagactctgtctcaaaaaaaaaaacaaaacaaaagaagaaagaaatgagttaatacggaaaatgcccttagaatagccaagcattcagtaaatgttattcattatcatgattcaatatttctggctgttatttggttgtttccccccctctgtttgtgtaaatttttaattgggataaaatacacaacatttacaattttaaccatttttaggtgtacttcagtagtggtaagtctattcacaatgttgtgcagttggtttttccttccacttttcttaaccattctcaatatcgcaactacatccactttgtgcaaacatcaggtttgtgcaccttatacgtagggaagggccattgcctccctcactgttatccaagaacacctttgaggattcatctgcactatgatttctgtgggaaaatacatttaaagtgccagtcttcattactctcagaacacggcctgtttggaagtaagcactgcttgcattttatgtccccttgcagtatctggcgagcgctgggtcctccatgacccctttggaacctttgtattaatcttctggctgtctcctttaagaactacaagattaacctttttgcagccctttctgttctgggattcttgaatctggcagcaggtaacgacaggtcccatcagaaacaggtcaagatcttgacttcctgccctccctgggagcagggcccacgagcaccacttaacacctttttcccctgacccagcctcattccagccttctgcaagtcctgctttcctctccaggacctttgttcctgctttgcttcctatatttcagggcctagggcagcatgaccttttaccttctgacccttgcccctgctgcagcatgtgttttgtgacggagtgtagggactggattgtgcagagaccctctttgcatctgtctgggccctcggcctattacaggagggacccctcacccttcctgcctgcaccagggtcctccaactggaggctgcttttagccctagggctagcgtgctctcttaagccagaagttttaggggcaagagatccctaatatgcatgaatgactctcacaagacaggcaggaagtctccaagagacttcctttacccctagggaaatgccatctgatctttgagataaggggctgggagcagtttgatttcatctccagagaaggaagccctcagttaaggggtcatcttgctcttttccccactccagggcctctctgccttatctctgtgccacctgtgaccccaggccttatacatgattgagaggattacccaaacagacctaattgacttattggaaatccaatcctttgattttttaattcacttcttttgtgctgctttatggagacaaaggagactcccctatactgcctgtgaagagcaagacagtctgcagccccgactgtgaggactgtgaggcctcctgtgtcagcagatgtgcatgtactctctgtactgatcccctggaaaggtggcctgtttgaaagcagtcctgcccaggcctgcagtaatgaagattaagcctcagagtactacaggttacccattttgttttgtttagcccctttcatcaaatgcttataaaattctaggagcttacctagggtttattgttgataacctcaaacatatgtgaatcatccactccaaactagggcagttttcttctcaggccctccaagggagttcggtgacattggcacattgtggggatgaataggctgaaatgccaggtacacagttagtggaaagactccaaaccaagcaaaggttgaacgtcaggtaactggagtagggggtgtattagttagctagggccgctgtaacaaagtaccccaaacggggtggcttaaacaacagatatttattatctcacttttctgggggctagaagtccaaggtcaacgtgtgccagagttggttccttctgagagagctgtgaggtaggatctgttccatgactctcttctcgtttctggtggtttgctggcaagctttggcattccttgccttggaggtctctgccttcatcttcacctgcattcttcccctgtgtatgtctggaagtccagagtatactttttataaagacaccagtcatattggatgtttaaaatgacctcatcctaactaattacatctgcaaggaccgtctttccaaataagatcacatcctgagggtactaggggttaggacttcaacttatgaattttgggggagagatagtcaacccataatgggcataagagaccgggagtggtatatgaaatatagtttgaattccacctcaagaccttgagcttatgacttctgtctagctctgtgtatcattcatacttcccactaatttttaacaaaatgactgggagagggagaaagtgaaacccagtggactgaggcttgagtgagcattacctcctgggcctgttgatttgcgtctccctggtgaccttcttctctgaccagcatccgtgggcttagggaaagcacagtggtggaaatgtgatcctggtgtgtgagatgcaaacttgatcttagcctttgctctccctggaaacttatcggtcaaaactttcactaaaggcagttttttgtctgtttgtttaggtttactggttatttattatttatagcatggttaaattgggtcaaatttttatgaattgtaagtagagaaacttttctaataagaggaaaggataagaaatcagacctttttgtaaagaaaattaccccacttaaagtcctggtttattttaggccgtttggcagtgagaagaagggattatttgtgtctgacagaggtctacaaggaaaaaggtttgggatcagaaaacacttccaaccagaatgacggttccctgccagtccttggtctttcttcctcccttccttctgtgcccacatggactaattatgtctggctttccctccctcttccttgtatatttcccttccatatcaagaccttcagaatgagggcaatgtggataatttcccagttttccagctgggcagctcaccaagaacaaacccagacatcaaggccagaccaaaaaaatcttcttgttttagacagaagactcctacatctgggggatttaatgcacccactgtccgctcagtgcatttcctgtgtccggagcttctctgcctgccggctctggtctcgtaagtttccatgccctgctgccaacttataataacagaggcggcaggcagcaggctgagaatgtcatagcctactccatacatgggcactgctttgcagactgaaacaaagcttgcagggtctcattgcaggcctctcagccttgacagtggttgtgcccagaccaccaggagcctggaattaaataccctcggatccagttctctactgttaatgttatcagcttcatcaagtacttcctctttgagtgatatctgtggagaaataaataaatcaagctcctccaagtcctgttcctgcctggatcctgagtccaaagtaaaatctgagttggattatccaaagcactatcaccctcctgcattgttcccaaggtctgggcaggaacggagagtgaaatctctccaggacattacatcagttcctcctttacccttggcatgaaagttcttcctctcctggtcctcccagacttcctaaggcctgccctgagtgcacacccacacactaagccttgaagcccaggacatcaaagaaagcctgcaggtaaccagattactgaccaacgcctgtgaccgttttgaaatttataagacgggaaatggattcaggaaatgggatttttcaatacatggtcttcatcatccttaagtatttttaagccttaataagcttttaagtaaagagagacattctgtaaatggcatttagaagaaaatataggaaagttcaaactggaactgtcttcaatagttgtttacagtgatcatattctgtgacaaatgaaaagtggaccagggacaaaagataaatacatttctatgggcagcagaattgacatccatattatctataaaaggaaagtttgccttgtctacaaaagattacagatcattttagttggtgcccagtaagcatttctatgcatttgggttaaagtgaggaagttagtgcttgtctttccaacctatatccttgcaaggttaattaagcactttaaaaaaaaaaaagctttttataacaggaaatatcaaacctatacaaaagtaaagagaattgtgtaatgaatcaccatgtacccatcaccagttttgatgatcaactcaaggccaatcatgtcttcctctgtggtctacctcctctctccttcaccatcccagattattttacagcaaatctcagatatataatttcccttgtaaatagtatcaacaggctgggcgcggtggctcatgcctgtaatcccagcactttgggaggctgaggtgggcggatcatgaggtcaggagatcgagaccatcctggctaacatggtgaaaccctgtctttactaaaactacaaaaaattagccgggcatggtggcgggcacctgtagtcccagctactcaggaggctgaggcaggagaatggcgtgaacccgggaggtggagcttgcagtgagcagagatcacgccactgcactccagcctgggtgaaagagcgagactccgtctcaaaaaaaaaaaaaaaaaaatagtgtcaacataggtctcaaaaaaagactataaaatcataatagaaccatcatatcacttgaaaactagtagttcctcggtatcatcaaataatctgctagtgttcactttttgccaaccatctcataaatgttttttacagtttggatcagaatccaaacaacatctatacattgcagatggttaacgtatctcttaagtttttttcaacctataggttcccatctgcaaccttcttgtgtgtgtgtttgagcagtccctctcttcaggtttttttaaagaagtcagccataattagtatattcgtatatataatatattatatatattagcgtaggcttatatatactatgtaagtatatacttatatagtattagtatatactatatatcatatatactataatcatatatagtatatatggtgtgtgtgtatatatatactatatatcatactatgcatatatagtatattagtataatctccccctgtacatagtttctttttttcctctggttgctttcaagattttctctttatttttggttttcagcagtttgactatggtgtacctgggtgtggtttttattttacatatcttacttgagattcttggaccttcgaatttactgttgttgataatgttgttaccaaatttgaggacaatctagccattattttttaatttattctactctgtttttttctatattctccttcttggacaccaattacatgtgtgttagaccacgtgatattgttccacaggtcactgaggatttgttttgtttggatttcatttttactgatctgtcttcaaattttctaaccctttcttctctcatctccgttctgctattaagtccatctagtccggtctttcatttcagatattatacttttcagttatagaatctttattttgcctttttttttaattccatttcccttttggcagcctgtatgtgtcatcatttattacaaccatgattttcttttagggcttgaacttatttataatagctgctgtaaagtttttctgtttgtttgtgttaactccaacatctgcattatctcaggttctgtttcttttgatggcctttcctccttattatgagtcacatgtttgtatttcttctcatatctagaaaattgtgactggatgctgagcacattgagacactggattgtgttctattccactgaagagtattgacttttgttctaggaggcaatcaaattactggccagttactttgaatctgtagaggcatggtcttacgtttcattaggtccaatctgtttctattttgccttttgcccttagcagatccccttgtcctagggtttttactcctacattgtggccattctggggtaacaaacagcctgaagtgtttacagagcctttgaacttgatgagactcaaactctgaactctgtctccactgcagtagccagtagctgaggtttccgcttagatcttttgattatacaactgttgcttttcactgaactccaaagggtctccctggcacttgggctattcggtaatcagacaagaatttgaggaagcttttacatgccaatttaatcactctcccctctgtggctcccactgtatgggatttgtttcttcaattttctgccattctggcagctacctactctatctcaagcaactttctgtttatcttctaactgcccctgtgctgcacggactggggaggaacatgcagcatagggcagttaggagatcaacagaatcagggggaaagctgtttaaatatggacctcactctgtgcagttcccttctttcaagagtgaaatcctctccggtttttgtctgcccttgataccttcaaatagttttttcaatgtatttaatatggtttctttcatttctacccgtaagaaggttagtttggtacacgccactctgctattgttgaactgaaattgcccctttccttgtttagataagtggtggcagatcataaatacttcatcttgcttttcgtatctaaccatagattctgatgctagtccttagcaaaatatcaagatactcctcattcctttttacttttacgtagtactccattttttagagatatatactataatttattaaatcagtcttctattgatagctattccaatgatgaggcacttgaatttatggcagtgggttatacagtagtcacaaaataagccctttgccttcaaggagatgatcttttaatattgtgaacaatatttttgttcagtgatcatatgatagatgagatctagtagaactttcaaaaaagaaaaaagtccgcattttcttcttaaccctgtgtaaaacttaaaaccactatgtctgtctctgtttactgaccctatcaaattacggaattcactttatgtgttcttcatatatgtatattatcttaatggacaaaggtgatatgtttgacttgctttacttagaactgtggacaattctttgaccagaacaaggacagcaagcatgcacatccttttggtgagactgccctgggaacagatgtggccagagagagttcattgagttgggtgtggagccgtgtagaaatccccatttttatgggcagatttctgtccttctgcaccttagcagggacttctggagccaggtgtgtgccggtccattccccgacccagccctcagagctacttctcttgctgagctgtgtacacttctgatgttatcctcgctcacatgtcaccagcttgcaactttgagtgggatgagttagaggtgtccatccatcctgcttcttccttacttctgcctgtctctgagcactcaggagcaaagtgctcccaaaagttctttcaagttcagtaagattgtcattctgtaaattggggccactgtgcatgcttagagcaggttttggtgtgactttgtgtcatagtttctatattgcagtgacagatgttgtcatgagtacacaggttctagaatctgactggagtctggttctataatctcctaactggctgtgtgaccttgggtaagttatttaacttctttacgcctcagttttatcatctgtaaaataggggtactagtggtatctcttggttaggagtgtcatgagtgtcataaggttgggggtttttttcttttttcttctttttttttttttttttgagacaaagttttgctctgtcacccaggctggagtgcaatggtgtgatcttggctcgctgcaacctccacctcctgggttcaagcgattctcatgtctcagcctcccgagtaactgggattacaggcgggagccaccgcacccagccaggagtgctataagttttaaacagtgaaatccagcatctaagatatagttattactaataattattactaatattattaacattatcactaatactaataactcctagagttagagaatacgaaaattttagttgtgaaaatgtaagtcaatgaaagcatctagagagaaacctgtaagaacccttccacctctgaaagcgacgtagaagagttaaatgatggccaaaagatggggcatggaagtttggcttccttgtgcctacaggccacaggtaggtcattaacggaatgcttgtagacatccttaggttgtctggcaatagaaaaatagtttcaatatgcacaccttaaggccaggcgcggtggctcacgcctgtaatcccagcactttgggaggctgaggcaggcagagcacgaggtcaggagacccagaccatcctggctaacacggtgaaaccccatctctactaaaaataaaaaaaattagccgagcatggtggtgggcgcctgtagtcccagctactcgggaggctgaggccggagaatggcatgaacccgggtggcagagcttgcagtgagccgagatcgtgccactgcactccagcctgggcaacagagtgagactccatctcaaacagaaaaaaaaaaaaaaatatgcacccttcaaattgttaagcagtgaaaaagacactgcattctggggagaaaggtcctttacacatacctacacgctcctccatttaccgcctgtagagccgcagggagtttcctgtcctgccaactcactggggtctgtgattgtctttccctctgctccacagataactgtgtccagaggacccccaggccatccgtggataatgtgcaccataaccctcccaccattgaactgttgcaccgctccaggtcacctatcacgacaaatcaccggccttctcctgaccccgagcagcggcccctccggtcccccctggacaacatgatccgccgcctctccccggctgagagagctcagggacccaggccgcaccaggagaacaaccaccaggagtcctaccctctgtcagtgtctcccatggagaataatcactgcccagcgtcctccgagtcccacccgaagccatccagcccccggcaggagagcacacgcgtgatccagctgatgcccagccccatcatgcaccctctgatcctgaacccccggcactccgtggatttcaaacagtccaggctctccgaggacgggctgcatagggaagggaagcccatcaacctctctcatcgggaagacctggcttacatgaaccacatcatggtctctgtctccccgcctgaagagcacgccatgcccattgggagaatagcaggtgagtgagttcccctctcgccgctccagcatcatggggacctgacaaagtcccactctcccctgtgatctttgcagccagcctcgcaccattcccaattaggcgccctccaaggctctctgagggcaattggaggcttctgcttggatgaggctaaatccctaatggcttggttaatgagccgctgggatggagtagttaatgagcctcagaaatgttaagaaacaaatgtcctacgtccagcttacaaggagagtcacatcagaatcaaggctaagcgaaaacatttaaaataaaaggtttatgagcatgctaatggccctgtcctgaagtttccagcagctaattaatgaccagacacagcataaagaagctttgtctcagattcaggcctgtaattccatcctgtgagcggtaacgccatgcagccttcaccttaggagcgggtaggagaggaaaacaggattatggtattggaggcaggtgttgctgggccatttggacagaggaaaccactcccagattctctttcatttattataagaagcccaaatttgcttacttaagggaagaaaccagtggaaaccagtgggaaaaatatctacacattgtctgtttcctaggatgctcataatttacatgaactcattcttcagaagcttaatcctctaaccatgtgacaaggttagctcttttcgtagagcatttctccattagatatttgttgagcacctgctgtgtacaaataaatgcattaggagtagggatacagagctagtttaacatgcaatatctttttccccaaggaatttagaatatagtgggagagacaaaggtgaaaaccactaagatataaggcagaatgaagtcagccccatttcccattcattttatgtaccagcattcattgagcacctactgtctgccagagtaataaagcgctgtagaagcaaagcagaaggaaggtgtgttttgactggagggaccaagcaaggctttgcaggggagagagcctgatactgaagtgactgtgctttcgatagtgggaaggaggcctggaggcaggagagaacggacctgttcagggaagggtgagaaatgccccctcctccctgagcccatgacccggtgagagctctagctgaccatcaaggtgctgccatgctgatggcagtggaagaacaggctcctacaagcctactttacttctgccttgaggtactgtcccttttttttttttttttttccacactctgttgcccaggctggagtgcagtgacggaatctcggctcactgcaagctccgcctcccgggttcacgtcattctcctgcctcagcctcctgagtagctgcgactacaggcgcccgccaccatgcccggctaatttttttcatatttttagtagagacggggtttcaccatgttagccaggatggtcttgatctcctgacctcgcgatccgcctgcgtcggcctcctaaagtgctaggattacaggcgtgagccaccgcgcctggccggtactgtcccttttttatttaaatcatgtatttctagatttttctctggccccaagtgcaccaccagtgttgtctcagtttcactgttataaatcatttacatcagggatgttgaatccagaaaataaaatggcaaacaaaaatgacttatatgttttaaaaactatgaaaaaggaaatgatatatgtttgggattccattcaaaacgatcctgcagagttagggggtgagatgtgggtggggcctacataaaacaaggctagccatcaccagctagtggctatatgtctgggtgatagatgcatgggggttaatattattgatctctctgcttttacctgtacattagattgttttaatcagaaaatgaaaaaataaaactggggaaaaaaagaatagtagataaagaagcaaagagcttgggcaaaacatgtgaatttccccaaataattggagaaggaggatgaggtcagtgtattgctgtgaattctataaatgacccatctcgtgctttccaggcaatacccttcttgtctgtataccctctcgtcttgtttcttgcatggtgtgtgcagcagtacttgacattttgcagataccttttgcttgtttataattctcaggaccgctctttaaggtagctcatgactgcagtattcatcttatgtggaagggtcatttgtacaggggaaaccacagaggaaactgagccccagagaggcaaaggcctttgccaaggtcagataggggccccatgaccgaggtgtgcaggacaacccttgctgcccgtggctgctgtccatagtgctgccctcgtgggcctggcttgcttcccaagatctctcctgtctacctcccaggtgacactgccttcaccacttcttgggaatctaccataagcccatgaatcaagaaagacacatggtttagacttgaggagttatttttcccttatttagtaggtttgtaaatttcaaaatattagtctcttaaaattatattactttttttttttttttttttttgagacagagtctctgtcacccaggctggagttcagtgatgcaatctcggctcattgcaacctctgcgtcctaggttcaagtgattctcgtgcctcagcctcctgagtagcagggattacaggcacacgccaccatgcctggcgaatttttttgtatttttagtaaagacggggtttcaccgtgttggccaggctggtcttgaactcctgacctcaagtgatctgcctgccttggcctcctaaattgctgggattacaggcatgaaccactgcacccagcctatactactatttttttcatctcattccccaatatcagtgtttgatgatggatgcggcctcatcggttaggaagcttggtggaatactgcacccaccaaatgatgagcctgggtgtctatgggtgcccgctctctcaagggcacacagaaataggcaatatgtgcttttcttgatggctctaggaagtcaagaatattcatgtaaaataaccctggggcctagatcttttgggggaatgcgttaactccttcagtataacacaatgtcctaaaactaattaccagtgctataatggcatattcaaaagtttttaaatctcccaatatatattttaactaatgcaaccaaatccaaatttaactcattccactgaaaggcattgtttttctccgaagaaggtaggactgaatcatccctaaagttccttccagctctgccagtctgtagtctgacagtcttgattctgtaaccctcccaagaaaacacaagagttttaagcacctttgtttctttgaggatacccctgtgtgtactccactcttctgatgtctttctggactcctcgatccttgtaaaattgattctgtttattggaggtgaaattcattgggtgattcctgtgtacaacgtaaaagttctgtcattaactgaatagccataaaaagcctttaaatctccgtaaagcagctgttagatgagaaaacttagttccttaaagcttttcaaatgagcacagcacaaaaagaaatgaaggtgctgctgaatgtcaaactgatgagtactatagctggagggtatagatggaaatagtactcatgaatgtggatcacaaaatgaagctaaattcttactattcagatatgatttgttcaggtgccctagaatttatgcatttggacaccttctgtgtataaggcactgttctgcattcttgatggggtggggacagcctcagagaggtataagacacagtctttatcatgaaagagctgagcacagttaactataaaagcgaagcacatgacatgtatcttagaagggctcctgttaagtaccacaggaggtcagagtagggatgtcagggcaagctacatggagggctggcttttagctgggcttggatgaatgcttagaatgtggacaagtggagattagagaaaaacaggtcattccagatggagaaaacttaccaggagcaaagcaagataaggctcggtgtattttttctatttcaggtagaaatgtaaatctacaagttgagatctattgaggtcatttaaaaatctatcatttttcaggctgggtactgtggctcacgcctgtaatcccagtactttggaaggccaaggctggcagatcacctgaggtcacgatttcgagaccagcctggccaacatggtgaaactccatctctatcaaaaaatacaaaaattcgtcgggcatgttggtgcacacctgtagtcccagctaccgaggaggctgaggtgggagaatcgcttgaacctggaaggtggaggttgtaatgagccaagattatgccactgcactccagcctgggcaacagagtgatactctgtctcaaaaaaaaaaaaatgtgtgtgtatatatatatgtgtgtatatatatacacacacatatatgtatatatatatgcgtatgtatatatacacacacacgtgtatgtgcgtgtgtacacacatgtgtatgtgcgtgtgtacacatatatgtgtatgtgcgtgtgtacacacatatatgtgtgtatacacatatatgtgtatgtgcgtgtgtacacacatatgtgtatgtgtgtgtgtatatacacatatgtgtgtgtatgtgtatatatgtgtgtatatatgtatatatgtgtgtatatatgtatatatgtatatgtgtatatatatgtgtatatatatatgaaatttttcataaattcttttcattatctattatcactgaaattccatcataccattaagatacatgcagaattgttctcactcataggtgggaattgaacaatgagaacacatggacacaggaaggggaacatcacacaccgggtcctgttatggggtcgggggaggggggagggatagcattaggagatatacctaatgtaaatgacgagttaatgggtgcagcacaccaacatggcacatgtatacatatgtaacaaacctgcacattgtgcacatgtaccctaaaacttaaagtataattaaaaaaaaaagatacatgcaaatttatgtctgttaggtatttaccatatggaaaaactaaaataatcaagaaaggaaattcagtaggtggttgacagtttaaatacaaatcacaaatgacatctttttaaatataacaagtagcttatttttaaaggtgtcacttactttgcaaaggataaggagaactgttattaagaatttaccaggttggaatggctagtgtttatgggagagagtttagcacaagacggagtgagacaagattgctggggtcttattttgaatccagcagccaacgctgtatggaatagtgaaaaagttgcctctttctgtgcttgttttctacttggtatctttaagaatgggctatttaggagcaaggagcctagcagaaagcatctgtcaatcttctaaaactttacctacaaaagttttactggcttgtgtcccaccagtgtgtttcaaagccagaaagtatattggccacaagcacctgtaggtggctgaggtgtgactgtagtcatccgtgagtcatgttttcagtatgtattgaaattccttatttggacttgatttcaaaggtagaagggccttttacaggtgaaggaactgagattgagacacatcaagagtctagcctcgagcttctgttcagtgtttttcccaaaattattgtttccttctggtctgggactctagagcaaagattgaaaactgtggcccaaagtgtgagccaaatccagccaccatgcgttttttttaaatcaagttttcctggaaaacagccaaacccatttatttggtattgcctatgtctgcttccatgctgcagtggcagagttgagtagttacaacagagattgcatggccagcaacacctaaaacatttattagttggccctttacagaaaacgtttgatgctctctgccttgcaacattgtgtacgtggtggtcagtgtgcttggaatcataggtgcaatgtaggatgcagacttagaaaacagtgcccttgctcccaaggaattatttgcactttagatgacaaggcatgtttgagacatgtgaaaggaacaataacaagttatgtaagagaggagacaggttctggactgcaggctatattttcagaccaaccagaatagttacgataatatcattaacataaataaaatactaagtatttagctacgtaaaagaaacgatttatttgcactttggattatacagttcttcattcattgattcaaaaattattgccagtctgctcatgtgccaggcattgttctagatgatagggcactgcatctctaaatgccaaatttcgtatccttgctggtggaaggcaatgtcctcttgctttatgccatgacacaaactaagctcctgctttaactatagacagctaaatcttaaacgaacacttttcagtcagtttagttttctcttaaagtactttaattccgttaaaacctgagccaccagatttcctgtctgcctgtctcttccttggccttaatccaaaactctgctgaggaagaagattcgttggtacactgacaattgttttataatccattcatttcataacccctcatttgctacccaaaagtggggacctaaatctgtacagatttacgtgttcaaaggccatggcctacccaaatagagaatatctcctttcttgtgtttctctcacaacttttgctgaagtctctccatctttgtgaacatgaacttctcgatttgtgaggctatcgctggtcagttgggtcattaatcctacagcaggcaagacacagaatttcctctcagctcaagatctcttcactcccaaccctcttagaacacacttcgcagcaatccttggaatctttaaaggtagccttttgtgactttaaaaaatacttttactatctctcaaggttacatccttaacagaaacaaaaagattctaatcagcgagacatcaagtctcttgcattgcttatttgtcacccaactaaaacaatgtactttcttgatttggttttattgactggatgaattatatatatacaaagattcaattcgggaagcctctgaagtaagatgaagaaaaaagtatgaaactccagagaaagcagtttgaggcttgtcctcaggggcttcaaggactgggagaagtcactgtattctggcatcttgcttctgtctccacttcctcccacagtgtttaatgctgctgtgaatttgtttcaaaggaagcctatagacttttttttttttttttaattttgtacatgagcctcaggagcagccttgacagctaaaagacctcgtaaaggagaagtgtgaagggattgcatgaaagtgctgggggcaagtctcagccctcggcctttgttggaaggtgtggggtgtgcagacacatgtgcaccttcgcacacatgcatctgtgcataaatatctgtgtttgcaggaaagaaaagatagggttgtgggatgtccccagaagccacagggattccagtgttttagtaccaggtgaaagagccgcttcctcccacactatctcagggagatgcccttctgtagacctctgtagcccagtaccctcaagagctcctggagacagatggccccgaacagtcctagggaagcagtgtgggcctgtggcaaaagcttggactgcgaagtcagcatgattggaatccggttcttgactcccaagcaggtgcataatgtccctgagcccttctttccttatctgtaatattgagaatagtaatacccatttctgggcccttttgactgttaatgagacaacatgtgaatgcatggcacaagaaagttaattgctacgtgtcactgtccccccctgcctcactgctgagctgccatcctgcccatctgagagggactgtgtgggagctgtgggtacagccagcacaactgcctgcagagccacgcagggcactgacagggaaggcctgtgtggggtgcccttcaaggccacctccgttttcttatttccttggagatttacttttgtgctcctgcttcccctccctgaagctttgcctgctgtccatatttggaggggatgaataagatgagcactggggaggggaggagccatcactccagcaggaatattcccagcggctgagtcactgcatttgattttcagtgtgaacaactgagaaatcaaagagccctaaaagaggaggaagtttcaggacaatgtttttaaaagataaaaaaacatcaacagcatggtgtctgagtggaaaataatagaaggggcttgaggagactggaaattccagtttgtgtaagggcgcacagtgctgtaatacagagtcctacctccctgcagtccctggatgtgaattcccaggctgcacccacacctgagcaaagcggaggctgggccttattaggttctgactgcgggctggatctcagctgcaggctgtgagtttcggataccggtgtttccaagccttctccacaccttatgtaatcacaggtgaaaaggtccagcctcatttgcagctgtggttcttctgccccaggaagccaggaagcgtagatttttgtattatttgcctccacttctccctcccccagcgtgccaccgtgcacatatgttttctgttttcctaagccacggcaaagcacaagcaattgcccattgtaaacacacctctgcgtatcaacacacacctggctgcactggattgaccaactttctgcttctaggtaatggctgatctagaatagaggaggaggagggaaaaaaaaaaaaaaacaagcagcagatggccccctgaatgttgtaaaccgtgtttctctaagcagggtttctcaacactctcgatatttgggccaaataataatttgtggggttgcttactatattgtaagagattcagcagcatccctggcctctacccactagatgctaggagcaccctgcaccccagtgtgacaaccagaaatgcctccagatattgccacatgcccccagttcagaaccatatttgtaaagcttagtagcaactttttttttcatatgctactttgcgtgttttgttgctgaactggaaataaacgttaatttttaggtaataaatttcaaaaaatgtaacagggacactcagcctctcttctggtaattatgcccatgacactgtcatttgcaggccttctttaaaattccacttgggcagttaaaagaacataaaatgactttcttagaagctttcctgaaatttaaattaaccacaatcattaaacattccctatgtcaataatttgactttcctactcaaagttttttaaggcatcagttttgtctagcgtggtttttttctttagaaaccatgttggttatgtgtgaattgcccatctttttacaatctctgctcaataagtttatacaatgagtctctggtaagagacagacgtgggagtgaaaatatttctccttaaccacaggaagggattttttacaatgcctttagctgcggataccgagggtacctcacccagcaggaaggagagggaactatacttgggctaaacactttcataaactacttctcatggaaaagaaaatccaaatagtggaaatttctttaaaatatccatgtgccttgagatagaagaaagccctttcgtttaagaaaaatgcacttaaaattaatgaataccttgtgatccaaaaacattttatacatatacgttcaggtgttttgaagtggagtgaacttctatttatagagtgtgttgcgctttattatatagtattatgcatttacattgatgatcaaagaacattgtatctgtgcaggcatgggttccgaaaaggctgaaaaattccaggtgagccgtggcaacaacctctaaaggatctaggaacctaaagaggatctgccttttatttaatagaaatcttagaaacaaaaataactgacatggcttgaatgtcaattgtttaaaaaaaaaaaaaaaaaaaggaaaaaaaatctattgtgtggtcaggcagttatttttatcatctaggcataatttttaccaaagaaacaaaacaatcaataatgttataaaagccacttatactctgagcttgaaacaactgctttatgccacaaaattcctattgctgtctccgttagtgactaattcaatatgtcctgaatgtcaacgtatttttattactcagctaaagttggctttgctggattaaatgtcatttaaaatgatcaattggcagcttgtttggggttgttttcacatttatgaaaggaaaagtttgccggatacaaatgttcttgaagctgatagggaaacggtgttctctggtaagccctgcccttccttttgccatctgataagtagataacattctaggtcctagtttgatgcctccgaaaaaccaacatggcagcccagtgcaggttaagcccttacattggagaaatggtctggttcacgtttcactgttttatgagaagtagaatgtaccattacagtaaaagagaagcaacagaaacatgcagtgaaaacgcccatgcttgtggttagagaactgtccgctttctttttgctctacagtaggcttctgagtggagtgccttccgcctagagtcaagagggctgccatgatgtcacccaccttcatatgggcaaaatgtctttatatgaaactgtaaaagacaaccaggtcgtttcttaattgctgaaatttattaaaatgaacacactagaaaatcacattcccaatccagaggaatccaatggcgtcgtcagcctatttgcaatggaaatgattgtaaacctatagggagacataggaggggctgcacacaaactactttcgttcgtcctgatttactggcttcttttccccctagagatacagtctcactctgtcactctatcgcccaggctgagtgcagtgggttgatcatggctcactgcagccccaaacccctgggctcaagcaattctcccacctcagcctcccaactagctgggattacaggcatgcaccaccacgcctggataatttttaaattttttgtagagatgaggtctcgttatgttgcctgggctggtcttgaactcccggactttcaagcaagtctactgcccctgcctcccaaaacaaacattgggattataattataagccaccacacccaaccctaatttacaggcactgtatgtgataatatgtgattttgtcagatgttttccagttggaagagattatggaaaattaaaatgtgtctgccatttgatagtaggacaaatactgaaatattaagccacagctgagttctggccttagtccttttggggctgctctgacaaactgccgtagactgggtagttggtacgcaatagatacggattgctccacagttctgggggctggggagatcaaggccctggcagatgaggcatctggtgagggcccactttctggttcatagacagcaccttcttgctgtgtcttcacttggtggaagggtgaggggtctctctcaggcctcttttaaaagggcactaatcccactcacaggggtggggcccccaagacctaatcacctcccaaaggtaccttggtagttagttaggatttcaacagatgaatttggggaggacatgaagattcagaccacagcagatctctattttccctttatagagaaagtaattcaagacaaggagatgcttacaagggaaaaagacactttgccactttttactgctttgcttagaaactagaatcatcctccttcaaatgcctgtaaaacgagctagattattctcagtctgcagtaggacactgatttctcaaggtacttaagatgcttgggttgctcatcttctccacacccccacctcagcccatcccctggcaatacagaatgcagccatggcaagacggggtgggcaatagaagtggctggacagcttctgttgttagaatggggttcaaagtccaggactatggtgttgttgttttaagaaggaggccacttgtccttttccaaaacacaatgagtgacacaccacattaatgtttaaacacagataatacagaagaaaggattccataagggatactaaagatttagggctgctgtacatttaatggtagttccttgaaagattaagcttctggaaaatgccacagttttctgccagtgtcttctgctattcaaagagaacgctggagttcagaaaagatacactgagcaggtgtactttgttctggaaagtcctaagattttataaacatacacccattaacgagtttctctgagactagaaattgcattgggaagtgtgtcatagcatgggttttggggtcatgcacagccaagaatcctgtgtgtcattcataagctgtgtcctcctgagtaaatcatcaaaccctctcagccccagcttcctgatctataaaataggaatagcaacagcacctgcctcataaggcggcgtaagggtcagatgtaaccaggcttgtcgaagccacagcacagtacctacaaatagcacccactaaataccgttgttatttttattactttctcttccctcccattatcactaatataataatcctgtaaagtaagtgctgttattcccacttcataagtgaggcaacagaacctcaggaaggttaagaagcgtgtccagggtggcccaactgaattcccccttgtaaatatatccccagagaagggtgtatgtttctctgcaatgcggatgtgttggctgtaatatattccaagtctcaactggacactcccctttcaaatgtgccaggcctaggccttgcccaaagtaaaaaagaaagaacattgtagtgcaggagtccagagtgcaaatccttgtgacctcaggcaagttatttcaacctctctgaggatcagaaataatacaggtaaagtgccgagttcatacttgtaattcagtagttgatcttccatcaccagccattctgacaagtgcctataaaaagtgggcatttccagaaccatgcagtgaacacctggaaattggtgctgctcctcatctggaggccagttaacctttaactcaacctagaaggcacacatctgtccccagctgcctctccaggttctgctggagggcaaccacacaccttcacagcacacatccagaaagtcatagaacaaggggaaggtgtacatcatgtcttcttcttcttctttttttttttttttttttttttttttttgagactgagtctcactttgtcaccgaggctggagggcagtggtgcgatctcgactcactgcaacttccacctcctgggttcaggcgattctcctgcctcagtgtcctgagtagctgggattacaggcacacgccaccatgcctggctaagtttttgtatttttagtagagacggggtttcgccacgttggtcaggctggtctcaaactcctggcctcaagtgatccacctgcctcagcttcccaaagtgctgggattacaggcgtgagccaccacgcccggccatgtcttctcttttaatttactagcccacagccaaaaaccaaggcccaacaccatgcctagtccatattaaatcacctaacacttaataaaatatccattgcctgactaaatgttcaaacatcagttctgcaagtggagaaagtgacttttgcactgggttcctttctgccatgatccactatatcaaaacattttttaaagacctccaaaatgtgatagaatgagaatatctgtatctctttttgaaaccatgctagccacagttcccacagtcagagtcaccaagccacatagtttttcttttcccaccatttttcactcctcactcctttttgctgtgttttagcctaccccagccttctcatctttatccatccatctcccaccaacaccaggataaccttttcactccactattttttaccacacagctctctctgtaaccatcaggaccctctttccacccttttttccttccagcctgcatttaacacacattcagagcccattgattcagttagaacttgcctcccgtctttcacatgggttctgcccaggtttaagtttgggtcacgaccgtggacttctgggtcactgtatcatcatctgtggagggaggctgtcgcctggatcatctctgaggcctccggtgggtcaaaggtcacacaacaggacctccctccatctttctgggcctccgtttcttcccggtaaaacaaggaagttagttagacaatcagtcaacccaagctaggcagaagcagttgctggattcttttttgattcttctggttagtgcctcaacaagaaacattttcaacagtgttttcttgcccttttcctctgtagactgtagactgctttgggattacgtctatcagttgctttctgacagccggtacgaaaacttcatccgatgggaggacaaagaatccaaaatattccggatagtggatcccaacggactggctcgactgtggggaaaccataaggtaaaagggcagcagatatctgctccataaactagtgccaaaatgaagtccttatccctggattggaggataatcgtctgtcttctgctttttacgtctgcccatacttatttagtttattccttgctgggcaagcaattaggcagttgcaaagggaaggaaataattaaagatgcatcttgccatttgttcctgagaccaggtgcccattaactcacatatcctggtttgctgggctgcatcatgagtgactcttgtttccactccccttgacctgatcccgccacctccactgttgttaggaactgggtaaaagggaagtacagcaagactctctgactcacaggggacctttgggaagtgccactacttttctgctcagttagaaactcccatgttccccaaagcccatttctttatagaaaatacttagattctgactgtaaaacatcccctttataagcaagcgatgcaagaagtttgccccacaatttcccaaactgggaggagggaatggaattgaataaagtcttttgcagtaaggaagactgctcaagtgcgcagttgtaaaaagcgggtaaccgtgatccaggccagtcgataggtggacctgaagcaaagcctgatgttggcatggtggcacaaccccaatccgctgagtgagtgaaaaggcagggaggcccagccaggtgtgcccagacctgcagccttctaagaaggcagtgggtaatgcagaccatgaccaaatatggcaaggccccactgacagacacttccatgtgtgagtcactgagaaaaatccctctgctactcccactgtaccattgcctcgggcccagaaccactgtattcttgcttccacaacaggaatttaaacaaaagaattgtcttccttaaaatgacagaccagaaacacaagtttgagaaaaggtcattgcaacaaaaaaaaagaaatgctgtgtgggtcagaaggtgaagggtgacccagagatagggggaacctgcaggaaattcctcaggcggagcagagagcggtcttgggaaaaggaaataagcgaggctgctatgggatctgctttattagctagggctccaggacttcggacaaagggtgattcaccttaggagtaaaccttggtgacagtgaatataaaaagctaaagggtggggacagatgtgcctggaaggcagccgattagcaggtagcttcccaaactggcagggccacaggcagcagctgaagagcttttattttaatagctcccgcagtgccttttctgaggttcatttcattgtgtctttgtgctttttttctcccttcctcctttgaacaaacagaacagaacaaacatgacctatgagaaaatgtccagagccctgcgccactactacaaactaaacattatcaggaaggagccaggacaaaggcttttgttcaggtagcacttcctttttctcctttccttcttttgggaggatgctgttttctttaaataacggggagtggggggagactgttaagatctctacctgcctatcggatacccaaagccaatcattgctacaaactggataccaggtactggtttgttaggatttaaggaaaatatttttttaacttatgtctgtcctgtaataaagccaaaactaaatgaacagaatctgactcacctttaaaataacgcagtgaccaaataatattatgtggcattaaagtccggtgtagttaaaagcacaaagtcaatggcaaaacaaggaattaaacctagacttccaggttaccatcgctgtaaggcaactttctgaaccagtatttgtcaaaatgcaggtaatgacccacagtgagtcatgaaatagattgaatgggtccatcagagcttttttttttaatgaaataaggataggataggatagagttgaaaatgccagactgcatgacatgtagcaagaatgacagttgattcatgaaaatgttgttccaggtgtgtatgtacgcgatgagtcatgatgtaaaatgtatttcttataatgcatcgtagtcagaataagtctacaagctgctgcactagaatttttctttccagaattcctcatagataatgagttccaaccaagttagcctgccaccacatagattgtaattccaagtactatgcaagagaggagaaagaactggaagaagaaggagggatctgaaggaccaatcaggagatgtagaagtagacctctggtgctggtggtagtcattagcggggccaactgcaggttggtagaagtgagatcaacaaacacaaccttgggtgatgacttttggcaggtgggccagaagagagtggcagatggggctagagatgtagattgtgaattatctatatacaggtaggaagtgataccatgtatgaacagatgagctcactgatatgattaatttattggaaagagcagagaatctggtctttagcattgggaaggaatggtaacttaggaatagtaaaagcaattaagatcttcaaaagaaacgggaaaggctcttcaggaaagggaaacagaatagaaggaataaaaaaagaaccctccattctctggctctaccgtatggcttttcttcatccttcaacctaaacgcagtccttggctccctttcttcccactctatacctttttcgtggatgaactgatcccgacacacaacttcatttatcacctcagtggttaggctcttaaatctctatatccagctctaaaatctccctgaaattccaaatttgaatgtccaagagtttcctgtaggctgtgtccccttaaatatcacatttaagtatttcagacatgacatcttcaaaacagacacttgtctcggattagaaattccacccagaggccgggcatgatggctcacacctgtaatcccagcactttgggaggctgaggtgggcagatcacgaggtcaagagatcgagaccatcctggccaacatggtgaaaccccatctctactaaaagtacaaaaattagctgagcgtagtggcatgcacctgtagtcccagctactcgggaggctgaggcaggagaatcacttgaacccgggaggcagaggttgcagtgagctgagatcgcgccactgcactccagcctggtgacagagcgagactccatctcaagaaaaaaaaaaaaaaaagaaaagaaattccacccagaattattgaattctttactcatcaggggcatcactgctgtttgaagcagccaactttgaaactacagttccctttgactcctcctgtatcccagtcattgtgctagatggaccattggctcttcagcaccattcccactctattctgtgttgcaggggctagaagcctgggaactacatttcccagaagggaatgttgccagaagttcccaggttggagtctttcagtgacaagcagtttcatgagatctgggagactagaaaaaagtaaaggcttccctggcagtggaagctgatgtctggacttcatgattcacatcgggattcactcaacaacgtctttctgtctctagtccactctgctgcctcctgaaaccataatacaaactgccagctgccctacaacactaatacagttccctatgccagaaatgtatatgactaacttttgcctttttaatacctacaccctcaaggctcaacctcaagtctgttgccctgaatgaggccttcttcagctgctccaacacacatagctgtcgtcttccatcatcacctgggtttcctggagcccttaactacactacaatttgctttttcttttcttttcttttcttttcttttttttttttttttttagacagagccttgttctgtcacccaggctacagtgcagtggcacaatctcgactcactggaacctccacctcctgaatttaagcaattctcataattatcatgcctcagctaatagtagctggaattacaggtgcctgccaccacacctgactaatttttgtatttttagtggagacagggtttcgccatgttggccactcttgtctcaaactcctggcttcaagtgatctgcccaccttggcctcccaaagtgcttgaattacagatgtgagccactgtgcctggccaacttgtttgtttttctagagacagggtctcactctgttgcccaggctagagtgcagtggtgtggtcatagctcactgaagcctcaaactctgggctcaagccatcctcctgcctcagcctccggagtagctagagcgactacaggatttatattttgaatacaggttgagtatccctcatctggaatgcttgggaccagaagtgtttccagtgtttggattagggatgctcagcctgtagttttatgtgtcaagtccttctccccgacaactagattataagctcctagaaggtagaggattctattttttatcattctatattaaacctttcagttaatgcttattgacagcctggtgtggaatatcagaagcttaatatgggaaagtcgtcaaaagaagaaaggggtggtttggggggccaagcataggacatctgtggagttggcttagaggggctctttattgacttcggatgtggagggagaaattttagttaggggataaaagaggagaaaaactgcagatgctacagatcatactgctggagaagtttgccagtaatgagcaggaaaagcagtagtagccagaagattgataggcttccaataaaagattttcagtaagagaaaggaatagtgctattagtgagggagagattagtccattttgaggaaatgaatgttagaagccagacttgccacaaaatgaaggtttcttggtataagacctagtatgtaatcaagtgaggtgttgaattgtagatactctttacaagatgtttgagtgttgaagaagatggaggtttaagtgttgaaatcatggactagtgccattaagcagctctttgatgaggagacagaacacaaagaatgagtaggactcaactcgtgagaagagtcaggagggctccagataagggaaaagctaaagatacatgggagagcatgcgccatgatttatacaagagccaagaccgctagactgcattgggttcatactgatgaacagtggaaaataagagcttcctaggtaaagatggcagaaagacccgatgagcagagcaaaggatgcacctttgacttgatgagtggtcattttaggcttttgcatgtggaggaatgagagaaaatgtaagctctaagatagtggcgcagggcagagtatatggggagagaaaggtgtgcaggcacagaaggggactggaacgggtgctcctacagtgtaggtggaacatctgcaaccaggctgccttcctgagccatgtaaattatggtcaaaacatgtcactgatgtcacttccagtttaacccattgaacaggaagatgaggcttgctgtacaccccagttgcaaaggtagacagactaaagagggttcattgctggcattttgggtgaatcagtgataacattgtaaaagatttttttttttttttttttttgcccttccaattttccagaagctccactaagttgtcctattgtcagcatttttcacttaacatttaactatatcctttgaaatttaagtaagttttgaataccatttcctgggctcacagtctggaatggaagtggatatacagctctcatgagtctgtaaaatctaattctgtaaaagaaagaacatatatacatggtctggaccaaggctttctcgtgtggtcatgcattaatgcaccacgtgatcccaaagggtgctcactacgtcacagacagcctagacttttttttttttttccaataattaggatttcactttgtcacccaagttagagtgcagtagcatgatcatagctgactgcagccttaacctcctgagcttaagggattctcccacctcagcctcccaagtagctaggactacaggtgcacaccaccgtacccagattttttttttttttggtagaggtggggtctcgctatgttgcccaagctggtctcaaactcctaggttcaagttatcttcccaacttggcctcccaaagcactaggattatatgcatgagctaccatgcctggccctagtctttttaaataagcattttaccactttttagacagtcagagaaaggagtaccttttcctaatttgcactaagttaacattaatctcggggttcagtagctctccagctgtataagatgatggagtctttctttatatacaggctagagttcagagtgaagacagctttaggaaaatggaatctcttacctcctccacttcttcttccaaaggtttatgaaaaccccagatgaaatcatgagtggccgaacagaccgtctggagcacctagagtcccaggagctggatgaacaaatataccaagaagatgaatgctgaaggaaccaacagtccacctcagcgggccagcagcccagggaacccctgcccaccaggattgctggaagtgtgacggagcaggcgggctgaggagagtggaaaaggaagcgacccagaaatggcagggacacttctcttgcagaccaagagggaccctggagcaccttagacaaactacccagcacaggcggggctggaattctggcggagggcatgagcctgggactccatgtcacgtttccttctgatttggaatctctccatctgtaattcctcaccctcacccttccaccgttgttagtatcatggtgtttttgtttttgtttttgttttaagaacctgcagtttgactcttcatcgttcatctaggggaagacatctgatgttgttttcctatggaaatatatatctattatatatatatattttttgcaaatctcacaaagtgcggcaagcccagctggtcaggaaagagaatacttgcagaggggttcaggttcctctttttcctgccacgtggatcaggtctgttcctgttactgttgggtcttggctgaaaaaaaaaaatgcttttaaaaaagataaaatgaaaaggagagctctctttttctctctcttgctctgttcttcccttggtcccctctgtcctcccgccctgcctgcagttgagattcagatgccttctgacagagttcagcctcttggagagtcttggggattgttggcacctaaacagaatcagtgacccgggtgctttgtggccagcagcacagaatcaaacccgcatcccagcattgggccacccatctgagggaggccaaaatcatcacagatgctgctgtgctgcagacagatacatgctagtccagagagccgcccctgagatggctgtgagaaccatgtgtctaaggcgtaagataaggatggaaggctgtccaagttatttggaaggcctcggcagcttgggattagcttgggagcgcagcgctgcaaagtggaaaatatgaaaagaccacacaggcccagcagtccagaaactgggcaaaaatattctgcagtggggatttatttttccaaagcaggtaacagaggctagtgagaaagaaaagctcctctctgctccattccaaaggccatcttgtggtcagtttcatgccctcacctgattttttttttttttttttttttttcaattcctaacctttttcaaagtttcctggtctccactggacacagagctttggagacggaggatcccagagggcagtctcagttgcaatcagtgtgtgcccagcctgggcagacaggaaattcctcggatacattattttttctttctttcatagctgtgtctcagaaaggacccatttgtggctctttttcacctcaaaataagatcgatggtatcttgtaaaatgagggtagtgccacttcttagtatttttgaaagctgttttagattttttttttttttccttttctagccatctaaattgactcttccaatataggtctcagaaatccaatatttggagtacaatttcttttaatccagattacacctgccttacaaagcaccccctccttgttcccctctgtttcctctactcagttgggggagaaactcacagctcctccgggatacatatgtgccctcagcagcagctcccaggtgaagttaccagacccctgggcttctccccagctttttctgagttgagtcagacatgtagagtttgggtcacacaggcaagaggaattttccctcggccttactgacaaggacaccaacctagggtgcaaacagatggactatggttcaaggacactggaattgaggagctgatcaaggctctcttcagccttgctctgtccctgcctcttatcagagcacaggtagacacacgggcatagccagcccactcctactgtcacaggcgccccaccattcaaccttccgggaggtcagggaccttctatatgaggcgagtgggtctcagtctgcttgaatggtgatgagattctgctggatctcagcacgctgcaggtgtcttttgagagcattcagtaggacatggtgatccctatttcagcctctaagatgactggtattctatctgaaatgcagagattaagccaaatacctgatgtattgtgaaagccactgattttaagaatggagagaaagggattttttactgcatccctctgtatgaatatgaaatcagagaccagggcatgatgttgctaggattagagcctctcagtctggcctcttcacccaagtgcaagaactcagtctcttactgttcaaagaatcttaacagttgaattatggagggaaattcccttttgccccaagcatttctatatttaaagcaatatcccaggagaatatgttagacttaggatgataccttcagccacttgaagaagaaatagaaggcgctcattccaatatagtctttatttcccattcagatacaggttgagcatccctaatctgaacagttaaaacccccaaatgccccaaaatccaaaccttcctgaacgctatgacaccatgagtggaaaattccacacctaacaaacacatttgctttcttatggttcaatgtacacaaactgttttatatagaaaatgatttcaaatatcataaaattaccttcaggctatgtgtataaagtatatatgagccataaatgaattttgtgtttagactttgtgtccatccccaagatctctcattttatatatatatatatatatatatatatatatatatatatatatatatacacacacacacacatacacaaatattccaggatacaaaaaaaaacatttaaaaatccgagacccagaacacttctggtcccaagcatttcagataagggatatcaatctgtactaccaataaggatttcgtaattcccctaactgcaaatgtcctcttcatttgttctttatgagaaaacccgggtagtgccagcacctggatacagtatttacaccctgcagaccctaaagatttcagattcagttagcaaaccttgatgaagcacctgctggacactgagggacccaaagctcaatcagccataatccctgctttcagagtttatattgtacctgcctaatccacccggcgtgactcatttcaacactaagtactaggggtgttgtcaggagacaaatctgaagtcaggagaggaaaatgcaaaggagccctgccgtgtgatggatgtgcattctcacttgggtcttgaagttctcattcctacatctcaagctagccaggcagtctcctctctatcagaagaaagcactggtaattggctagactggctatgttgaaggtaacatgaactctaagatcttgacccagggcgacttggttttgcttaaggtggcatcaccaatgttccaaatcctttagggagatgagggtatccccacagaaaaagaggaataatagaccaatggattttctcctttcaccagtatgtttggaaccctctgatccaatgtcttttgatactgatctcttgtccaaatgagaatgtcgctttagctgaaattcaaatggctgtgacaatttaccgaaatgatgaagtaaccaccattcccacctttcactgcctaggctccaagtctgaatacatttttgaaataggaactcccttttgcaaaaaagaaacctgggtgtcagggaggtgaagtgacttgccctaggagcagacagcatgccaagaatggaattaggctcaggatccagcctgggctcaccctgtgtggctcattcccacccaggaaactgaagataaaagatttgggaaaacacaccaagaaaaaggggcagttttctttgcccaagcatttggtgctagttagaggctgttcactctctcctgctcctcttcggagtagaaataaaggctgtgacacaaggaagccagtggggtgggagggaggcaccataatccctccctaaaacccacagaagactaacctgatactcttttgacccaactgcatcaacactaaacagctgcagaccccctgaatctttcacacatgccaagtgaacattcttgatgatttctctttgtgaccgcaaccacctgcaaaccagaacgactctagaatttccttccccgcccccctttttgtttagtttctaatctcttgtttatgaggtgtggggtttataagggactgaatcaaatgaatgtaacaaaaaagaaaaaaaaaacaaaaaaaaatgccttttctcagggccagtgagttgcaaataatttttaaagaaaagcctataattacatcatctcaataaattttttataaaaaaaaaaaaaccatgaagtccagagtctctgtttttaataatatgaaatggagtcagacaaggtgctccgatgaggtaaatcctgtctccactcaattatggtataaagggcaatcatggtttttctctggcagcaagtctccgctgcagggcagtctgcaggcgatctttagacaagtggtaccggaaaggtcagagtgaaccattccaagctgagcagctgccacaggtggaagaattaccaagaggaaccgtgatcagagatgcttgggtcccatgctgtggtgaaggtttattagctcactgagaacttagcaatgccaggtcctcacacaatagaattgccccttaaatctgctgagatcagaggtctaagcctaccaggtgatgaaggcgtaagggctgggatagatcctatgactaaatacaggactgtaatgacctagaaggtcatcacacagctcagagccagcccacatgctcagaatgtcccagccaacctgaccaacagagccacccaccaaccagtgggcacttgggagttcaagatcaaacattctgcacttgaccagaactatctgccatcagaagtgggtggaaacaaggggaagaatggaagaggaagcaaatgcattgctgttgagcaaattgggcggaggttcaaaatgtctaagaaatcagcagtctcagaaaatgttcttagtttacttttgtctttaggttaacccagttactctgtatcccctgagaatgattgctgaaatttggccctatattctgtatgatcagagcacagtatcaaataagggtctagatattttttttgtggtgctaaaaatgcattcgaagctactatttctataatgcagcattagagaacttgctagaaatgcaaattatcagttcccaccccataaactgaatcagaaactttggagctgggacccagcagtatgttttaacaagcactctgggtgattctgatgcacacaaaagtctgagagtcactgctaccaatttcttcatcttagtatgaaagagagcttgtagcaatttaaacaataaactcaaaataattgatgacaactaatttgcatcaatagtactcacacacaataacgctgcattttcctaatggtagatatactgtggaatgaggctaagtggacacagaatcacataccaaagtcatcgtcttgttttctccaaaccttttaagcaatcagtttgctgtaaagatgagctgttttaaagggtaactcttaacagctgacctgcccttgcaaattagagcacagcaatttatccacttatgcccacttatctgcctaaccagcctgatctaaaaagaaaaataaaaggattattctcatctgctaactgaccttggctgtctgtccccggaattattaaacagagcctggatgagcatttagccagggcatttgcagaggactctagaaccactggactagaccagtgcttctcaaacctgaaagtgcttatgaatcatcagatctcagggaaaaaagcagattttgcttcagtagtatcttgggaagtctggacagaagatctgttcttctaccctactctctgggtggggcttgaggtgctgcacttttttttttttttttttttttttttttttttgagacagagtctcactctatcgcgcaggctggagtgcagtggcacgatctcggctcactgcaagctccgcctcccgggttcaagcaattctctgcctcagcctcccaagaagctgggattacagatgcctgccactacgcctggctaattttttctatttttagtagagacggggtttcaccgtattagccaggatggtctcgatctcctggcctcgtgatctgcccgcctcagcctcccaaagtgttgagattacaggcgtgagccaccgcacctggctgaggttctgcacgtctaaaaagctccaggtagtgctgatggtgctggtccagggaccacactgagtagtgagaagacagtctcccttcagaccctgaaatgctaactgtgatgcaaaactgaccgaacccctccctttgttgttttcctctgctaattcctccctagaatggtccctgggcccagtcctgctctgtgagaagtttgcttgttccctttcagggcagcatcaagagtaaacaacatgatcaaaagcctcttcaccaagtgaaggaacagctattcatgtactggaccttcatacagacattcataaccagatgcctcatggtcatcattcttatgggaagcaatgagaattccaagcatcactgcctctcagcctctagaaagaccagtcttggtcactgaaagcagacagaacactaacaatgccattcttgatgttctaaatggcatagataggatggatgagcagatcttccatgcaaacagtccaagatgctgacattaaaatcagataatcctgtttgttagtacttaacagattcactgttttcttattttttttaattaaggccttcagtctctgccagattaagatgatagatttctgttagtaaaaaccactgaggaacgtctgcttaatctcttctgagacaatagaagactatttcctctccccaaaccctcttagcagtggccttctggagtcctctgagatgttcatgccttttccctcaaccagaattttggtcatgagatcccatatcagaccatccacctgagttgaactttgcttcctccagtgcctctgggagagctaagtgctagctcggtgccccagctgcaagcacttctataaaagcaactaaatgcctccatgcagtgaattgctcatgtgcctctgtcccctactaaagctctctaaaggtagagtattttatgcacatttttactaccagccccttgcatggggctggcacaaggtatatgttaataagtgttttaaatgggagtgaagtcagagaaactctttgtgaccttaatttaggcaaagatttcttgaatatgacaccaaaaaatccataaaagaaaaaaatggataaattggacttcatcaaaattaaaacttgctcctcaaaacacaccatattcagaaaatgaaaagataagttacagactgggagaaaatatttgcaagtcatttgataaagaacttgtatccaggataaacttccacaactcaataagatgaataacccgattttaaaatggtcaaaagatttaaacagacatttcaccaaagaatttatagaaatggttgttaagcacacaaaaagatgctcaacattattagtcactaaggaaaggtaaattaaaaccacagtgagataacaactcatccacaaaaggctataataaagactgtcaataccaagtgttggctaggaggtggaaaaactggaaccctcatacattgctggtggggatgtaaaatggcacagccactttggacaacagtttggcagcttcttaaaaagttaagcataaatttgtcatatccaaaaaatttcactctgaagtatcttctcaaagaaatgaaaacacgtccacacaaagacgtatacacaaatatttagagcagcattattttactttattttgagatggggtctcactctgttgcccaggctggaatgcactgatgcaatcacacctcactgcagcctgaaacttctgggctcaagtgatcctcccatctcagccccctgagtagctgggactacaggtgtgtgccatgcgctggccaacttttttttattttttgtagaaacagggtctcgctatgttgcctaggctggtcttgaactcctgggctcaagcgatccacctgcctcagcttcccaaagtgctgggattacaggtatgcgccactgcacccggcccagcagcattattcataatagatcgcttctgtaatcctatcacttcgagaggctgaggtgggatgatcatttaagcttaggagttcagtgtgggcaaaatggtgaaaccccatctctacaaaaaaatttaaaaattagcagggtgtgttggcaaacacctgtggtcccagctacttgggaagctgaggtgggaggatctcttgagcccaggagattgaggctccagtgagaagtggtcacaccactacactccagcccgggtgacagaggaagaccctgtctcaggaaaaaaaaaaaaaaaaaggctgggcgcagtggctcacacctgtaatcccagcaactcgggaggctgaggcaggagaatcgcttgaacagggaaatggaagttgcagtgagccgagatcacgccactgcactccagcctgggccacagagcaagactctgtctcaaaaaaaaaaaagacaaaaaccagacacaatccacacatccattaactggtgaatagataaataaaatgtagtagatccaggcaatggaatactatttagcaacaaaaaggaaacaaaccattgatacatgcagtaacatgaatgaaactcaaaaacatattcagttatataaaatttccagtaaaggcaaatctataaagacaggaggagatgagtgtttacctggggatggaggtgggagtggggattgaatggaaacaagcaagagggaacttttggagataatggaaatgttctaaaattggatagtcatgatggttgcataaatctatacatttactagaacttattgaactgtacccttataaagaatgtgttttaaggtacataattttacttcaaaaaagctgttaatacaaaaaaaaaggaaaagaaaacaatctacataaatcaattcacgctggttgtatggtaagtgggactgtcttcaggagctgcacataggactcaaataaaggaattatagaaaaatatactaataatgtaatatactaataaaaatgaaacattaagagaaattatgacagcaagaaatcaattacattctgttcatcaaccaacctccccagggctaggcctctcaacagtccaggaagtctgagtaaaccacggctctctcagaaatactttaaactatggacaccccagaaggaaccccagaaacacacagcccttgatggccaccccctgccagcatcaggtggctccaggcagttgtatagacagcggccctaatttgaactggtagcctaggatattggaagaccatttgatgctgagactccaagtcatagattcttaaagctacacagcaacataaaggccatctgaatcagtaggtgtttgtttgtgttatgtgtggccccagggcttcccaaaggggataaggagcaatgggggagaaatgcctcaggaatgaatctgggagcctgagaaggacccaactgaaatcagacgatgggaacaccaagcagggagatggtttaacacacctgtgggctattattcttcaactatgaaattaacatctatttagttggggtgaagagcaaattattttttactcacaaaaatgatgagacttttagccaggtgtggtggctcatgcctgtaatcccagcccattggaaggccaaggcaggtggatcacaagttaggagtttgagaccagcctggccaacatggagaaaccccatctgtcctaaaaatacaaaaattagctggacatggtggtgcgtgcctgtagtcccagctatttgggaggctgaggcacgagaatggcttgaacctgggaggcggaggttgcagtgagccgagattgcatcactgcacttcagcctgggtgacagagcaagaccttgtctcaaccacaacaacaaaaaatgatgagacttttatgtacaaaataagaaatgcattatatgcactgaaaatatcattacatttttactttatct

SEQ ID NO: 1877 - DNA, 1393 bp, Homo sapiens
gcttgcagccaatttactggagcagggatgacgtagcccagtggctcaagtgggctgaaaatgagttttctttaaggccaattgacagcaacacgtttgaaatgaatggcaaagctctcctgctgctgaccaaagaggactttcgctatcgatctcctcattcaggtgatgtgctctatgaactccttcagcatattctgaagcagaggaaacctcggattcttttttcaccattcttccaccctggaaactctatacacacacagccggaggtcatactgcatcagaaccatgaagaagataactgtgtccagaggacccccaggccatccgtggataatgtgcaccataaccctcccaccattgaactgttgcaccgctccaggtcacctatcacgacaaatcaccggccttctcctgaccccgagcagcggcccctccggtcccccctggacaacatgatccgccgcctctccccggctgagagagctcagggacccaggccgcaccaggagaacaaccaccaggagtcctaccctctgtcagtgtctcccatggagaataatcactgcccagcgtcctccgagtcccacccgaagccatccagcccccggcaggagagcacacgcgtgatccagctgatgcccagccccatcatgcaccctctgatcctgaacccccggcactccgtggatttcaaacagtccaggctctccgaggacgggctgcatagggaagggaagcccatcaacctctctcatcgggaagacctggcttacatgaaccacatcatggtctctgtctccccgcctgaagagcacgccatgcccattgggagaatagcagactgtagactgctttgggattacgtctatcagttgctttctgacagccggtacgaaaacttcatccgatgggaggacaaagaatccaaaatattccggatagtggatcccaacggactggctcgactgtggggaaaccataagaacagaacaaacatgacctatgagaaaatgtccagagccctgcgccactactacaaactaaacattatcaggaaggagccaggacaaaggcttttgttcaggtttatgaaaaccccagatgaaatcatgagtggccgaacagaccgtctggagcacctagagtcccaggagctggatgaacaaatataccaagaagatgaatgctgaaggaaccaacagtccacctcagcgggccagcagcccagggaacccctgcccaccaggattgctggaagtgtgacggagcaggcgggctgaggagagtggaaaaggaagcgacccagaaatggcagggacacttctcttgcagaccaagagggaccctggagcaccttagacaaactacccagcacaggcggggctgg

SEQ ID NO: 1878 - protein, 397 aa, Homo sapiens
LQPIYWSRDDVAQWLKWAENEFSLRPIDSNTFEMNGKALLLLTKEDFRYRSPHSGDVLYELLQHILKQRKPRILFSPFFHPGNSIHTQPEVILHQNHEEDNCVQRTPRPSVDNVHHNPPTIELLHRSRSPITTNHRPSPDPEQRPLRSPLDNMIRRLSPAERAQGPRPHQENNHQESYPLSVSPMENNHCPASSESHPKPSSPRQESTRVIQLMPSPIMHPLILNPRHSVDFKQSRLSEDGLHREGKPINLSHREDLAYMNHIMVSVSPPEEHAMPIGRIADCRLLWDYVYQLLSDSRYENFIRWEDKESKIFRIVDPNGLARLWGNHKNRTNMTYEKMSRALRHYYKLNIIRKEPGQRLLFRFMKTPDEIMSGRTDRLEHLESQELDEQIYQEDEC

SEQ ID NO: 1879 - DNA, 63248 bp, Mus musculus
  misc_feature (1)...(63248): n = A,T,C or G
acatattaatggtataactttacaagtacttctattttttccctcattacatttttgagattataaattgatgacataattcctcccttccctttcctctctccaaactctcccatatatccctttctgctctatttcaaattcatggcctttatttatttatttatttatttatttattcatggttttttggtttttctagatagggtttctctgtatagccctggctgtcctggaactcactttgtagaccagctggcctcgaactcagaagtctgcctgcctctgcctcccgagtgctgggattaaaggcatgcaccaccacgtctggcatggcttttatttttaaaactaattgttatcatatgcatatatatatatatatatatatatatatatatatatacctaactataacttcatataatgttacctgtatgtatgttttcagggctgactgtttggcagtagacaaccaatttgtgtactctttcctggggaaggccatctttcccattctaggttgcctatagttctctgtgtaaggttgagacttcgtggccttttctccaacaagtttgaaagtttattggtattatcttgttcagttcacatctgggcagtggtttgagtgataatagttccataggcttatatattagcctgcttagtctccagtttgtgaactgtttcagaaggactagagggattagaaggtgtggccttgttggaggaagtgtgtcactgggtggtctggcctgcttcccgccatgatgataatggacttctgaaactgtcagcaagctcccaattgaatgcttccttttgtaagagttgccttggttacagtgtctcttcacagaggtaaaacagtatacatgataggcagttatggcggtgagattctatgagtctagtctctaatatttcttggagccacaatctcatagcaaactccctgaccatcatgctcttaacatcgttctgccctctcttctgcaatgttctctgagaattagatgtgggagtgtttatagatgtacctatcaaggctaggcttcatagttctatattttgattggttgtggttttctgtaacggtctccatccactgcaaagaagagttctcttgatgaaggattaagactttccagacagccctccttctgagtttacctcccttgccttccttcctatcattttaattgtatcctgaaatttccctttatcctctttggtgatttgaatgaaaatggcctttgtagctcataaggagttgcactatttgaaagaattagggcatgtagccttattggagtagaggtggctttgtgaagggggggtgtcactgtgggtgggctttgaggtttcagatgctcaagccagtcccagtgtcactctctcttcctgctgcctgctgccacagatgtagacctctcagctacctctccagcaccacgtttgctgacatgctgccatgcttcctgccatgatgataacagactaaacttctgaagctgaaagccagccccaattagatatttttctttataagagtggtcatggacattgtttctcttcacagcaataaaaccctaactaagacaccttattctgtatttacctctcacctcctccttaaggaacttattttacttgttctaattctgttttgtaagtttcttttcaaatttctatttctcggcattgatatacatatttaatgatgtaactttactgcttcttaaggttcaatcaggatggagatttgttttctttacacaatttaaaaattgtatttattgtgattgtgtttgtgagcatgtgagcgcgggtgcccgtgccttgtgtacctgtagaggtcagaggacaactttgtgtggttggttttctttccatctttatgtgagttctttgaatcaaattggttcttaatttgcttgtttggataatattattgtgcactgtggaaaagcatcacggctcaacaaaaagctgatggcctctagcgaaggaggagagaataggcatgatttctggcagagataggaattctaggagttaggtgtgggagaattccccagccagacatggaggaagaagcaggccgggactggaggagaggtaactaatgagccatgttgcagaacttagactagaataaacaggttaataagttataagacctggatggcaacaagcctaagcaaagaccttaagcattcataataagtataagtcaccgtgtcatcgagctggtggctccaaagaaagtcccatgtgcttgctttataataaaaaaaaacttttttaaacttgtattttcaatggtacacatgtgaccacctgacctttttagtaatttttgtcatgacatattttgaaacgtttctaatggccatcaagtgaacattccataaattattcatcactttttagtgtttagcatataagctgactaacattgtctgtgttcattttttttttgtttttgtttttggattttggtttttggagacagggtttctctggatagccctggctgtcctggaactcactctgtagaccaggctggcctggaactcagagatccacctgcctctgcctcccaagtgctgggattaaaggcgtgcgccaccacgcccggcatctgtgttcattttaaggcagcatgtagaaggcaaaacagacatattgatgacagccaaagagtggaaagaaagcacaaccagtgtgttcatgcgtgtgcacactcccgttgttgggtggaaatgtgaaaaatcacagccagatcaatggaatttaagatgagcgaatattttctggaatgacccagagggcttcacagttattaggttggaagagttggctcagaggttaagtatgcttcctgctcttccagaggacccaggttcagttctcaacacccacactgcagctcacaaccttctgtaactccaattccaaggcttctaactcccttgcctgacctccaagggttcctgtatgtcctgtatgcccgtggtgcctattaactcattcaggcaaacacacgtgcacataaaacaaacacacaaaaaatctttttaagtttacaataatgatcatatccttttcttctttagcttctttcacaaaagaattagcatggactcaacaaaacaaacaatctagttaaaaacagaccaaggatctgaacaagccaaagaagattatacaaatgacctcgaaacacatgagaagattttcaatgacattaatcactagggaaatgaaaatcacaactgaaagatatcacctgacacctattgggttgtctgctatttaaacagaccagaaaataacaagtgttggcaaggaatccttgtgaactacgagtgcgaaatagtaaagccactatgaaaaatagtccctacaaatgcatttttaaaaaaaagaaagaaagaattaccatataatatagcaattcaacttttagtattcattcaaattagtcaaattcagggtcttgaataaatatttatacatttctgctgaaagcatcattattcacaaacaccaaaaggtggaaacaatccgacggtcccaggatgggtgtagcagccgagcattagtcagctttaaaagtgaaattctgaaaagcactatgacacacatgaaccttgaagtcacagaaagacaggttctgtctgagtccactcatctgaggtacctaggacaaccacattcagggacacaggagaaggagggctgatgtcagagactggaggaaggggacagtgttgagttgtttcatgggcagaagatgaaaatatttctggagtaggattgtacactttaacatgcctgagagaagaagctagggtgttacctcagtggttaccacacagcacgaggaccaccacatttgaatcctagaacacatggatgtggtagcacgggcttatgatcccagagctgaggaggcagaagtgggaaaatccccggagcctgaagaccagctagcctaatctagttggcaaggtctgagctgatgagagaccctgtttcagaaaacaaggttgacaatacctgaggaatgacaacaggttgtctattggtctctgtgtgcacttgcacacactgtctatctgcctctgtgtgcacttgcacgcactgtctatcttatctgcctctgtgtgcacttgcacgcactgtctatctgcctctgtgtgcacttgcacgcactgtctatctgcctctgtgtgcacttgcacgcactgtctatctgcctctgtgtgcacttgcacgcactgtctattggtctctaggcctctatgtgccacacaaacacacatggatcatcaaacacacaaaaacatgcacacacatgtttaagatgatagattttataagtattttaccacaatttaaaaaaaaagcatactaaaagtgagtttggatggtctatggtatttcatattttgtaaaacgtgttcgtgtatgtgtccattagattctttacaacaacttgcaagggagcaggctgtgtgttataacttccctttggcagtagaagagattccttgtaggagtagggattttgtaaactggctcaacaggaatggggatgttttaaagtgacatctgtgcccctccctttagctctcagactatggaaacaatggtccccaagaaataggaatttcccctggaatctcatgctgggagaagaagactgaagcctggtgccaggcagcggaaaaactttctttcgttttggttttggctttaagatgtgggtttctctgtatagctctggctgttctggaactctctgtagaccaggctagcctcaaactcagagattggactgcttctgcctcccaaatgctgggattaaaggtgcctcctcccaagacgtttttgttttgttttatttttcagaggaaaacctttgtttccaggaaagagatctcacatgtctgacaacttatcagagtaggtgatgggctggactggactacgctttgaaggtgactgcttagctctgcacacctctggccctgtatttaaaccttgatgcaggcatccatggttatgagctttgatgtgatctcttctggtcttcatccctaccagctctggggctctgacacctgtgacctactttttgcatcctcttatcttcatctctgcacacctgtcttacaggacccacgagagcgctctctaccatccactctgctaactttggagacccggtcagggactagagtttcctcaggaagcttgctcagggacttcatagaaaatggcgttggcatttagcctccctcagaaacctgaacagaattttagtgacatggttgggtaaattctgacaaatacatgcacccttggaccccacaccctatcaaaacacagagtatttctagcaacccagaaagtttggcactggaccccaaagcaactactctttggatttttttactctataagaaatcttggttgttttcaagcaggtcagcaagagtgggagtgtgggaggcactggttatttactgggcattgttcctgagctattgtttctcacctaagaccatggccctgctgaatgggggtgggggtggggcacaaaaacacagaaaacaaagaaataacttcctctgtttctcacatttagctaaaacttccctttccttgggtagtgggggccaagttctggtttgaaagaggatgaaggaaggtgacatattaaagaaaaggataccccattcctacatgctccctgaatctgccacaattgccactgttgtctctttcagatcctaattattaggcttccttaggcatgtgtgctctatcctctgttcctagctcttagatctttgtgactcagttaataaatccattaagctggaaaatgagggtccatgtcagcccttgagatggtcatgacatttacacagtatccagacccttgggagcttacagtctagtgggaaagaccaaaatacaagaagctaagaaatacaaacgctacatcagtcatctctggacctctggagtctctttcctttaaaaaaaaaataacaatttttattagcatatattaggcatactttgtttgattgtggcatcttcatatatgcaaagaatgtgttttgatcatattcttctctctcccactagcctcttttgtcccctatttccattgtctgcctcattttcccaaagagtaggaatttcttccttgggatgcaaccaactcactgacagctccaaatgctgcaagacttctccctggccctcttcttcctcttttttttaccaacttctcctcatcaggaaacaacaatgtctacctctgtgttctccagagcttttatcaaatgcaccctccctccatgccttcattacaacaagcctggcttcttatcttttcatccatcttctgcactgtgactttctagccacttcgacacctgtctcaaagcctgtgtcttagttgcttttctattgctgtgaagagacaccacgatcaaggcaacctataaaaggatgcctttaatttggggcccacagttccagaggatagtccatgatcatggtggggagcagcaggcatcttaacatggtgctggagtagtaagtgagaacttgcatgttgacacaacaaccatgaaggggagaggggaagggagggcgggagagagagagagagagagcgagagcgcacattaattgggaatggcttggacttttgaaactttaaagtccacatgcctcctccaacaaggctatacctcttaatccttcccaaagagttgcatcaactggagaacaggcattcaaacatatgatcatagctgggccattcttattcagtctggcccagctatttctctgagttcctaggcttataggacagaacacagagtattcaacgttcccaaccgcctagccttgcccacctgcagccttagcctgctaaggcaggcttgagagacaaggaaagtgaatggaacattcaagaagactctccttgctctgggctctaatttacctttcctgctgacagaatcaaggaattgtaatacaaatgataaagagaaattgactacagagataaaaaaaatctcaaggttgatgtgaaaaacagtaaatgaactagtctattaattttaatcttgttaatttaaattttacacgtgtgtgtgtgtgtatacttgtgcatacatatagcacaatgtgtatgtggtcgtcagaggacattttgcgggaatcagttctctcccttccattgtgtggattctagggattgaacttagacttcaggcttggtggtaaacacctttactcactaattcatctcactgacttccgtgaactattcttacataggaccagaatgtttgtaatcctgaatttttaccatattggcaggcatctctcatctttaaatctaagatttgatgtgtgtgtgtgtgtgcgtgcgcgcacacatgcatgaatgtagtgaaggccagaaaagggagttagattctttggagctggatttaactggcggttgtgagctgtccaacataggtactgaaatctgaactcctattcttagtaccagcagtaaatgctcttaaccactgagccatctctctagatccttcatctctaatctaaataatgcacgtcataaaagcacattacaacttcatttactacaaaaaaagtccttttaaaaggctaacaaattcatacacctacttaacttttaaaccttaatttagattttgcataatctttaaaccctgtactttacatccgtagagaagttcaaacttctaaaagctgcaaaatcattcacatagacatctaagtgactttccgtggaagagcccacactcatgtcttgaggttgtgcctgcccctttcctatacaactcactctctatatacttagtaaatgtgctaacttgacttcaccatagtttatcctgaaaatttgtggtataggcaagattgtggccatgcaccagtggaggtctgtaacacccaaaggaatgactggtagccacagtgttgggctgtatctccctgctgctactgacccctctaccccagctctcttttctggcctgagaggctgccctgcttgtctacatcactgatccttcctgcctttagccactgtttaggagcctcccagcccagccccacacacccacaaaatacgctggtatctcagctctgctatctaggctgtgcatttctccagttacctgtgccctctcattatctggaattgaatactcctctccacaggcctgggagctccttggggacaagagtattcatctcggagtccttagtgccctgagcagagtaaagaagctcaggtgtgctggattttgccaatactttgtacactgtaggagaaagatgttactatggtatccatccagagacaggacagtcaacaattaagaacctggcttgacacggcttctgggactagcagagctgaggtttgaccttcaaggatcaggctcatctgctcttccacttacatgccattgtcaatgaacattttatctctgaatttcagtaggtaggtagccaaagcctgcaactctcccggcagctccccttcccgacacctgccacccaccgctccttcaggagttcagagaagcctggcgtctttgacttttgcttctcacttctcttctcctcccttcctctatcatgtcctcttgctgtcctctaaacaacagcttccttcaggggtccctgacggcattggggcctcagagttcacataacattcctcctactccacccctacacatcctggctgtcctagaactagctcattagaccagactggcctcagactcatagagatccatctgcctctgccccttgagtgcgggtcttaatggtgtgtgccaccaccaccttacatcttaaagatgaggaattgaatgggggacttcaggttcaaagggaatttgtttgatgcaagctccaaggagactaaagaatttggctaagtcacgtaacctctcggagtccaagctcattcataaaatgaagatgataaataataggaatgtgacagtgagataacttagaatcctgtccaatgctcagtcactgctcagtgattatcaataatcaaaggtcacagttctcatccaagaagttacgcacagtgtgtctaattgtgccatataaaatgctctggatgttctgcaatcgtagttgaaaggaagtgatcccgtctggctccttctttgctttcagaatgaagtacaaatgtccgggatctgtggatctgtgtgtctggggttgtgtgaccctgtacaggaaagaatgaagtctctaacaaattagaaacagtaggatcgtcctccaaaagagtattgattgaggatgtttatacagcctttacacactgcatgacctaagaccttaccataatcagatcttttgagaatcctttagtgcaagacgatgattagatgggcatgtaaatcacagggagttaaaagcaagtattaaaagtagagaaaaggtaaaaggtctatgcaaatcagacacagcaacagctttcttaaaatcctcattgccttctccaggcagcagaagaccgcccccactatccagagccccgcctctcgggcctagtgacgcaagctaggctccgcccctctccggcgcagggcctgggcgatctgggtcacgtgagcctgagtgcggaagtgaggctgcggtacgcgtccatgattggtagtggcgaaggttctgggggcggggccagacgccggaggtgccgggggaggaggctgccgtgggggccggcttggagtgggattcgacccgcggcgctgaccgactgctggaccgacggccgacgggcacccgggtctgcgcgcactgctgctccgggtcgccccggccgaggcgctggccacggtagacctcagggagggctcgggctgccgggccgggcgccatgtccatggaggaccccttctttgtagtgaaggggtgagtgtgggccgaggactcccgcctcagagagaggggagggaaatcgaggcagggcgacacagcctctgtgctcggacaccgcgcgtcgtttggggccgggcccctggggtcccactatcggcccgcaccgccacttcctcggggtcgcgcgccgcaggtggggagcgacgcgccggagccggccgacagcatctgggcaggaaaagggaaatggccctcttggagtgggcgtgcgcgggggcgagctccattgtggagtcgtggagctagctcgggacggccaccccgcggcttgcccggtagtgtccagcgggtgcgggagccggtgcgggaggacgcgcgctttcccgggggaggaaaagtcctccaggccgggtgctgatgttggaaggaaaacaatatgcaatcagccaaaccaaactttccgagggtttcttgtgagccaccggggttttcccaccgtgtcgaaggaaatgagtgtttctattgaactccttggtttcatcctgggtgtttgacaggtttccctcacttcacgttctgcctttttagaagcctactgccctcgttttgcgacagaactgtcctgactccatctttgtttatctgttgggagatgaaaacatcaattgcactttgttgtatcaactttgtagccattacacaaaagcaagaaagcgcaattatgatgtcgcaacttatttctaataatgtgtcagttttatgctttgaatgtcagagaaatgtcaaaaatctgagaactgcgaagttaagacagagtaagttctactgactgcaaagtgttctttgcttttaactagttgctacttgcatcttacttgtatagtggtaaaagctgaccagttgtgtgggtgtttgtttttgtatttaagagtcctgggaaacttaaaatgagatactttactatccttggtgtgtacagtcaatgcacaatcaaatatattatgactgcttttttttttttttttggctttttgagacagagtttctctgtgtaactcccttgaactcactgagatctgcctgcctctgcttcctgagtgctgggattaaaggccagcttggctaagattgtctctacgtttccttaaaagggtttttcttttgccttgctttaatttagtcggggaataggaaggtatatatttaacagtaaaatctgcctacctggaaattgtgttctatattatggaattgattaagattttagttggttttgcttttaaatttagagttagagttgtatacttttcccttgaatggaagggttttcttgggtttttgtcttattttgtggagtggtaagtgaatgttgtggcatacatgtggaaatcagaggacaacttgcaggaacttctcctctttcactgcgtgggtctcagggatctaactcaagtctcaggcttggccgcaggcacctttgtctgctgagccatctcaccagccccagaactgaagtttttgacattcaggttgcaaaggttatctctggcagtgagtagatagcagaggtaaccagcggatttctctgttcgcctttgagggaaacatggaaagttctttattgctcagccatattggtatttacccctgcaagcctactagcacttactttacttgctgactaggtattactactctattaggacactgtcctcggtcacttgttgcagtagaaaagacaagccagccacatcagtgtctcaagatgtgtgatagcatatccatgaacatcattttattaacaggattgagggccactgagatatcttggtagataagggctcatgcagccaagcctgatgacctgaatttgatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttttttttttttggtttgtttttgtttttcgaaacagggtttctctgtgtagccctggctgtcctggaactcactctgtagaccaggctgtcctcgaactcagaaatccgcctgcctctgcctcctgagtgctgggattaaaggtgtgcaccaccactgcccggctcttctgtcttttgatgtgtttgcttaaaactactcagtggaagcgggaaggtggtgacacaggtctttaatcccatcactccagaggcagaggtaggcagatctcttgaatttgaagccagcctggtctacaaaatgctccaggacagccagaactacatggagaaactgtctcaaaacaaacaaactaaccaaacatgcaaaaaccaaaaccaaaaaaccaaacaaacaaaaaactgaaccaaccaaccaatttctgttgagcagaaatataaagcaaattccactttcttctctttttgttcttacttttttgtttttttggtggccaagtctcttgtattccaatccagccttgatcttctgagcgtgcctctgccctttgattgctagaattatgagcatgcatcattttacattttctactacttacattaaaaaagaagtaaaaataatttaacatctgttagtagatttgaaaatattattactgctgtgggttttgctgtttgtctgttttgtttttgagctagggtcttgttgtgtagaacttgctggcttggtatatgcagtgtagtgcagggtagccttaaacttggtattcattcctcagcctcctgagtgttgacattataggcatgcacttggcttcaacatgcaattaaacattatttgtataaagttttcaaaatttgttattttaaacttctatctcatttcaatttggatgttaaaactttgaatatattgtcctatatttagaattcattaaacttacaatccaaaagatatattcagaatctggggtgatagggtacatttgtaataccagcacctgggagtcagcggcagaatgaacagatgttcagaagctagctagcctcataatgaatttgaggttagcctgagctacttgagatcctacctcaaacaagaggaagaggaagaggaggaggaggaggaagaggaggaggaggaaggagaagaagaagaagaagaagaagaagaagaagaagaagaagaaataataagaaattcacatgccctaagaagaagaagaagaagaagaagaagaagaagaagaagaagaagaagaagaagaagaagaagaaataataagaaattcacatgccctaagaagaagaagaagaaataataagaaattcacatgccctaagaagaagaagaagaagaagaagaagaagaagaagaagaagaagaagaagaaataataagaaatttacatgccctaagaagaagaagaagaagaagaagaagaagaagaagaagaagaagaagaaataataagaaattcacatgccagaagaagaagacgaagaagaagaagaagaaaaagaagaagaagaagaaaataagaaattcacatgccctacttgcttcaaacatgaataccacttttttggcaaacaaattgcatattagtttttaaattaattaaatactagttactcagtgacaatgctttcaaagttcttagttgtacctgaatagttacatgtgaatttaatattgacagcacagtatggcccttcaaggtctaaacaggtgtagcctacttagtgtcagttaatggctacctgctgcagaatcaaaatgcaaaaccaaaacactccttgatgatgttactgtcaacctgaattcagctgaatttagaaaaaaatctgtttttaattaccaacagttttatacatttttgaccctaactcactgtcataatattcgttacttctacattactatgaccaaattactagagagaataagagaggaaagactgatttctgccatagggtttcagaagggttcaatccatgcttgggcagaacatggtgtcagtgggagagtgtggaagaggggaggtgttcattcatggcaagcaatagcagagagagtgagacaggaagggccagggacaggatacccccagggacagacagatgggcagacagacagacagacacacagtgacttacttcttccagcttttgagagctcccaaacagcaccagcagctgcccccttcaaaccgaaggcacagcacgctgctcccacaatgccccgtgctagtcctcacagcactgactctgcaggccaggtcagctcaggagtgagtctgacttgacctgactgtcactacacctgattcgagacacttgttttcttgacatggctcttgttcctgtgacctgtgctttctagtgtacactgactttctttcccacttgatcccatattcactcctcagagtcctcttacaacttttgggtactcaccagcattcaggggttcagagcacctctttaaagctgctcagtctctaactgtctttccaaccccagccccttatccagggctacccccttatccagggttacccccttatccagggttaccccctgcctcgttagccatctccagaacaccacttggtggagcacacactccctgggctcccttttggttcagtgctccagcattcagtccagtctgtgcctgctacactaggctcttacttctgcctgttcacacgttgagcttccatgagtcactgtgagcactccactgcctcaggaagggcttcactggtgcctctcattctatattgtgctgcttccttgccccatcttattaactgtgaccttttatctgcatttccggtctagtatcttaaatgcacagcataaattctagcacacagtctttactggtggtggtggtagagtaggtaggctgcttcatagaaggcgacaccatcagcacaggcccctggcagggggcactgtgtgtttaaaaattatggatgtatgcagacaaatggagtagaaagtttgttgagacagaacagctagtatttaaaggctacatctcttgagccaggaacactttatatgaattgtcaccttgaaaagacagaccagataatgggaaattttgtttcatgtcaaagagaaggagctgaggggttgcacagccaacagctgcaggctccacatttaaacaacctaatttcactgagtccaggtagaacatagtcaactcatgttaacccaaggaataccccatcttgatgactttagagactttggaaactgggaaggaagggaaattagggatttaggaatattggtttggctacggtgcaggctgtgtctgtgtgaaggaaattaaaaagaaggcctttgtgaaatactgttttaagtgtgcaaagatcagcagatggtcctgcaaaggtggtggtctgctctgcctcccatctggtaatgactgtctttgacattgcaggagaggactaatctagttcctactagctgatctgctctagggtgcagatgactgttttcagccttgggtagtctgtcctgtacaggaggcctgttgtcccttgcagacccagaagaaccgtcagtggttttggttttgtcttcagcaaaagcagtttctaagtaacttacatctgtagtttttcactctgaaacctacttaccccaggcctgttgctgatttaggttgttttcacggacggtgttcctgtagcataatagctgattcggcgcacatgcacaacagagcttttcatgagtattgccagactgtccctaggatgtgcctgggtactttaagaagcctgttctattaatcctttgctggtgcatagattcaatactaatttttggatgtgaaaatgcagggtaggagctcactcaggatttgatgagttaattcagtcagtttttggttctttagccctccttcccccgtgttacacaagctttcagaattagcttttttgaatttgcagtctctactgaaacaagacatcaagaaaaccataaaatttagcatattgggatgtgtcagtacagttacgtgttgcttggtgtttgggctataatctgagaggtgccttcttagaacattgttgtcaactgtcagatgtcacacgtgtacttaggtcaactaagaagactataccactaaggccataatcctatgggttttttgtacttaattttctaaattaaatctgtatttactttgtacacatggtggggcacagcacactgaatgtttggaagtcagattgtgggagttctcctcttccaccatattcacaggaaggcagagtcatcactgactgagccatccatctttcggacctttgcttggttgtttgtgtggttgcttttgagacagagtttcaccatattgctcaagatggcctggaatccaatatgcagcccaggctgacctcagaaacatggcagtcctctgacctctgcctcccaagggctgggatcacatgcacacatgaaccgtatcttgcttaggaggtggttttttgtttttttgtttttttttgctattgttttgtttttgctattctccctcattgagtcaaggaaacttggggggtgaggctaagactaacttattttattttatgtatataagtgttgtgctcccatgaatgtttggttcccatggaagtcagaagagaacatcgtatcctttagaactagactaatgtacagttgtgagtcaccatgtagatactggggattgaacccagtttctctgcaagaacaagtgctcttaacttctgagccctctctccagccaccagtaggtggttttgtggtttttgtttgttgttttttaagagaagttacagttcactaatttaaaatcactttttaaaaatttacttatttgtttagtgttccatctgcacatatgactacacaccagaagagggcaccaggtctcattatagatggtttcataaccatcatgtggttgctgggaattgaactcgggacctttcgaagaacagccagtgccctaacctctgagccatctttccatccccaaaaatcacgttttcaaggccttaaacacagacattatagatctataaggaaagcagaagctttctggaagctttcagaactgagattaaataggtcttggtggtagaatacttttcatcttcaaggtcaaataaacttgaggcaagcagccaaaatgtctgagctctggatctctttagctgttgggtggtttaaggctgggttatcctggaacttccttgagatctaaaatctcagtggttgacttagtggaggctgtgcaggttaagaagtaaaggaggaggcagtgactcacacttaggttaagtcttcaagcttgggaagtggtggcactgttggcttcggtaggagttagagagaggaggaggcaggctttctttttagtctgcctttgcttgcttgtttgaatgcctgcttttcttgtaggagatgctacaatctttggttttagcaatagtaatgccctggaggtggtcaatgaggaaggggtaaccctggataaggggctggagttggaaagacagttggagactgagcagctttaaagaggtgctctgaacccctgaatgctggtgagtacccaaaagttgtaagaggactctgaggaatgaatacgggatcaagtgggaaagaaagtcagtgtacactagaaagcacaggtcacaggaacaagaaccatgtcaagaaaacaagtgtctcgagtcaggtgtagtgacagtcaggtcaagtcagactcactcctgagctgacctggcctgcagggttagtgctgtgaggactagcacagggcattgtgggagcagcgtgctgtgccttgggtttgaagggggcagctgctggtgctgtttgggagctctcaaaagctggaagaagtaagtcgctctgtgtgtgtgtgtgtgtgtatgtgtgtgtgtgtgtgtgtgcatgcgcgcatgcctgcctgcctgtctgtgtgtgtgtctgtgtttctgtctgcccatctttttgtccctgggggtatcctgtccctggcccttcctgtctcactttctctgctattgcctgccatgaatgaacacctctcctcttccacattctcccactgacaccatgttctgcccaagcatggattgaacccttctgaaaccctatggcagaaatcagtctttcctttcttttcttttttttgggggtggtggtttgagacagggtttctctgtgtagccctggctgtcctggaactcacttggtagaccaggctggcctcaaactcagaaatccgcctacctctgcctcctgagtgctgggattaaaagcgtgcgccaccatgcccagccgagtctttccttgcttgttctctctaatttggtcatagtaatgcacaagtaacgaatgtatgacagtgaattagggagatagatagatacacacacacacaaacacacacacacacacacacacacacacacacacacacacacacacacacacacacatataaaactgttggtagttaagaagagcccttttctcccctgaatttggttggtagtagagctaagtgaagagtgttttgattttcccttaaatgcaaaaagtgtgtgtggcaagagcttttctcccccgaggttggcagtggagtggagtgtagggtgcagggcaggagctagcttgaggagcgtgggaggtggctgaggaaagtggttgctgaggcttgtatagcttgcagcctgggtttttgaggttgcagctctgattcagaaactatctgactttatgtatgttatgtatgttgtatgttttcaaaccagaagcttctccataaggagacttacaggatggttgctgccccagacacaggccgccccagtgtaggcactgtttcatttgcttcttatgttgggaagtaggtgctcatttctgtcagtcagaagtctgtgttcctttgtgtcacacctgtgtagacttgtgtcactgtcttgatgaacagaatgaagtggtgacctttgacccctaaggtccctcaactatcacagctctctcctacgtcatcttctcttaggacactcacttaggatgcatcatctgactgggtaggaagtcagccacacttaagtcactcccccagagggatgggggtatacctccagagagccctggagaagtgactggagaacccctgttcttaacgttcttcagctcagacctggaacagtgtggacctggggcaggtcatccctgttgtgtctgatcactcatccacagagtctgtgagcactgcaaacactgtgttacaacaagccggggagtagttgttgcacagcacaggaacagatgccaactcagtttgtctgcattgtcagagaagaaaggcagaacccaaagggaagctggaactgcagtcccacagcttgttaacacaggcacatagcagctactaagaaaccaagtcttctctgttgatccaacgcagtaacaaggctgggtacttataaagagaagagatttactcagctcttggagagttcaaggctgggtcctatagagaaaggccctgagctgtatcacaccttgatgcagtcacttatgggagggacatatgccatggaggcaaggaagaggggtcaagctctgtcttttgtagtagcttctcttttcaggaactacctggggtcccacaaggactgccaaagatctactcaccttctgctgggacctgcctcttaaagctttcaatactgctatgctgaggccaaaccaccggcatgcatgaacccttaagacacacttaaaccctatccaaagtttacacttgctgttagctgagatagtcctcatttacttctgtatttggcaaactctttttttttttttcttttgaggcaggatctcaatagatcaggctggcctcagacgcacacatctactagcctctgtcttctatgggctgggattaaaagcatgtaccactattgcaggcatatatttagcaaagttaattaaatataagtaaaaaaaacaaaaaacaaaaacctttgtgatgttttatggaggggtaacatttggaaatgtagccctcccaacctagattgtttgggatggtgagccttttactacgccatgacaaattggaaactcgcatggaggaggctttacagtcaataccaatggatcgttgttgagccagcttccaaagcttagtcttgttgctatcaactgttgtctgaagacagtaaaagtcttgtttggaaagtttagctggcttttcctgttttctgagaaggtacattcatttcttaatcaggaaagaagagctgtgttacagtggtcctgtggtcttatcgtgggttgatgttagttagggtccttcattttgtggttatgagaacttcacagatacggtgatttttgacaggctgttagacagcaagggggtaaagtttctgttttcagagttttactaatgcagtgcctttgttgcctatgacatggtgcatcaaactgactttcgaaacatgattagaagtaaacttgcctgactcacatggagatagccacttctcttcatccgtgcttgatcaaggtgtctctgcagaggggctagagccttagttcttgggaagatagctagcgagctttaattgaaatgatgggcatgactccaaagctgttggtgagccaactgctagtaaccaagaagcttgcttagccaaaccctaagagtcaaagtgtatcgtgcttgtgtgtattctttaccattcgcatcgcataactgagagaaaggtctggaatagctaagccgggctgtccaaataaaggagcagcttgaccacagcaatcactcgttcaataaagtgcttaccaggctgccgtgtggggggtggctttcgtgtggcccttcctcggctgggttgactgagaccccctcccttcctttcctcttccaggaagtcagagaaggaaagaagggcctctccttctgcctcacagatggcaggtggatggatggatggatggatggcaggattatgctgctgagttttagggactgatttgttgaaatgctaagtggtcctcagtgcatactgctaggtgcttatgtgcagttctaagtggtcctcagtgcatactgctaggtgcttatgtgcagttctaagtggtcctcagtgcatactgctaggtacctaggttttgagtggaagagggtgtcctggttggtcttgtgcattctgagaagtggccagtggctcttggcactttgtgaaaatctcaagttctttgggaaattctgactagtgttttcaaagttttctgcaaggcatagttgcctgtgcctacaataatgtcagccttctgaaagctgaagcaacattaacccatttcaaggttaacctaggctacaaagtgagatcaaaacctaccacttgctggtcatggtgatagagccctttacccagcactttgaggcagagacagacaaatctctgagtttaaggccagcctggcctacagagaagattctgggacagccagggctacatagaaagaccctgtctttaaaacagacaaacaaacaaacaaacatgcttccccctaaaaagagaaaagaaccaccaccctcaaaacacttggttgtgacccacataattccctagtgcctattcatgcctgggaaactgttcctagcagcttgggcggtttggttctctggaagacctcttcagaactcttcagttggggttctggacacactatgagctctggcttttcttccaaagtctgagccattgctgacagtacctaactttggggtctcttaaaaaaacaaacaagacaaaacaaaacaaacaaacaaacaaacaaacaaaaaaccctgccttggaaacgtgaagtaatggttgtttacctttcttctgtttgtcctctacaatgaaaactaaaaatgagtcctgatttaaaaccaaggtctttagagtagagcaaaccaagacctggttaggtctgtggggtgttgggcgttactctgagattgccctatcacatttttcagattcctgcttctttgggacatgctttagttgtggtttacttagggacttagtgccaccagagtccactccatattcgatcacccggagagctttttaaaaactatccaatcagccccacccccagccccactctctcactcttactttgattcatgtgtatgtgtgtcagctgtacgcaagccccatgtattcaggagcctgaggaggtcagaagagagtgctgatctctggaacccagtgtgggtgttaggaaccaaactcagagcctctggaagcgcagcaagctccctcagccatagagccatctttccagccccgagaccatacaggcctgaaaatcaggtctgggaccacaggggctctcaagatgagccacaggaggatccgtttgtttctcaaactcttttcataacaatattatgtttttgcctctcactgtgttgctgtttgcactgatgaatagtggtatactgggtggttctgtaaacccttgcaccttactgtatcccagtgatttaccacctggaactcaggaaaaagctagtcatatgcttttacacagagtctttgcgaatcagtaagagttactaattttataaaatcttgccctttctagacatttcttcatttatttttgttgttgtttgtttgttgttgagtcagggtttcttcatgtagcccttgctgtcctgaaactcaccttatagactaggctgaccttgaactcacaaagttctacctgcctctgcctccccaagtgttgagatcaaaggcctgtaccaccacgcctggattttcttttacttttttaaggttatactttagttataatgaaatccactcctttaccatctgcttctgcataatgacatgaattctcaggtatgcaattactgtagttaggatactggacaggctatggagacagttcatttggtaaaggcgtgctgtgctgtgctgtgctgtgctgtgctgtgctgtgctgtgctgtgctgtgctgtgctgtgctgtgctgtgcttgcaagcatgagaacctcagttagctctccagcagccactgtgtttgtagcttgtttttccagattggttaggtagaggcagggaaagccgtgctcatcactccttagccagcccagtgctgttaaggagttctaggccagtgagacagacagcttcaaaaaccaaggcgggtaggtgctaaggaacagcacccgaggatgttgtttggccttggcatgtatgtacatacatgtgcatacatgtgcacacatgcatacctgcgtactgatcttttgatacagtcgtttcaatgggatttaagcctcgtgatagtgaagaagatttgtagaccctttcactccacctgctgggagagcatgctgtatggtggtgtttctgagcctcatcccatgctgtaaacaagaaccacatcagtgctgcttactctaggaagcagacacttagcaaagatgaaatgtttaaaatattccagagagatcctgggggttaaaatgtctcagattaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggtgctgtgagggtggcatgtggtgatgctgtgaggatagtgagtggtgatgctctgaggatagtgtgtggtgatactgtgagaatagtatgtggtgattctgtaaggatccatgtgaaggtgctgtgaggatggtgtgtgatgatgctgtgaggatgtgtgtggtgatgttgcctcgagtcctacttttattcatcaatgagtcatgtgtgacatctcctttccctttaccttgactacagagaggtacagaaagcagtcaacactgcccaaggattgtttcagagatggacagagctccttcagggcccctctgcagcaacaagggaagaaatcgactggaccaccaacgagctgaggaacaatctccgcagcatagagtgggatctggaggacctcgatgaaaccatcaatatccttctctgtcgtctgggggtctagggacttgggagcatgggcaagagacagacaaggttttatctagatgtcttgagccatagatgagagagaggctggtttttatagtgattgagctggcttttgttggtcactgccgggtgatctcagggaggctagccctattcttccgtctatagcaaaccctccagatctagactgtatagggcagtgatcatcactttggaccctggagtcagtctgctggtgtcccgtttctcattccaccattgtagaagtgaaagtaaacttttcctctcaaatagtaaaatagtaatacttctgatatctgtgggggatttttcttcacataccaaacggttctccagcagacaccaactgagtgtcctatggttttgagactatgtacctggagatagcatgggatcctgtagtgctcatagcccccccatatcagatgccaggtgcaaaccccagattctaacttgttagtcaaactcacttcctgtttgtttaatttttttcaagagcagcttgtagagttcagggaaatgaattgcttaattggctgtgtattataaagtctgtattatgtgtttataaaaagataaagagagggggatatgtcctgtggaggtatagtcaggtatggggctagggggtaccttgacgggcccatgctgagggatcccttccctctgagggaccagccacatgatggtatagtacagagtagagtttattcagggcatggggagaggaattaagaggnnnnnnnnnnnnnnnnnnnnggggagggagggagggagggaagaagagagagagagagagagagagagagagagagagagagaggagtagaggccagccgtgagcatgtggagagagtggggaagagaaagcaagagaataagagagaaacaagagagcaaggagggggcaaacagccccttttaaagtgagtcaagaatacctggctattgccaggtaactgtgggacggagcttagacagaatgctaacactgtgtgtggaagagatgcccaggggaaggtaggcagaagagcattgtgtggcttccaggaatgccactttcatgtggtgttccacaggaaccctgtccacctcaggattatgaaagtttcatcacagaaacattattgattaggtcattacttattggtgattagctcaacctttagtccccttctcaatacaggggtattggtggctggaagttcctatcaccagtcatagagttggtttgtttggtgatcagaggaattgtgtaggactcactagttatctagtagcatatagaatctggagactccaagggccttaagagctctctgtgccagagatggaattgaaatatatatttgatacagtgtcacagcagtgactctggctttggccacaccagtaagcttctctgtgctttagtttcctcttcaaaagaactctaggataaagagtgcccaacttaggaatgccaggagagttacatgtatcgagagcttaaaaggggcctgtccagagtatttgactataaaggcttagcagttaggctgggatgctctttggtaatatagcccttgatcctagcatgcgaggaccaggttttgggccctgtagaaacacaggcatgagtgcatgcaccatactcgcagtcattgccgtgtagtatatatagtatatatatatagtgtatataggccagtggtacagcctttagttagagctcaaaagaaaatctcttcaaagagttctccacttaagaagtgattttaaaataccactgtcaattgaaaagctgcctgtaccgtgaagccatgtttggtgaaaacacatccattatgctaacttatgcagttgatactgggggaaagcccacagctctgatgatggactggacatctgttgatgttgacttgtgaagctttctgttctcagtcggaaagtctctgtaaccaaaactttagttagatgataatgctggttcagtgtctgaattctggtttgtgtttttctatgaaataatttatcaaggaaaccaacctctacaaggttcacttactgggcagcatgggcctataggcagtgttgacatgtagtgttaacttctgagctagagaccacggtactttttcctcatcattatgatacttctactgttatagatggtgccttttaagttacataaaatctgaggggagaggcaatttcaagaggatcttgtttcctctgagacagatcagggcatgtcagttgtgaggcaagagaacaggagagggcagtggggacaaacaagagcgaagtataatggcacatttgtatggagagtcacagagaagcgttgctttatatgctaaccaaactttgaaaagactatacaaataaaattgaaaaaccacaagaaagaaaggaagaaagaaagaaagaaagaaagaaagaaagaaagaaagaaagaaaggaaggaagggattggggggggagggaggaaggaagaaaagaaagaaaaggcaagggaaggaagaacagaagaaaagaaaattgttaggcccaggcatggtggtgtccacctagtactcggatggatgcgacaggagagtcaagggttaagccagcctgggctttagggctatacagtgaggcctaggcaagccctgattgcatagtgtgtccttgtctcaaagaagacatgagataaagaacaaaagctttggtcttcatcattcatttcgcaattgtttcttgagtgttctgtctactggacattttcttggtttttaagattaggtcaaaagaaactgtagctacccctcatggaattagggttgagaacagacaataataataataataataataataataataataataataataatgaagataatttacagtttatgtaccttctctgaaggcttgatctctttaggttgaggaagagggttaccacattggcataaggaagagttttgatgacaaattaaaaagtttgcaaaagctgtttgaggtgactatgattctagcacttgggaggctgaggcaggttatactacaagttgaaagccatgctacgtagtgagttccaggacactataggttccctgcatcaggagttcccaaaggatagacacacatgctggcaaacaccaggaagatcttagctgacctgtggtcagttagctatgaatttatggagagccccatatgtcttttctacccctcccaccctctcccatgctttcagcccagctacattcccagcctgagacacaggttaatctggaactcaagaccctccctcctctcatgcgctgggattacaggtgctctattacgccagccaggtcatctctgtcttggggcaaagggatcctctcgtagctgtggttggagaggaagtttagggatgttctgtgaagttgagtgtcttcagggggtttgggttatctcattccttgtgtttcagtgccctatggcttatcaggcactgctgttttgccttaatttgttggctacgcatagttgaagcaaatcctagaaaattcaacttggatgcaactgaattgagcataagaaaagccttcatcacaagtactcggcaaattgtcagggtaaggagcacgccttgctgtgttgtcagtgcaagagacagacacactggtcagaaacctccctcagccacagcccagcaggctgactctcaaacaacatgaactcggcatgaactcaatgccaatgtgtcctagtctgtaattggggggaatctactttgaatttttgggttgttagaatgagaacgagataataaacagctggctggaagattactctaacagcctgatctacttgcctatgtgtctaacttccttaaaatagagattaaaaaacaacaacaacaacaaaactcttaatgtgcactctttctggacaaaagcaaagcctcttgtaggagccatttggtttcctgattgactggtaatcatgtgcattgttagagtgctcttcctgggtttggctggtggccgtccctaccatctgagttgcttctggaactcccactgcactattacaactgccatacaagggcttgacagcctcccaggagttacccagagcaggcaggccaagggtggcatgtaagaacaagccagtgaggggacacattgttagtacaaaattattaagaatactacccactagtaaaggataaaagagaaaatatagtttaggtaaaaatcttgtgtcattcagatctattttacactttgaaagtatatggctaagccatttgattagcataactagatgtaagagaagcagctgccattaacatatgtacttgaaagtagcttccttgaagaaaaagacttgggatcagaccagtgctgacatatggcaggaaccttgcttagtgtttgccaaagactttcaccatgtgatttcctctcgaaatgatctcaaatggtagattatcattgaactttattcttgtcttttgtttcactcagtagttggcctctctctgtacttataactaaattgtttatatataagctcacatgtaatagagcagaaacctttttgacttcaggtgccccctggagacaatgagtacttgaattcaacattctgactttctgttgtaaaatggctaggtgacatcttttgtgtgtccgccctcacgctatagcccacactggcctcagactcatggggatccacttctctcagcctcccaagctctagctctgcaggtgtgaaccaccacatctggctggctgagccatgtgtgctgcatgtgtatagtctttaatcaatgcatttattctttcagtaaggtggtccttgtgagttttgagaatcagaattcaaagatctctatatgttgaaagttaaattatgactggaagtagatcctgaagtttcttttttctttctcctttgtttttttatagacagggtccttctgtgtgtctctgactatcctagaactctcttgaccaagctggcctcaaaatcacagagatccacctgcctctgccttctggctgctgggattaaagttgtgagccaccactgcccggctgaagttcatttattaatatttgaaaatctctttaaagtacattttaggattattttaaatcctaacaggacaccagaagcttactatccgtacagagcaggagacctaaaccccactcagctgtgctcacaactgacttcttggtggacttactggctttgttgttttactttattccctgcccccacctttgggaaactgttagtatttgccacagatgccacagatggagtaattgaacccggacttttgctgacttggttttaataacttgaattgaaagtcttacagagaggcagctctcgtggaggcagctagcttgaggctggggagcactgagccctgtgctgcccagactagcgaacaatacagtcaggatggctaaaggtgaccccatgaaaccaaagggcaagatgtctgcttatgccttctttgtgcagacatgcagggaagaatataagaagaaaaacccagagggtcccatcaattttgcagagttttccaagaagtgctctgagaggtgaaagaccatgtctagcaaagagaaatcaaagtttgatgaaatggcaaaggcagataaagtatgctatgattgggagatgaaagattatagaccagctaaaggaggcaagaagaaggacccaaatgcccccaaaagacccccgtctggatttttcttattctgctctgaattccatcccaagatcaaattcacaaaccctggcatctccattggagatgtggcaaaaaagctgggtgagatgtggaagaacttgagtgacagtgaagcagcctacgtcaccaaggcagcaaagctgaaggagaaggatgagaagggtgtctctgactggcagtctaaagggaagtttgagggggccaaggggtctgctaaagttgcccggaaaaaggtggaggaggcggaggaggaagaggaagaagaggaggagggagaagaggaagatgaataaaaactctgtctccttgtgaataccttagagtaggagagcgctgtgattgacacatctcttatttgagttgtgtctattgcccttgttaggtttaattacaaaattgatcacgatcatgttgtagtttctcaaagtgtcagtggtttacatgaagtggtcatgggtttccggagtgccctgaaactgtatcaaagttgtacattgctccaaacatttttaaaaccaaaaggcgctctcacgtactcctcactcagtgcactttgctgttggtgtgacaaggcatttgaagatgtttctggcattttgttctcaactcgtaaggtagtgttaactatatggttattggctagaaatcctgagttgtcaactgtacatatctatagtttgtaaagagaacaaaacaacccagacagattcttgatgctccttgcttggcgtggaggctgtgaggggaagatgccttttggagggggccgtagctcagggcgtgcactgtgaggctggacctgttaatactgcagtgagcatcctttagctccaggttgtcttgtttttgtatatagtggcatagcattctgctgacattcttagttgtggaaagggggaggggtcagctggcatgagaagtgcttggagttttttctttagttaagtgcagtaggtctaaaactttttaaagaaactgtggaactcatcattgtcagcaaaacaaagaactgcatcaatggaagttcaaaaaccctctggacctaaacacaatttgcaacattctgttgttttttatatgtttagaatgctgaaatgtttttgaagttaaataaacagtattacattttaagaaaaagaaaagaaaaaagaaagtcttacagagaagaaggaaagagcggcagtcaccttgatgaaaaacaaaagagttgcatgaattggccttggtgtgttcagctgaagagatcacaggctcttggtaggaactgtggagaaggggcaggggatggcagatttgggaaatgggacaaggcagattttatagaaggatgttgagatcacaggcgtagccagcattgggcctacagacttttcgttttgtagtggcctacttttttcccttcagaatgtcacatattagtgctctattttcatcatttccacccttctttcttcccagttcaacccctgtgctccttggacatactgtatatatccaatcctcctgggattggatagcccatcacagggcttgtgcctagagaaaactagatctcctcctcagcagccagtcataacctgtagatcttcacccaggagtggagcctttgacaagtccccacctgcactaccatgtcagctggtgttgtcattgtgcaggtcttgattaggtaccttattgttaaaatttcatgggttcatttccctgtcatttaccaaagacagcatctcatagcaacatcctggtcctctggctcttacttacagtctttccacccttccttccatgatgttccctgaccctttggtgtagggtttgtgttgcagatgtattgactgggcctgggcaccccacggtcagtttctctctgtatgttgaccagttgtggcttccctccatctgccctccatctgctgcaaaagactcttctttggtgagagtgagagttacactaatcagtgagagtaagggtgagcgttgagaaagcttagaaggtgtactgacttaggaaagttattctatattttgtttgtgtttttgtttgtttttgttttgttttgaggcagggtctctttacatagccctgcctgtcctgaaactcactatatagaccaggctggcctccaactcagatccacctgcttctgcctcccaagtgttgggattaaaggcgtgtgccaccacaggtggccttctactttattcttaaatgaggatattctaatttgattgagtcagtttgtcaggcagagcagtcagtgataaacaaaaccttttgtcttttctgtgaagaagaaaaattcttctgtgtgatttgtatgtgaggtacttgtgcatgctagacatacactctgagctacagcaaagcccttctcccaagtgactgcctgattaggattcattggccatgaatttctactcttcccttgtttaaagagttgctaagcatcttccatggttgtccaatttttattaagtttcctggtaatttttatctgaaaaaacacattttagttactatataaaatagtctctccccccatccttttcctttggcatcctgctgcagataaacccaggtcctcatgcatgcagggtaagcactttagcactgagcgatatcctggctcatctgtatccagctaagtccttttacattgtggagtcatctgttcaacagagtcgtcacaggggataggtttgttttggagatacccctcaagtgactttgggttactccagggactcagtacatttggttttgcagcatatgctggaaggtcagtgaataagacaccaagaaactgagatgtaggctaagctctgaccttgatagatatgtcacaagtcagtagtcttattgggcctcctttgtatcaataaaatatccttgttaacattttctggttttaactttggaaggaaaattggaactatactgtaccctgtaccctacggtccacagtgtttcaccccaagagcatttgccatcagttagagcagaaatgactttggttagtcgacgaggctaagataagcagaggtgtacagatgaccctaggatgaggggcccctgagtgggaagcgctggcatccacagtatctcgttcattcagttcagaaacagttgacatgaaagcagcataaatagccaggacatttgttgttcttttagcagatggatcgtattttattgggactaactgctgatcctaagcttcaagtgctaaaaagaggatgagtaattttgtttttggcatgatagactgttacaagatgtttaaaactgtttagtaacacagctaaaattccatatcccagtgtgaaggtgatctcctaggcggtgtctggtgactaactagcctacatagataaaatgtcatccacacttgaaagctgtgctccactgcaggagtgagcatgtgtactatgtacatgctgagagaatgtgtccatcacacacacacacacacacacaaacacagagagagagagagagatacatactctctccctcccttatcaaataaaaactttaataacctgagattaatgaaagcaccctgatatagctgtctcctgtgaggctacgctggggcctagcaaacacagaagtggatgctcacagtcagctattggatggatcacagggcccccaatggaggagctagagaaagtacccaaggagctaaaggggtctgcaaccctataggaggaacagcagtatgaactaaccagtacccccagagctcttgtctttagctgcaaatgtagcagaagatggcctagtcggccatcagtggaaagagaggcccattggtcgggcaaactttatatgtctcagtataggggaacgccagggccaagaagaagacttttgggatagcattggaaatgtaaatgaaataaatacctaattaaaaaaagaatctgagattaaaaaacatttcactcatctattgcatttttatttaaaaaaaagagtcgcttttttacaagagaagaaaaaacccctgtactcagaataatccctgattcagcactgtgttgtagtttcccctagatgatagccttgttagtcaagtgcatgtttacatgttaagaatgctcggtgcttgctgtttttgaaatgtgaacaattctatttgaaaggtgaaaatgcccctccagtctgaaatttgctctctagaaataataactttctggggctggagaaatggcttagtggtttagagcactggctgctcttccagaggataggagctcagctttctgctccctcatgatgactcacaactgcccggaactcctgtacgagggaatctaacaccttctggcttctacaggcatgaggcacacacagggtgcatagacatgcatgcagaaaaaacacccattacattaaatacataagtaaattcataaatagatagatttcttaaaaagaaataatcattttctgcctgttttctgggtattagaacacaaactcttattaagaaatgataggatatcctgtaaatttttcttgatgtttactgcagagtgtgcctggcatgcgcaatgtcttgggttaaatcctcagacccatcagggagagagaaggagagtaaagaaaaagggaggagagtgtattgtgacttggacctggtgccttagcacttgggaggtgaagcaggagaatcatgagttcaagaccaacctgggctacatagtgaaaactgtctccaaacaaacagcaacatacatgtgtgtaaatacaggtagatgtagttgactctgtccagttgaaatacagtatgaaccacttacgtctaatagccacattttttttgttgtttgttttgttttgtttttcgagacagggtttctctgtgtagccttggctgtcctggaactcactttgtagaccaggctggcctcaaattcagaaatccgcctgcctctgcctccccagtgctgggattaaaggcgtgcgccaccacacccggctagtagccacatttaaaaaagaaacaagtgagtttagtaaactttatttaacttaatatactcagaaattatcatttaaacatatggccagtataagaaatagtaaactttttaaacttgttatactaaaaactctaaattttcagttcaagtgtgaagtttttattgaaaataacttagccatcatttaaacttgcaattgaaaagtagatttagaaacccagttttttctaaagatatttaacagtaatagaatttatattttagttaattaagataattactgaccttgttcaaggtgatcaacaactacaactggtatggcaactttgttggacagaagcaaattttgataattttttcaatggctgtatatttatatatagtgtccatttcaatggtcactgttaatcaccacaatggtcccatgaagtactattgcaaatggatggaagaaatagaagttcagcaaactgtccaacttagccagttatctaagaagtattgctaagtctggagcaggtccaattgggaaaatgcctctagctgtgctttgattgctgtgggctataagcctttctgtgctatatcacttatgtctggtctgctttctgaaggaaatctcctgataagcaaggtgttttccatagtactgtaggtctgggtctactgtaaattctctccaccttatttggacacagtccttatttctacttttataaatgatactgtagaaatttttttacccatctgttttagttattttctttaaataaatggctattattcgggtcaaggcagtgaatattcttaaactgtttgatacaaaacaacaaaactcattttcaaagagtttgttctgttaccatccatgcattatgtggtagtttctaaaacactctattagcatacaacaatatagaaaaagtcactaatcctaagcattcaatttgatgagtttattaatgggatagtccatttgaacagcaccaagaagcatgagcctgtccaggtttacccagcacttcaggtgcctgttggaggtgtgttcaagccagtacctaccactactatccaacggtagacagtgaacagattacacacacacacacacacacacacacacacacacacacacacacacacacacacacacacacacacacacaccactgaaggctaaggtgccacttgtctgattccagtatggaagtataatgttcattgttcttttagaaagactgttataacattggcaaactagaaagttattgttctctcattagtaatgtgtattaaataaatgtagtttttggatggaataaatattaaagcacttcagttgatcagtagggaattcttcggtctaggacatgctatcttgttttgaggtttctagaatttgtatgtagcagaggttctcaagtttcagtgttaacattcttttcccagagagacttgttaaagtgtgccataaagagtgtctggtgtaggttaggatggggcctagagaagcacacttttagtaacctcttgggtatctgagtcaggtaagtcaccccgtgaactctaaaggagcagaggactaagccatgtcacctgctacatacgtattagacaccagttagtctttgatgaatgaatgacccagggctttgaaagttgaagccaggtggttattcacaattaagtacagtaagaaccataaagccatggcacccctgatccagcactcactcttcagggttcgtgatgcccggctgggtatgagggcatacacttcagtcccagtaccgggaagcagaggcaggcagatctgggatttcaagattagccaggtctacggagtgagttccatgccagtcagggctacagagagagaccttgctttaaaacaacaaaagttgaatacattatatttgcatctataaaaataagtctacttgccaacagaaaatttcaaagtatcttgacttttttcttctataaaaaaactgtattgtaattataacatactttagatctttctttagtgttttccatcatagttaagaattaactccattataataagaattttaatggctcatatttaatgaaattttgcttgaataaatatactatctgatataatatagccactgatttttttctatacattatttttgataatactttaaaaattcgctctgatgttagaaatagtctgtcctgtgaatgattgcgtcccagaagaactgaacaggcaagagtttaatggtaactgtactttaagaagaacaggttttacatgtgttttagaggatgctagtccttgagcacagtcctttggcttttaccctcccattgccgtttattggctatgtgactttgagaaggtatcagtcgttctggacctaggtcccctcagcctgagaacagatgatgtcagctcctgcggctcgggaagttaggaaaattagttagccctggttctgactgcctttctctttttggctaaatgtagcatcttcgttacctgtttttaagggaaaacctttcctatttcttttctgtttgaaactgaaaataaaagccaaagaatgctgtcgtttgcttaaagataggcaatcaatcgtgggttctgcctgtatgggaaatactgtccatgccttccttatgtcatatctcatttgttgtctgtctcatcaggacatgaaggatcagatgtcagcttcatctgtgcaggcactggctgaaaggaaaaacagacaggtaagaaaataccagacagagtataagtgtccattaaagaagcacctggctagatccttgaggttggaaattgctgaccgtccctggattacaggatggagaacaagacctgtacacactgatggggagggggctgatagggtaggtattgtggaagtcttttgtttgtttagtttctgttattacttgctactgtaacaaaattctgagctaatcagcttatagaggaaagaaaaggagtttattttggctcaggttggcaggtttcactccatgattggttagccccaaagctttcgggcatgtggcaaggcttcatgacagcaggacataaaacttacaaatgccacgttttttgttttttgttttttttaaattctttttatacaatatactttgttcattttgtttcccctccctaacttttctcaaattcccctctccttgcccaccccatttcatattctttctttttcattttttaccaagtatacatttaaaaaaaaaaaaaactttttattgctcctttgtgaatttcacatcttgcatcccagtcccacttatctcctatccctttgtattttccctctgcccttgcagcctcccctggaaagaaaattagaaacaaacaaacaaacaaacacaccccttacccaaacaaacatcccattgagaaagctgcaatgtgtcacagcgggccaccctcttgtccacacttctttacttgcaaatgttcactgcagtgactcattggtctggttccaggcctctggcttctgctacactattaatactggatcctcactgggactccttggatatcctgttgtcgccctatgtcgtggagaccctgcagctttggatatgcaggactggccccttgacaagctctagcagttcatagattggtagatgctggggtgggccaactccaagccccagatctgggcctgggtggtcgctgagctggttagtctaccaattctcctgtacccacacttccacaaagctgcaactggcaaggggcagggccagctctcccactctcagatttggccatctgtagcaggacaagatgtcaccatggcctccggtggcaggtggcagggcaagctacatgtcaggctgtttttctccaccctcagttccatttctgtttgtagtgctcaaagcattacacttctttttctctaatatctctcctccatatacttgtacatcatagtggctcctgctttgggcgggcctctgggtgtcttccctccttctctcttaaaaaaccaaaaccaaaaaagctgggctagagagatggctcaggtattaagagcactggctgctcttctaagggtcctgagttcaattcccagcaaccacatggtgactcacaaccatccataatgagatttggtgtcctcttctggcctgcaggcatacatgcaggtggaatggtatatgctttatatataataaataaatacatctttaacatacaaaaatccaaaccaaaaaagcaagcacaagcaagtgcacacaaaaccattttatgttggtgcactactcctgagcatgtggcctgccctggaatgtggctcataatgcctagtgtcactcttttaaattaattttcattgagccagcatcgttcagtagccattagctgtttgtttggggatggggctttgtgcccacttcttctttctccatgctgggattttgtgtggcttgaacctgtgcaagccttgtcggtgttgtcgtaggccctgtgagttggtatgagcatcacccctgttgtgtctagagagctcttcctttgcatcatcctccgtctctggctcttacagtgttcccacgttgttttgtgcacacatccctgtgccttgagtggaggggtgtgattcacacattccagttagaactaaatgctcaaagtctttggctttgcacattgtccagttgtgggtctctgtgttaattaccatctattgcaagaagatacttctccagtgagggttcatcaaatgtattgatttaggcatattagctacacttctaaaagattccattacctctcaggtgtgtcataggccaggatttaccacatggcctttggcagacatttagacaaaccttagcttctagccagcttttctcagcactgcaccaccctctgattcacctgctcctggccgctggaccccacagcacctcctcctcctcttcttctggcaccactgtgctgtcaggcgtctgctaaggagtcctaattgcttactgtctttttatgggactccaggctccttgaaaggggcttggttatgtttgaattttaatgtagccaggtggttgctcatacatctaaggccaatctgggtccacataatgtaaacttagctctggcctgggatgtatagtaaaactctatctcaaaattaaacacatgaatgaaattgatgcagacatttgaggaatctttaacatgtttcaaatttatttatttgtttgtgacagtctccctacacagccatggctgtcctggaattctctatgtagagatcaggctggccttgaactcagagatccacctgcctctgcgtccctagtgcaaggattaaaggcgtgtgccaccattcccgaaagcatggtttgggggaaggaattgtttttactttgagacaaggttttgctattcatgtagctatggctggcctatgtagcccaggttgtcctgaaactaaaaataaaaatcttcctgccctagctttctgggtgctgggattacagatatgaaccaccttgcctggttctttttatgaaagaaactcttccaagctggagatggctctgcagttacaagcacttgctgctcttccagaggatggagacccgaattcatctttcagcatccttatcaggcactcacagctgcctgtaaccctaactccaggggatccattgccttcattcacatgtacagacccacatacagacaccacacactaacacataattaaaacgaataaagtggaaactcctttctaattgttaaaatataatccttaaaagatgagcagctgtcatctggtcatctggaacttaaactttgaatttaagttctgatttgtgtgtttttcttgtttgcttgggtttgttttgttgttttcattgttcttacttatctcccccctctcattctttttttttttttttttttttgagctatagttgggaaaagctatcggccagcttatcccatctgccttgaacccttcaaagaagccagcaagtggctaaggtggcctttaccccaagggcctttggtacccacttaaacaaaccttagccagcccgccctaactctgctctccactgctccctctcatcttcccccagccattctccttaggagtagcatcgatctgtgagactcatcgggagatcttgaatataccttgctggtgttcctcaaaccatctaccaggcaccatcctgcatgcccatatcagagcctgatccaggttcgagggctgcttggcttggtcagtagtggctcctggtgttcctcctgattggttgtccctgctcacacaggcactcctaggagacagcagcagccagagctggaatgctggagtggcagatcgctatgggcgccttgaccgggagctgcagctagccaactcccacttcatcgaggagcagcaggcacagcagcaggtacctgagaacagctggtcaagcaaggaggtggcaggagggcgcctcccctgactctctgatagccacaagcttattacctaaagacaagcagcttagacccagctgccgtatgctgggttgtcaggtgtgtaatgattgtatacaccatttaaaatcttgaaagcatggtgtcccaaagaaccacttgatcagacttcaggaaaagcagagctgacatctaaaccaacaaggccaaggatttgtgcaggctttggttttgttgctgttgttctgagatgggttcttgagctgtgtagctgtggttggttggctgacctccaactcctggagattagcctgcttgtgccttctgcatgcagccgtgccccagctaaagccaaggatttttaaaaggaaaacattccttcttccccagtttcttatttgtacatttagccttttgtccattttaacaaagatactttcagaaacactcgagttcttgtttcatccattgaaagttgttaatttgctgagcgtggtggtgcacgcctttaatcccagcactcgggaggcagaggcaggcggatttctgagttcgaggccaacctggtctacaaagtgagttccaggacagccagggctacacagagaaaccctgtcttaaaaaaccaaaaaaaaaaaaaaatttgttaatttgtttcattctacataaaaacagttgctttgataaaggttgagacattgaaggaaagtgaactgaattatctccatgttgttgcattcatttatttatgagtttattgatgtggttttattgagccagagtcatgctatgtagtccaggctggcctcgaactcataatcattctgccccagcttcctgagggttgagattgtagggctgagccaaccacgccagctggtggtgttgcctttaccaacagctatgctagtaaaagcaggctaacgatgacattatagatcaggatgtgagaatcagctgtccgttaaactttggttcataaatactgtgttttatgcttatatgtaggccttgtgttcctttgttctttttatgttatcatgttggcctaactagttgtttgctctcaagatgttataatgaagcaaagtttgagatagagagtaagggaaccacagcacaactgaaagtgtgtctttgtcagccaacagttgtctttgaggtaacttactgtcctggaagaagaaaaggactctatgcagtcctcccacatccagagatctgctaggctgtctttcactgacactgtgaccatctgttgtggacggagacccttgatcttggcggtgggcttcctcttcctaaccagcccctgatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttttccgttccctcgttggacctcagccaagcagagtaaatctctcttggtggtttcaagccccgctgactgctcactgttggatcagcaggggatagcagtagcttgacagtccaggctttggagcagtgtgttctcagaggcagtggtctgctgctttgatttctgggctttgcttttgaatgtgaattgtcccaagctggcaaagaaactagcagctgctggagtgccgggcttggaaccaggtaagatggattttaattgcttatttccgttcctctggcaccagttgattgtggaacagcaggatgagcagttggagctggtctctggcagcatcggggtgctgaagaacatgtcgcagcgcatcggaggggagctggaggaacaggccgtgtgagtagtgagatgccctgagcagcagtgacgctgactgagaccctgaaagcctagcagtgaagtacgtggctgctaaagagagaagctgcataatgtgtggttgcagtttggactttgttgcacggagtagctcccccaaagaagcaaatcccagataaaattcacaactgtggtttaggcaaagctgttagttttaaaaccctttaaacgacacactaagttctctgagcagactcttgaggcatagttaggaatgggaagcagatagagccatgccctctggagacagtgccctgaagaggaggatgggcctgaaggtggtgttaggactcccagctgtcatccatcccagtacccactacattaacataagtcctgtcttacaaaagaacattcaaatttaattgtaattagcaaaaacaatcttccctctcaaaacaaaggaataaaaaaaagcaaaacatggactagagagatggctctgaggttaagatcactggctgctcttccagaggtcctgagttcaatgcccagcaaccacatggtggctcaaaaccgcctgcagtggaatccaacaccctcttctggtgtgtctgaagacagccacagtgtactcatatacataaagtaaataagtaaatcttaaaaaaaaaaaagaggcaaaacataactcttcaaaattgtttttgctgaagaacctgtctcttacactcaagtatgaaatgcacagacagctttttttatacagctgctgtataatacaccattctactttttccccgggtgagtgggggtgtacacctggatgtttcttaatgttcactgttacatatgctcattatcagttcttcctgggcacgtgttccgcaccaggttgtcaaggccctggggatataggagtgagcaagatagacactgcctgccattcagaatgcttgctgcttcccaggcatagcacatattgtacacatgaagggaagtagtcccacggtggcagtggggaaagagccactgtcactgcgataggccagttcagccagctggagagccctggtcagctgaaacctgggggcaagagagccagtgactctgcagagatgtgtgtagcagtgtgtgtaggagggaggaagcacctgagagagtcggggcaagtgtacacacacacaacatggttttcagtgtctgccatggggaagggggagcagaagtcctgagagggagtcagagcatagcaggtgtggcctgtcagtatgatgaggaggcgggactttccttttcagtatggaggaaaggcagggaggtagtgtttggagtgatgccgtgagcaggtgctgggttttagatgatttagcagagtggatccaggtggctatgccaggtgaggatctagagtaactggaacccaaacactgggtgagtttctatttaaaatggaaggaagggcttcagctactttattggtgaggcagcttgaaaagaaaggcagcctgagatccacctagttaaagatgctgcaatgatgatggtctatctccatcccctcaaagctagcacagcagcaacaggaatggttttgcaaagataaaaacctctggagaacataaaacaggaaacaggagttataccagtttagcttacagaaagcaggcaggtgatgggctcagtaggcctaagaaagctgacccctgagccagaggggagcaaacgtgaggcagtgtgcctcccaccacagacctctcagtgtgactagcctgtactcagatggtgtaatgttaatgttgaatattgacctaaccaaactatgacacaactacaaatatatatatcagagaagtgggaaggaggggacaggtgggaatcacgtggtctagggctaaatcctaatgtgatagttctgtaccatcaagtctgaggactaaagtccgcatcataagatacaagcaagctacttcacaagaggagaaaggaccagaagaagctgaactgacaggaacacacaggtaacggaagagaactgtggtttaccataacatccctgcaggacggttttgctctttaaattaggtattgatccttctggtaaaaatagaagggaagaaatatgggccttgaactgctacatatgctgtctaggagaatagcgccagcctcatgtggctactgagcatggaatgtggccagtgaactcaaatgggctgtgagcagaatgggagtcctggagtctggagcaaaggggcaggagagtttatcaatcatctttatatttcatgttgaagggataactcagatatagtagcatagataaaatatagctaaaaattaatttcagaggccagttggtgtagcatttgcctgcatacagtccccagcagtagcaggtttggtggcttctacccacagttggtgggtggaagcaggatggtcagaaggtcagggtcatccttgtaagttcaaggccagcctggactgcatttgagatcctggctcaaattttaaaaccttttagaaagcacagtgtcgaaaaaatgcaaaaaggcatttgtgacctgtatgtctctctgctgggcagaagcttggtgtggctgtgcttggctcaggattgattggcatgccttgttttatctttagtaagaaaaggtacgcccagcacacacaagtagcccttggttttcagtgctcggcctggagatgcctgccagcaacaggaccaaagtgctgccaggatctgagatgaactaaacatattttaatttgaaaactcaagtatagaacaaagatttatttacttcgttgtcagtgtggactgtggtagttaacttaacgaggatttggtagttccagatactgaaggactgtcatgtttcctttgtgggctcacacccagagcagtggtttatagctgccagtgacactgtcaaagtaaataaggtctttgtaggaaggctgtggtactaattggtgtattaattttagcctcaaactaatcatgtactagacagaagctgaaatctggaatgtatagtaatttatgaaataaaggttgctagaatacaaatacagtattcagtgctgtttccagcagcatgttggatggcaaataacaggggcctcctgagctgattctccagttctccttggagaaacactgcttttatgcagcaatgatgcatccattatacactctctccctcttgctttctgagagcgagcaagcgagagagagagagagagagagagagagagagagagagagagagagagagagagagagagaaagaaagcgcacatcccaaccctaccccttccccaccctaccccatacaccatcagggatgtcaagcctctggcttttaacttataataaggcagaatgctttaaaggagaatctgtctgatttagagtatactcctgaactcacattgacataaagtacttttgtgtattaatgtgcttcttgcaggccccctcgacacgcattgctttggcatagtcaccctgtttaacaggtatcaagagtctcaaagacttgtgtaagataccttgttcaaagaagaagtaacaaagccaggctctctggccctgtgcctgggctggcagtgctgtgtagtcagcggcacactgccttgtctgcagttctgaaatctacaaatccaagtgtttaatttgcagcagacttgtgtgatggaaaagtctcagctacaccgagtgtagctgtgattctttatgggttcttctgcagaaatacaagcattcttgatcatgggaactaccccagaccctgctaaggttgttgactaatctatagcatatgcaatatgtttttttaaagcatatattttccaaatttatttaaaacaaaacaaaatgtaagtcgttctaaggatttcgggtaacagggtggatcctgagtccccaaggacactttttacctttactgagatggaggcccaggccttactttatagcatggcaaatgcaaggctctacttaccacctgctccctccttctctccagcatgctagatgatttctctcacgagttggagagcactcagtctcgactggacaacgtgatgaagaaacttgcaaaagtgtctcacatgaccagtggtatgtatgtgtgactctgtctgtgaccttctcttgcctctggcatatttgtctgtgctacttttgggtcagaaaatggaatagtagtatatagaagccatagcctgcgcttgtggactacacgttgggaaagtcttgttcctgttacacgttttcgagtgttcgcccagtggagaaacttcccggaaatcccaaatcttgttttttacttttttccatttttcttgccacattagagaacttaacgtttttcttctgatatttttattttagcacatggtgggtacgtgtgtgtgtgtgctcgtgtgtgtgtgtgtgtgctcgtgtgtgtgcacgtgtgtgtgtgtgcacatgtgtgtgtgtgcacgtgtgtgtgtgtgcacgtgtgcatgcatgcacacactgaccatggcactcatgttcatggcagtaggtacttttgctcaccgtccctagggaacttccttaaagtcaaaattgctataacacttgctgctttctgtgaactgtcttcctttcatcattgggaaaatacctacttcttcagactgtgatgtcttataaagtgctgtcctagcattgtgtaccagggtagaaatgaaaaaataaggtttcaggtcagttaccatatttgaagatgttttctaatctacatttttttttttttgtgattactacaaattgcctcccctgaccaacaggaaatgatgtacgtcaagtcaaaatccagtatctcctctttatctggaggttgttgcctggtgaaaggaagacctgagatgtttcttgagataatttgagtgctttgggccataggataccccctcataaaagaccctccccaatcccctggtggtttctggatgtcaggtgcatctgacatggagggctgaaacacagatgcccgtgcactcttctgcagtgtcctcctggctcggtcacacagcagtgtccggccttcacctcttaactaaaccattgagagttgtagatagagctcaatgggagagtctttagtacttaaccaggaggggtgaggccctgggttctgtagcaagcaccttggagtggtgagcattggatgaaaaacaatgcaaaggtgtttaccagtgtgttcgtgctctgtcttatccaaaaataccgctctgctcagtggagagacctaagggatcaaaaagaagtgcatatctggagttctttccattctctctaggttaaatgccttcatgcttcaagcaggttctttgcctgaagctgtgtgtgttatacaggcaccagctcagtgtatcttccccatgatcagagaagggtctgaagtttgttttctggttcctctgttctcctctacctgtagtcctctactttatttatgtatttgcttttaaattttatgtgtgtgtgtgttgtacatgtgtgtacatgtgtttttgcagtagtgtgcatgtgtggagaccagaggtcatttttattttgctgactgtctgcctgtctctctctctttttgcacttgcttgtgtacacaggtatgttgaaggagttagttcctcccaccatgtgggagctggagatctaactcaggttgtgaggcttgacagcaagtatgtttacccactcagccatctcactagtctctcagccttatttgtttatttactcttttatttattatatacattgatgttttgcctgcatgtatgtctctgtggggatgttggtttcctgcaactgtagttgcatagttgtgagccaccatgtgggtgttgggaattgaactagggttatctagaagagtagtcagtgctcttacctgctgagccatctctccagccttcagccttattttttggagactaagacgctcattaacgagaaccatgccattttgcctagcctggctgagcggtgtgaagcccctggatccacctgtctctgcctccctgtcttttcccccagccgagcactgtggttatgggcacaagtcaatatgcctggcttttacctgcctgtggggatctaaactcagggtctcatgcagacactttacccactgagttatcgtctcagtacccttgtatttaaagaaaaaaagtttctttaaggaagtgttacataagcagtttaaatactagtctctctggtgtgcgtgttcgttgtacagtcaagtagccccttcagcatcagctctgtcaggaagagtgagtgaacaaaggccgtctgtgtgttttgtttgctagcattctgggtgtgaagagcgtaggaaagtcctgcagagtgtctgcaacactgaagctctctcatgcttcatcccgctttgtccagaaagaagagtttgggaaacagcatgagatatttggcaatatttgtatatggaagagagtctacaactgctctgttatatattaactgagcagttagcatgaaatacccttcgttttaatttttgcttgctaccaaagaaatattgctgtagtatgtgtttcagcttattgaccaggcagtttgtaattgttcttttctcttccataacttttggttaagttcattgctttgttatcaaacctgtatggaaaggcagtctcaaaacaatctgtcacaccagtgccagagggtctgagaagggccgatttgtcaccgtattcacgcttgttaggatggagtgataaggaagggtccttccatgctggactggaaactatggtcctgtgtctttaacgagaaaagagaatgctttccaaacagtggcatttgcccatggcaggcctcctcacactcgtcagagcagtcctgcttcagacagaaggagtgggtagacttgggtcttagtgactcagtgagtttctggtgtgtggggcagacaaggtggtccagcaaaaagatttgctgtgcttgttgatattcacatgttttggccaaaaaacagctctaagatgttgctgtggcacttactaagaatatgatttgctctgtggagagttgctatctattttcctaaattcagaccatcctataatatgctcatcaaaactgtgctgtgctgagatctgaaggctatgcagtagactttaacagcagctccacttttacatacacctgtgtacttgtgtttcattggctcattgctcctggttcagctacattctcataatgatggcattgtgtatgtgcaagtagaggctggaggtcaactagggtgtttccctctgttacttcctaccttatcatctttatttttttgagacctagaacttgtaagttctgctagaatggctggccagcaaagtcccaaggatctacctgtctgctccgcaccagcactggcgccaggagcatgcagccgtgccgtctgtttacctgggtgaggggggttggagctcatgcctgcgcagcagacatttgggcactcagtcattcctcatcatgtcctttgctttttgttctttaatagaatttgtatgactctggcaaacacatcaaacacatgtatatactctttgatactttggctggctgtcaacttgtgggaattctcctgtctcagccttcctagtgttaacttaagagacatacccagcatgcctagcttcttagtagcattcctttgtatcatcctggtcctttgtgaaggacactaggacctgctagtggacatgccacttgtgtggtccacatttctgcaagttacataagcgtcctaatggtggtgctgtctctgtgggtgcctcaagctggggccctgcacagcatgcaatgcagctgttctttaaccctttgggggacagttgtagtcttagggttgtgggctacagtaggcatccctgggcctgtcggcctttctgtcttgcagagggcttctctgctttcaaccatctagaagaactgtagcctttctgtatcctgtgccaattgctccaaaatgttagtagggctaaggtttcagaaggcattggctttcattacagatatactatgtaaatcatttgaacacagttactggctaaccaatctccttatctgactaggtgtgatatgaaattagtcattctctgccctgggagctgctttttcagccgttcatttcctgaaccgaccagcagtggctgtctctcctctccaccctctcacagtgctcatgaggagagcatgcgcattgccgaagcatatctctgtgtgggagattaaagcaggctttaatctgtcacaccagtgccagaagccttttcactggtgcacctgccaccagcagaaagctaagatccatgggcttcagctaaaggctcaggactcaaagcctgcacttaatggcagagttgtagatgtgtttgaagtgtagccccaaggcagaacagcacaggggacctggtgcctgggcagggttgggatctgctctgctctgccatgtgcatgccttgtcccttctctgcttcagcaatgttgtcctaaagtctgaggacctatgtctcaggaagggcagtacctaaccctgggaaggtcacctttgtgtcctgccttccagatcggcgccagtggtgtgccatagccgtcctcttcgcggtcctggtggtcgtgctgatcctcttcctagtgctgtgatggtggcccgcccgcctcaggcacttctgcacgaggacccaggggagaggagaagcaagcactccgccacttacattcctcgcccagaaacacacctctaccccgcctcctctgtgactccagctttgagacagccctctctcccagcgctcaaagggcaagcttcgaagagggaagaggtgaccatgtgcccggccggatagcagaagccccggctgcccactcttgctgaggacagcaagccactgctttgccttactggacctcgctccttgaggaaggaaggacagagtcctcagaagaactgacagccccacttactccgttgctcattctgctggtctctggcagcctttccttctactcagacccttttccctgcttagatgggttgccactctcccttcagaagaagcctggcaagaacgagggcatctggggatgtacgtttccattgctgttatgtttcttagcccctgagagcttgctgtttctgagaacagaaggctcagaaacacttcgtgacagaaatgcagtgtctcattttgctgggtaagagttgagattaaactgcttttccgggtgtttttgtggcagggataagcaacaggaagtagtgaaatcccttggggctgggggtgcagatgatgaaaggctttaataaactggggcagttgagaacagcagcacctgtgtcggtctagcctattgaaggactgatggtatctccctgggcctggccagagctgctgacctgctctgtcccagggctgtctcctcagaggtgcagcttgcagacgtagagccccgaacagcacagcaatgctcagccaggtgggacacaccttcttctctgatgcttttatgctgatggcactcagagatgaggtaggagggccagcacatctattacgcttatgcagaagctgtcctgacacagaaaggctgcttctgagccagaggccccttactctgtgagtaatagcatagatggggaagagaacttggtactctgctctctaagaacaacttgacttcatcatccatgggagttactgagggagtccaaattccctgacagatggtttattgggttgaagtggctgaaactgctgacactacgcttcaggcttcgggtgacggttcccatacctcagatgtgctcatgaatgtgggatttcttataatgtcccaaatgcatagcctggtattaacatagccgtcagggccagagccagccttccacgttggaggctgccgctcagttgtcctccgtgctggaagagcagcacctggacagcctgacctttgacctctcttgctctgcctctctgtgcattccttagcatgccaactttcaaaaaacaaatcctgggttattcatattccttgggattttgacttttgggtcccctttttgttttgttttattattcccaatgatgtgcttgcccagctaactttcaaattgcacttttaaataaatatttgtaacaatttttaaaagaagggtattttatcttgtttaggatcatgataggtaaggaaatctacctgttggtaaaagctaaaagattagtaagaccaaaagggggtcggcaccgtgtctgcgtgaagctctggtgttagatacagtgatgttagttcttttcagatgaagagaaaatgtgaatagtacaaagggcttcaatgtagggttctgtgttatttttgtttcacgaaattttaaagttttgaatagtcttctgtgaacatagaccatgggcaggcctcagatttgcattaaaatatagaagccttttgttaaaaatcaatgtgggccttgtctgagtactgaaacccacactccacattacaaagccgtgaacagtctaagaattgaaatcgccgcacttaaagccatgttctccgctagcagaggagagtcggtcagacgcattcagagagtnnnnnnnnnnnnnnnnnnnntcggtcagacgcattcagagagtacttctttagtaaggttcccgcatggtcagggacgaagacttgtgactctggctttaattttgtaggatctattttgagtgcgtatggcaacctcactgattgaaggtattggcctaacagtgttgtagacctgacacaggctgggactgagcgtggcgtgtcagcaagaaaggagctgctcgcgcaggtgctcccgcctgcacctcagtcctgcggcggccggcttagtccaggccagtcactgcagagccagggcaaagagaacaaggacagacctttcttccgcagtgacccagagagctgaaggtatccttctgccatatgtcctagactagggaagggaacacagggatggcccacactgcctaggagtgtgtgtctcttacagatgtgctccccagcccactctgcctgctgctcttggttttggagccatcacattaaagaactggtgggatatatatgctggctaacaaaagagcttagagtgcttacgggaagaacgcttttcccatcgactgaggatgggacggaggacagtccactgagagcgcctgccagagcacggatcccaaaatacctttagttctcagccctctgttttaatcttgtctttgtttgggctgggacatcacaatgcgatgcctgccctggacttcacagtcctggcaaatggaattgtcatgtatgcctgagcacgcatgttgtgttttcctcaatttcagaattcacgctagagctgaaacagggaaacttggcaacttgcccattattctctgcttttagccagagttaaacagactgatgggtctggtagccaacagcttggcaacttccatgccttctcacctcgtgcgggtaagggctgtgaagagaaatccagtctgattccaacagaaatctgtctctgttaagtgttttaccttctgtaagtaaaggcagtggagccaagggttttctttgggtgatttctctgcccacagagtgagaccaggggggcattcatggcacctgcaggcccagagctcgagggagggatggactgagttcacctctgtggacttggtgtggcttggcttcaccttgtgccacaaagtgaatttgtaaccaaaacagagatggactatctggaaggcaagttatagaacgtggagcacagcagctgtcgcttcctccccctccctctgactgcattgcctccctcccaaattggtagaaacgatgggcttctgtttatctttttaaggtgtattttgtccatcgagagtagagagaacgtaaaattggagttcgcaaatgtatcagcccctcactgtgcgccccagtcaattcctgaagagaagactctccaacaaggggctttactcggccactgaagactcggccacaggatcctccctggaccctcacagctgggaggggcctagtaagataggagggggtctgtcttaaatgcccttactcaactgccaaccttcaaaaagatcttaccctgaaaatggcctttctctttaagagtgaacaatgggggatgggaaagcctgctgccaaaccagttgacccgattgtgagccccagaacccacctggtggaggaagagaaccacacccacgagttgtcctctcctccacgtgtgctggattgtgggcacacgtgcaaataaatcactatataaatgtacagtttttaaagaaaggatgagattggtctgctgtgtataaacgtgggagccactgtcacctgtttcttactaatgcgctctgggcagctttactgtctggttttgattccagaaaagcgtgagtttggagtggaacagctcctatggcctgagcagcagggctctgacccaggggctgtccattgcagaggatgaatagccactgcaggcaggacttagccatcgggagcccttttaggacaagtcaaggcacttgaagctggccttggtgacagaactcagagtgatgctaacttgattcctcggcatggcgtgtttgcctgcggacaaacactgaagctctgaacggtgcctgttcaggtggctgctgactggctgcatttggaaatcctccatatgttatagcttctgccaagtcagctgtcagggcagggtgagaaagaagagaacgtgagagtgtgtgtgtgtgtgtgtgtatgtgtgtgcgtgtgtccctgccatcagctaacacgttggtgctatttttcttctgacgtgaccttaatccagacatgctcttcccctagcagtgcacattggctgctcaggcagtgcctgccccccgctggggcctcacatgaacgtttcatggacctggtttgcccactgcggccagagctttatgaggaagtgtattttacagtctgtcttcttatggctatgaattttcttctgaaaggccacttggctctcaggggctttgagaaataagaccaccgtcatcactgttagctgagcagatatctgggccctgcccctgctccatctgcgctttcctgagccctggggtgggaccaagatcaagctttgccttccgtgtcagcggagattccgctgggatccatgtgtggacagcgaggaggaccctgaagctgagctctggctggagagaagcaggtgtctttattcccagggaaagcagagtgtctgtgccctggttgtctgggggcagggcagccggccacccactgacaaggctctggaattgcttttctgttttgctctgcttttttctgtttttgaactctagacctcgtgcatacagcacactgagtaccactgagtcccaccccggctttggcaagtgctctcagctagctccctgtgacttcttcctgactggcccaggctggacctaaccctcagcatgctagcagatatgagggccatctaggaaaccgtcaaaggaacccagctgcagatgatggcagatttgattttataagtagaagtagcctccatggcttattttaatgcagaaatggaacttataagtggcaaaatagtgggaaagaaacccttatatattttcccaaggttaaatacttttacttttaaataataggacgtacacactggtgtggggtcagggtcagaactttacctgggcatcttacaggtggcacatccccacagcatggtaagagtgaaccagatccctgggaccagagttttgtcacctctgccacaggtaggtttatgtggtggctctcccagggtgagaagcttgctagagatgcatttttttttgtggagtcgttaggagaggaggctagcacccacaacccctggttccagtgcacaccgttgaggaccattgcttctacattgctctgcatctacagggaacgttcctcaaagaggcgtgcctgctcggttggtaaccctaacatctgatgacatcacacacgtgaaaactgctaagacacacttgtgtaagataaactccatgaaaactgctaagacacttgtgtaagataaactccatgaaggtgacattctacaccttgcagtccacttctttcttctgctcctcaagtcctgctgcagccgagccctgtgacgggattctgttcagtattaaagcaagatggagacctgagcgctgccctgggtgttttccccttccccttcccacttcccccatccgctcttgttcttcagtattcacatttaaacacaggttacccctccctcccggctgcactagtggatatggggctggggagagagcgcagtggaccggagcactcaccgtgcaggcttgagtactgagttcacattctccagtacatgctgaaaagctgggtttgattgagacaggaggatcactgggactccatggccaatgtagctggaaaaacccacaggctacaaactcagtgaaagacgctggctatgagaggtaaaggactggtagaagaacgatgctctacacacatgcacacacacacacacacgtgtgtgcattcacacaacacacactttaaaacactgacatatgaaggaaacaatttgcaattgatacctgctgggtctcaggaaaagaatccatggaggatcactgtgtctgtcatctgcacttggaggcaggccatacccaggggtcattggccaacacacaatgggcttttttttttttttttttttttttttttttttttggggcttccttcaccccaccccctttttttttaaatgaagggagaaagcacttggacttggtaaactggtctgggaggaactgggggaggggaaagcatatgggtaaagtatatgaaaaaaatgaaataaaactattcttaacatagatatctgcccgaggcagagaaagctggcagccactagaagattggagttatggattgttagtgctcaagaggtagcccagttggtagagtgcttgcctacccagtccagggctcagtccctagtaccaaagaaaaccagatttgcctgcttggagtcctaacacatgggaaaatggagcaagagagccagattttcaatccccctgcctcagcttcccaagcagctgagattacaggcctgaagactgcagcatgaagccactaagagagacaccagcatagggctggggaaggctcggcactgagagcgcttgctctgcagtcctacgttctctcaccagcacccatctggtggcacaccgctgcctataactccagtttcaggggatcccacctcctttgctggcctcttgggcaccaggcatgcataggtgtacatacatgcagacagacagacagacacatacatattaaccttaagaaagaaattaactagtctagtgcctataatccccagctattccaaaggctgaggcaggaggatttaaaagtgaaggccagcccgatgaactttagtgagaccttatctcaaaaaaaagaaaaagaaaagagaagtgaggtatgaaatagtacagtggtggtaaaggcacttgccttcaagcccgatgacccattcaatcctgggagcccacgtgataggagatgggtgccatgacaaatacatacccacacatatgcagactaagtaagtgtaatatatgtgtgcacacacatacatatgatgtagaaaaaggctagagacataatagttgagaagtagagtgcccacctagtgtgtgagacctagttcaatctccagatcacacccagagatactgctggcaccaagtttgactggaccacaggtttttgcttcaggaaaagctgcccgtctgccatgagtaatggtaggcaggtatctcactaaagctgtctctaacctggcacgttcctcaggagccatcaaccttggtgtttgagacaagatctccagctggggcctagctgactccagggacccttgcacccctgtggtgacaagcatccatcaccatagctgacaaatgtgggtgctgagaatcaggccctcacacttgaggagacgaacactcctgatggagccagctcctaaaacatcaaagtcttccgtgcctaaggtaaagcatgggtgacagttgcctcggtcttgaccatgtctcagagctgttactaaagttaaagttagttaactcaggaaatctgatctaggccttggcatagttgcataaattctagccactcaggaggctgaggattgcagcaagttcaaggccagcctgggctaacccaagataataattctagtccaggagcttaggaagtcagccccagtggcatttggattttgtttataagaaaactgaacaaacttctgatcttagtaacccaagaagacccagagactctgtcgtgtctgcggcggcaacagttgcagtgcaagatctcctaccacatccacagtccttcctcccaatttagcttctgagctggatggaggctggtgaacttggggtgtcacagggctgaagctgtccctccccagaagcttttgtggtccccaggtgggatgggcccgctgcctcgtggtccttctagcccatgccatgccaatttgccttatctctcagctaaagctgactccattcaggaggtgtgggcatcccaaagcacagagcaggcctcccctctgtgcctggcccctgcccagagccccaagggcagccccacactgtgataggggcctgagcccagactgcagaaggacaagacaaagacaggcctggcaggtgcccgggcatccacagaacagtcccggatgccctccaggactggcagggcagctgttgagccctggctcggtgggcacagtatctgagccagtcccagcagctcccttcctgggcccagcccagcgacctggccaaactcacagcctttgagagctgggcagagcttgccaaggaaggctgccatttctgagcaggtgttctggctgccctggaaagagacttcacagtgcagagtgggaagggatccggggacggcaggagcctgtgaatagctccagaatatgcctggggagagaagaaatggcttgggcaggtgcaccaggacaggccagttgttgccaggtaagtgaaggataattgcactgaggaaaagtcacagtctaaaggcctccgactgcacgactgtgtgagggctaaagggagagggaacagcgccagcgcagtgtcatggtttgctcccaggacagacacttctctaatccttgcaaaggttgccaggcagtgggtaggtggaagagactcagcaagggccacagataaacaggaagaatgaagttcccattcatttcacaaagctgtgcttaggagtgccttttccgtcctcaccaccagccctccagctctgcaccaggctgcaccatgccagacactgccacactgaccaggtggcgtgggattcttgcccctccttgttctgtttgttaatggagtcttcctcatttcccccacctctccagcctgcaccagatctggcttagggcaattaactaagttctagaaggttctgatggtgcagtttctggagaaccacaccaatagctctataggtaaagcaaatgacagaacagacaagatgctggagagagcaaagcactctccctatcccccaacacaaacacgcacacacacactcacacacacacacacactcactcactcacacacatgccagggaccacagcattgcttaccccaggggaaagcagaggccacggggtgcctcagatctcaggtcagaggcaggaaagcctgtatgccctgtacattctcacatctgggttctgtccttttctgccctgggggaggggaaatggaggaaggctagagaagacgggtggacctcactcggggcagacagagctgggaacttgataccagcaccgccatcgagctgggtttcccacctctgaaaggccaagaagcaggacactcctggtaggccccgtttaaagactggggtacaccagggcctggccagcagaagctcctgccaccccagccccctggcctctcccagccccttcactgcatttctccagaagacaagtgaccttgctataacagaaagcagaggtgacttttgctactgacattttccccagaggtgaaatttctttagtggcagctccaggctagggaatatccagcaggacagtggttctcaactttctaacactgcgacccgttaatacagttcctcacgcagtggtgaccccaaccatgaaattattttcattgctacttcagcactgtaatgttcctacctttatgaattgaatggaaatatctttggagacaggtttgccaaaggggtcgcaaccctcgggttgagaaccactgctgtatggggttgccagggcttccccttgattgtagcgtttgcagggaagggatgggggcagattcatctctcgagtgctccagtgccctctttatgtgctgaggtttcatgcacatgataggctggctactcttatccacctgctagaagccccttctttttgctttttctccagcctggggtagtcctagccatccagtcctgcact

SEQ ID NO: 1880 - DNA, 768 bp, Mus musculus
atgtccatggaggaccccttctttgtagtgaagggagaggtacagaaagcagtcaacactgcccaaggattgtttcagagatggacagagctccttcagggcccctctgcagcaacaagggaagaaatcgactggaccaccaacgagctgaggaacaatctccgcagcatagagtgggatctggaggacctcgatgaaaccatcaatatccttgaagcaaatcctagaaaattcaacttggatgcaactgaattgagcataagaaaagccttcatcacaagtactcggcaaattgtcagggacatgaaggatcagatgtcagcttcatctgtgcaggcactggctgaaaggaaaaacagacaggcactcctaggagacagcagcagccagagctggaatgctggagtggcagatcgctatgggcgccttgaccgggagctgcagctagccaactcccacttcatcgaggagcagcaggcacagcagcagttgattgtggaacagcaggatgagcagttggagctggtctctggcagcatcggggtgctgaagaacatgtcgcagcgcatcggaggggagctggaggaacaggccgtcatgctagatgatttctctcacgagttggagagcactcagtctcgactggacaacgtgatgaagaaacttgcaaaagtgtctcacatgaccagtgatcggcgccagtggtgtgccatagccgtcctcttcgcggtcctggtggtcgtgctgatcctcttcctagtgctgtga

SEQ ID NO: 1881 - protein, 255 aa, Mus musculus
MSMEDPFFVVKGEVQKAVNTAQGLFQRWTELLQGPSAATREEIDWTTNELRNNLRSIEWDLEDLDETINILEANPRKFNLDATELSIRKAFITSTRQIVRDMKDQMSASSVQALAERKNRQALLGDSSSQSWNAGVADRYGRLDRELQLANSHFIEEQQAQQQLIVEQQDEQLELVSGSIGVLKNMSQRIGGELEEQAVMLDDFSHELESTQSRLDNVMKKLAKVSHMTSDRRQWCAIAVLFAVLVVVLILFLVL

SEQ ID NO: 1882 - DNA, 69611 bp, Homo sapiens
  misc_feature (1)...(69611): n = A,T,C or G
cactaagttggtggtaatttgttatagcagcaacaggaaactaataggtctacctttacccagaataaaataagaagccaaataatgaaattaacatttggcaatctctcagcggcccctggcaccttctcttctcagatctttgtatttctctcttcctttcctttctgtttctttacattgtttttccttttgttactcatttaacaaatacagtcacctggatttctcttttggaaaactcccccaatattcccaaatgtctctcagcactggaattccatggccatgtattttttcctttgaatttttgttaatatcttgttccaaaatgcattccataccataacctgctgtactgacattaaaaagtaggtatgaggccgggcgcggtggctcacgcctgtaatcccagcactttgggaggccgaggcgggcagatcacgaggtcaggagatcgagaccatcctggaacatggtgaaaccctgtctctactaaaaatacaaaaaattagccaggcgtggtggtgagtgcctgtagtcccagctactcgggaggctgaggcaggagaatggtgtgaacccaggaggtagaggttgcagtgagctgagattgtgccactgcactccagcctgggtgacagagcaaggctccatctcaaaaaaaaaaaannnnnnnnnnnnnnnnnnnnnnnnnnnnnnnnnnntgagtagctgggattacacacccagctaatttttgtctttttagtagagatggggttttcccatgttggccaggctggtcttgaactcctgacctcaggatccacccaccttggcctcccaaagtgctgggattacaggcgtgagccaccacacctgaccgatgtctttcattttttaagtcattgtattctaattgcaaattagtaaatttaatccagagtacagggcaaatacatataaaaaacccagagagtgataagataaaaatcacccatcagaaaaaattgctgttggccgggcatggtggctcacacctgtaatcccaactttgggaggctgacgtgggcaaattgcttgagcccaggagttcaagaccagcctgggcaacatggtgaaacccctatctgtactaaaaatacaaaaaattagccaggtgtggtgcatgcgcctgtagtctcagctacttaggtggctgaggtgggaggattgcttgagccagggaggtcaaggctgcagtgagctgagacgccactgtactacaaccatggcaacagaaagaaagaagggaaggaaggaaggaaggagagagagaaggagggaggaagaaaggaaaaaatttgctgttaacatattttagtgtatttcttttcagtggttttgctgactacatatgtctgcatataagcatacctttatttgttcattttaccaaaaaagggttttacgtcctaatagtattttgtaaattcttttcaaatttatattttccaatattaatatgcagtttttaatagcatagctttaatagtccttaaaatttttaatagattcaattatgccaagatcttcaaggacaggtaagactgccccactaagctgggaggcactgaggtagggagaatccctcgcattctctttgtggaaaaacaagcctcacctctgagcaatagtctaaacttaaatctcaggccgcacttttcagagtgggttgtgcttatcctgttcattataaatccctttatgtgtttggctttttaatacctgatttattatatgtattttaaggcccctctgaggaatctgactcatttgcagttagtgcaattcatccttaaaaaccaaatgatgaattatcaagttagcaaaagggtcttgtttgttaaataatgttgttttcaacataatatattttattatatttaatcagtagtttccccttggctatttcttttttaattcagtagaagtgtgtgtgtgtgtgtgtgtgtgtgtgtgtgtgtctgtgtctgtgtctgtgtcgagtttgatttgagcccttttctgtgggtaggtaaaatccatttgccaatttttggccaaggctagtccttgtacaaatgggagtagaatactgtagcaaagaacatgggttcaggagtcaaacttattttcaaatgaggctctgacatttcctacctatgtgacctttgaccaaattattaacttctctaagtctgggatttctcatagaaaatggaggtaataaccaattctgccttacaggattattgtgaggattcaatgaaatcagcagtggtggaaccaagaagtgacttgtcacttgttggggcattagagtacttttactacacacgcataatggccatcagctgtcttaagtaatcccaaataaacctataatttaagaaaagaggccaggcgcagtggctcacgcctgtaatcccagcactttgggaggccaaggtgggcagatcatgaggtcaggagatcgagaccagcctggctaacatggtgaaaccccgtctctactaaaaatacaaaaaattagccgggcgtggtggtggtcgcctgtagtcccagctactcgggaggctgaggcaggagaatggtgtgaacctgggaggcagagcttgcagtgagcagagatcgcaccactgcactctagcatgggcgacagagtgagactccatctcaaaaaaaaaaaaagaaaagacaggggtctcccatgccacatcaagtcccctagccctgctgtccaaccaaattacattctaaaacctgccccatatggggattctggagcttctgaagataatgcatgtgtgtcactgtatttgttttcacactgctgacaaatacatacccaagactgggcaatttacaaaagaaagaggtttattggacttacagttccacatagctggggaggcctcacaatcatggctgaaggcaaggaagagtaagccacatcttatgtggatggcagcaggcagacaggagcttgtgtagggaaactccaccttataatactgccagatttcatgagacttattcgctatcacgagaacagcacgggaaagacctacctccattattcaattacctcccaccaggtccctcccaccacaacacatgagaattcaagatgagatttggttgggtacacagcccaaccacatcggtcacttagcacaatgcctggtacatagtatgtaaatattagcaatcactagtactattattgcaatgagccagtttaccaacacagattgatttttctttccttatacacagtcacattcataaaggatggtaaagaacatacctccccttcctatagtggttcaaatccaccgtcttgtcaagaaattcactgaattccaataacgtatttcagctttttagtactcaccaatttccattcattcagaccctcctaacttgccttattctaaacaggatttaaaactgttatttatttatttatttatttatttttttgagacagggtctcactgtcgcctaggctggagtgcagtggcgtgaatatggctcactacaacttctgcctcctggctcaagtgatcctcccacctcaccctcacgagtagctgggaccataggcataagccactacacttggctaatttttgtattttttttttgtagagatggggttttgccatgttgctcaggctgaaaactgctaacttttgatgtactttttcgtatgtggtcacttggcttttcacttctcttttattactttttctcttctttttaaaaaactttttggatttctgactatccaagtaaatatttcactgtagtagttgacaaactttaaatagatttcttttttcctacgtgtaaaaattttctatgtaccaaaacattttaatgtataagaaagaacagagctgaaattgtatcatatgtataattttgtgtcttgctgtttttactcaagccattcctatgtcattacatacttttaaacaacatttctaatgaccaccaaatggatgttccacaaattctccatcattccttagtgctgaatatgtaaattgactggaattcctccttgtttattttaaatcagtgtgtagagggtgacagtggtggaggtgttggtaacaaacaggaagaggaaataaatcatggccagtgtgttttggatatgtgtatggatattttctgtggttggaggtaggaaacatagacagtcatagccagatcaatggaacttaacataagtggaatgttctggaatatgtacatgtatatcagggtttctaaaaggttggataatgatgaagagtatgatatcctatatctatgttaacacttttctccctttctttaccttgtttcaagaaggatttagggtgaactcaacaaaaacaaaacaactcaatcaaaaatgggcaaaggacttgaatagacatttctccccaccccccaaaaaagatatacaaatggccaataagcacacgaataggtgcttaacatcactaattattaaagaaatgtgaatcaaaaccataatgagataccacctcacacctattagtacaactgctataagggaaaagaaaacccagaaaataacaagtgttgatgaagatatgaagaaattggaatgcgtgtgtcttttagcaggaatgtaaaatggaaaacaatatgactgttcttcaaaaaaatttaaaatagaattaccatatccagcagttccacttctgggtatatatccaaaataatggaaagcagggtctcaaagagatatttgtacaccagcgttcatagcagcattattcattatagccaaaagatgaaagaaagccaagtgtcgtccactgatggatgaatggacaagcacaatgtggtatatatacaatggaatattaggcttacaaaggaaggaaattctgcaatatgtagaatgaatgaatgaaccttgaagatatcatgctaactgaaagaagcaaatcataaaaagacagatcctgtatgattccacttatgtgaggtacccagagtagtaaaattcatagagacacacagtagaatggtggttgccagagattgttgggggagaatggggagttgtttaatgggtatagagtttcagttctgcaagatgaaaagagttctggacattggttgcacaacaaggcaaatatatttaacactactgaattgtacacttaaatatggttaagatggtaaattttatgttatgtgtattttaccacaattaaatttttttttttttttgagatggagtctcgctctgtcgccaggctggagggcagtggcgtgatcttggctcactgcaacccctgcctcctgggttcaagtgattctcctgcctcggcctcccaagtagctgggactacaggcacgcaccaccaagcccagctaatttttgtatttttagtagagatggggtttcaccatgttggccaggatggtctcgatctcttgaccttgtgatctgcccgccttggcctcccaaagtgctgggattacaggtgtgagccaccatgtccggcctcataaatttaaaaaataaaaaatttaaaaaataaaaaattattcccatatatgatccagttgttccttataacaggctagtgaaggagcaggctgaatgtcattatttcagagtaggggagatccccttgtaggggtgtcatggcattcccgcagcttccaggggcagggggtggctacccactgcaatccctctcaggtctatcctggcatccccagtgatatggttggctcctttctgatcctcagctcatttggctgcctgtgccttattctctgtgttgccatctccttatttctgcagaagatgcattgcaggacccagtgtgctcccttcctcattcactctcctaactttggagactcactcaggaaccagaggttctcctggctgcccactcagaactctacagaaagctcagagttggcatgtcaacctcccccagaaaaatgaacagaagttaagtccaattaagagtttcggtttgaggaattctgacaaatgatactctcatgtaacacacactccgtcaagatacagagcatttctagtacccaagaaagtttcccttcccagtcaaactctgtcccccaagacaaccactgttttgattttttattccctgagaaatttaaattattcttttgggttgggggtggggtaggggtgggggtgtgggaagagatgggtttttgctgagtattcttcccaacctattgtttatgccaggacgtgggtcctattaaatgaaaaaaaaaaaaaagaaagaaagaaagaacctcctttgtttctccttgcattttagccatagcttccctttccttgtgggcagtggaggccaaggtctagtttgagagagggtaaaggagggtgacacattaaagaaaggaacacctacacacacacacacacatacacacattttatatcttgacactccactatctccattgttggtgctttttctaatcccctaattatgggaacccaagcctctgtcctctatcttctattactacttataaaactctggcctgtcatatgtggtccaattaagaaattcatggaacagataataagaggccgtgtcaggcacttaggtgataataacattaacatagtatcctgtccctccaggagtttactgtttggtggggataaatgacatgctaacagctaatttacattcaccctaaatcaaatcctcctcttgtgttctctttcttgatggttggaaccaacactacccatttacaaccccagaagccttcctccctcttctttcatcaattcccccataccctgaaccaatcagtcaccaagtatactaactttgcctctaaagtatgtctcaaatgcatcactcttctccaccttagttgtcacaagcccagctcaggataccctcatccctcctctggaccataacctcctagccactgaagcatctgtctcaaatgccaatctgaccctgtcaattccctcagtccccatggggaactgtccataggaagcgtccactattctgaacattacaaacaagggccctgataatctgaccctgtccacctccaggcttagctcctgctgcccccatccttttccttctactccagcaacatggcccccttctcctggctgcttctagtcactgcttaggaaccccctgccccagccccgaaaacacacaaatatactggtatcttgtcgctgtgtttctatggcaacctgtgcccttctctcactgtgtgtctctcccaccagtctgtctctcccaccagtctgacagttccttgaaggcaagaaccaagccttgttcatgcctgtgtctcagtgcttagcacacagtaggagcacaacatgtgtcaggcactgttttaagcacttttcacacatcacctcatgacactctataaggaagctgttattacggtgtctatttcacagttgaggatagtgagagatgaagcggcttgcctgagatgcaacagtcaggaagcagcagaactcaagcaatcagactccaaggatggtcttcaacaccatgctcacctacccctcaatttacatgtgcttgttgaatgaatgaacgatgacacgttttcacctccccagctaagtaaattaaacagttctctcccaataaacattagcaatcactagtattggacactgcttcctttccccacatctgccttccatcattcgctcctccagggattttggctttcacccctctcttctctcccctcctgaaacccattcagcccctcatcatgtctaggtgtttagtcttgttttccttttgaaacatctgtcagattcactccttctctgttctcaatcgctgtcatcctggtctggacctcatcccttcaggccacatgactttagcagcgtccttactggttttcctgacttcagtaacttagtcctttgggatcttgaggtttacacacatttttatttaaccatcacaacaacccatgaactagctattattatttatgttttatagatgaggaactgaatgatagagccaaggtttaaacggggtttgtgttgctccaaggactgtgccagctccagactggtgaccttgggcaagtcacttaacctccgagtctcagatttctcatttataaaatgggcatgatagcagtaattatcacattgtaagagcaactgagataacacttaacatcctgcctgacacacacacacagtaagtgctcaatgattttcagcaatcaaagtccacaatccccatccacaaatttcatagcatatctagcatatgagttggttaatggttctgggcaaaatgttttctcgaatagctcttgaaccacagtgagaggaagttgtcatacctggccccttctttattcctcgaaggtgtgctctcctgggaagcaccatatgctgtatgaaaaattactttacatggttatttgcagaatgtacagcaacagaaagtacaccccatctggtggaaagtgcacagaatctgcagttctgccctgtccaggctgtgtgactacaggaagtcttcaagcctctctgaacttattttcttatctacaaaatgagaaaaatggatggtgtggtggctcacgcccataatcccaccactttgggaggcagaggcaggaggatcatgtgagctcaggtgttcaaggccagcctaggaaatatactgagagccccatctctataaaaaatttaaaaattagccgggcgtggtggcgctcacctgtagtcccagctactcgggaggctgaggccggaggatcgcttgagcccaggaggtcaagggtgcagtgagctgtgattgtgccactacactccagccagggtgacagagagagaccctgccccccaaaaagggggaggggggaataatactttcccccaaaggatactgagatgatgcatacacaacctttagcacactgtccaacacaaagcaagacctacttaaaggatctgtgtaacattataatcagatactatgcttcattttaagtcgaggaccagatagatttataaattacatactgtcaaaattaagtattaaaagtagaggaaaggtaagaggattttgcaaatcaggtacaactacagcttatcctgaaaagccgactgcctagttctgagggaacaagccactcctcaccctcaagcttgaggagagggctgtagaagcccgcccacctccaccgccccgagggctccgcctccagggccgagggacgcaggcgtaagccccgcccactggggggggggggagagagagagagagagagagagagagagannnnnnnnnnnnnnnnnnnnttttttctcattttgtagataagaaaataagttcagagaggcttgaagacttcctgtagtcacacagcctggacagggcagaactgcagattctgtgcactttccaccagatggggtgtactttgtgttgctgtacattctgcaaataaccatgtaaagtaatttttcatacagcatatggtgcttcccaggagagcacaccttcgaggaataaagaaggggccaggtagagcgactgcatagagaggagagagaggagagagagagagagagagagatatatgccctggtcacgtgagcggggtgcggaagtcgtgtttcaggcggcgttcgtgattggccgcggccgagggtcccgggggtggggtcaggccctccgacgcttcgggaggagccgggactggaggctgccgagggggccggcgcccgagtccgggattcggccagtggtgctgagcgagtgctggaccagcggccgtcctgtgcacctggcctgtgcgcgtgcccgctgctcggcttcacccagactaaggcgcgggcagctgcgggaacaggcggggtgggcggagggagaccgggaggcacgggcgccctgtgcgcggaggaggtgaaggcggccggggccgggacgccatgtccatggaggaccccttctttgtggtgaaagggtgagtgtcggccgagcgctccaccggaggaagaggtggcggtgctgcctgcccgcacctcctaggtcttctcgcagtggggggaggggaggcaagttggagctggggagggggaacagtggagacggcttagtcttgagggccatgaccaagcgtcaagagacgttccctccatccctacctggaccgtgaagccactgtccccagccaagcccctggtggtggggggccctttttggcctgtgtgctgcggtacaatttatttgggggccgaggggctcagcagctctgcaggtggggaaggagacacgcgggtcctggcgcacactggccgtctagtcgagcatgggatcttgcttcgaaggagcgaaaacagcatctgggcaggaaaagggaaatggccctcctgagctttgtagttcgcgttgacgggggtgagctccattgtccattgagtttggagcgcttgtccgcagactggcgagaccacaacaagcccagaggcgtctgagcacgtttgctgggagggaggcgggggcgggggccgttctgggaggctggggagcagggcaccggaagacaattcaatgggggagtttttactgagtaatgtgaggagaggaaagcagtcgttcatactcagtgatgatttggaaggaaaacaaaatgaaacaagccaaaccaaactttcctcagctttctattagcaaccggaattttctcacagtgctaaaggaaatgagtgttgcttgttaactccttgatttcatccaggttgtttgacaggtttctcctatttcttctgcctttcagaatagaaaggactgccttctgttcccttacaagctatcctagctcatctttgattgctcgattgtttctttggagatagagtcttcaactgcactttgtaatatccacttcgtagccattaaacacatgcaagaagatcaattctgatgtaacttttagtttcttattagaaacttgtcagttttctgttttaaatgtcaaacatgaaaaatctgaaaactgcaaagttcccaggtcagtactgatcaccacagaatgtcccttgctttttactagttgctgctagcttcctatttctgtagtggtgcaagctggccgttgtatagtcaagtgttgtagaaaatttaaatggtattttaggtgaaatactttatcgattatgcagtaaaatacatttatactacttcttaatatttccctggaaagttttttttcttcaccttactctaatttagatgggaaaatgctgagttgtaaatttactggtaatatgtgtatccctacctagaaaatgtgatatttattagaaggattgatttaggggttaatttttaaaatagatgttttttccttgattgaaagttcttaatgcttaggttggcaaaggttatctctggcggtagagatcagagatgatcagaaattttttgtttgactttttatggaatttgtcaaaagcctaaattcttctgtcttggcatttttttttcttgatggtatcctatacagtctactaatgcttgctcactgattaaatatcactactttatcggaacattggcttggagggagttttgattgatttttacatcattttagctcctatctttaaggttcttgaaggaaaagagattctcagttccttctgctgtggaaaggtaaagtcacccatgaaggtgtatccagatttttggggagtcatgtacctgtgtttattaaaagtatcaaaaatgcattacacagcatgcaaaaattaaaggtgcctaaattatggcccttagcctaggagcttctggtctaatctgagaaacaaattaccccaaaattaaatagaaatgacaggtggcaaatgaatgagtgttgaagtgaatgctacagataagtgcctcaggagttcagagaaaggtaactccttgggaattgttaggattaggagagcttttggaggcagtagtgtatcttgaattaggttttgaagatgggcagaatttagataatcaggcctgtctctcttacctggatgcttatcagagtctttttaattgttcttcctgcttctggtctcatttcctctttcagctgtcctgggatctattggatcattgctgtccaatagaagtataatgccagccatgtatgtcattttacattttctagtagccgcagtaaaatataaaggaacaggtgaaattaattctaatgtaatctctaatacattcaaaatattcaacatgtgattaaagattattgatgagatattttacttttgtactaagtcttctaaatctgatacatattttacacttactgcacatttaaatttggacattaaattttcatcagaaataattgatctgtatttaaagttcattaaatacattttttttttttgagacagagtcttgttctgttgcccagactggagtgcagtggtgcaatcacggctcactgcaacctctgcctcccaggttcaagcgattcttgcacctcagcctcctgagtagctgggactataggtgtgtaccacctcacctggctaatttttgtatttttaggactatgggcagggcacccgccaccacgcccggctaattttttgtattttttagtagagacggggtttcaccatgttagccaggatggtctcgatctcctgaccttgtgatccacctgtctcggcctcccaaagtgctgtgattacaggcgtgagccaccgcgcccggcctacatactctttaattgttccaaacatacataaaaggtttttgataactgaattgctatcagttaccaagtttacattaattaaaatttaatttctgtcacactagccacatttccagtcagtagttgtatgtggcttccgtgttggacagcacagtgtaagcttttctagagtcctagacaggtgtaccctacttaatattattcagtggctgctgctggcctgcagaataaagtgccaacacttcctgacctcactgatctagcctctgctctcccttagccttagtactccagcagtgccagactcaatacagtgactgtgattgctgtactggatgctcttactctacatgcacccacactgcctgattcacccacgcagctttctggagtcagtgtaagcatctcccttgcctccaggaagtgcttcctttgtcacccctaattattggacctcttcctctgtctctctttcattattagactatgagctctgaggtttgggactgttttttttttttttttcctctgtatttccagcctacaccttgaatatatagtgtaaatgttgaacacatactctttgttgatggtggtgattgtgatggaatggtgcctcatgggtgagaacaccaccagccaaaggcctaagttgggcaatgtgtgttagaaatgatctggaagagcagcccaggtggagtagacagtttagggaagtagtaacagctcacatttaaaggatgcatctccagtgccaggcatacatgtaaagtgctaagtaagcactttatatgaattttcactctgtaaaaacacccatatgatgaatactagccacattttagagatgagaagctgaggaagtgttagaggggttaacttacttgcctagggtcacacagctaataagtggtgtactcaggcttcaaattagaacaacctgatttcacactactgtcaatacttcccagtgcaggtaaaatagggtcaagttatgttggcctaaggagaatctcatcttgaggccattacagatttttaaagcaaggaaatgacatgaaattaggattttaggaatattgatttggtggtagtgttggatgcatcagtgtgaggaaagatgaaaaaggagaccagttagaaagctgttgtaacttatacatgcagtggttagtgcttggaagtttgaagctccttttgggaggttttgacattgtcaatgtcctgttcggaacagaatcccacaacagggattgctcttttatccttatgaagtaggtattattattgtcatcatttcacaaaaaggaaaatgaaacttagtaaaaaacttcaactttataagcttgtacgtagaagggccaggatttatatatttattacaaatatatattatatatataatatggtcattttaaaaattgggattatacgttatatatggttttatcactttttcttttctttttttttttttttttttttttttgggacagagtcttactctgtcgcccaggctggagtgcaatggcgatggcgtgatctcagctcactgcaacctctacctcttgggttcaagcgattctcctgccacaccctcccaagtagctgggactaccaatgtgcgccactatgcctggctaattttgtatttttagtagagatggcatttcaccctgttagccaggctggtcttgaactttgacctcaggtgatccacacaccttggcttcccaaagtgttgggattataggcatgagccaccgcgcctggcctgttttatgacgttttcatctgtatttctttatatccttcagacttctgggtggcagcttttaatgactgcattgtattttgtcatataaatgttcatcctggaagatacattatatttatgatcacactacaattaatgtggtgataagcctacttgtcataggtctgtattgctgcttctgattttcatagcctgtattcctggagcataattgctaattcagagggcaggcacagcaaagcgtttgatgcatactaccacgttgtcctccagaatattcccccttgcccctcaaagtgtttgagggacccaattcccttgattccagtactgggattttcattaaaaaaatctttactaatctccgggtgaaaatatcatatttaaatcttgtagtcttcatctttgtattcagtaaggatgtactcagtgtttgttgagtgaacccattttgattgtttagttctgtagtttttttcctcccttgttggcaagtttttagaattagcctccttttagaatttgcaccttctaatcagacaaaccctgaagaaaaccatgtaactgagcatgtggagacagagtataagtgagccactcctgtggataaaaggtacaaataccatggctctttgctattttattgctgtggaggttttgtgtgtctgatgaggatagttttttgtttgtttgtttgtttgtttttttgagacggagtctcactctgttgcccaggctggagtgcagtggcgcgatctcggctcactgcaagctccgcctcccgggttcacgccattctcctgcctcagcctcctgagtagctgggactacaggtgcccgccaccacgcccagctaatttttttttttttgtattttcagtagatacggggtttcactgtgttagccaggatggtctcgatctcctgacctcgtgatcctcccacctcggcctcccaaagtgctgggattacaggcatgagccaccgcgcccagccgaggatggtttttttgtttgtttgtttgtttttgagacagagtctcattctgtcacccaggctggagtgcagtggcgcgtcttggctcactgcaacctccgcctcccgggttcaagcacttctccctgcctctgcctcccgagtagcccgccatcacgcccggatagtttttgtatttttagtagagacagggtttcactgtgtttaccaggctggtcttgaactcctgacctcaggtgatctgcccgcctcggcctcccaaagtgcttggattacaggcatgagccaccgcacccagcatgataacagttttatttccaggtttttggctgtggattgatgttgaaataatgacataagtaagctgatgagtaagatggtatatgttatgttgtgttctttaaccttctctgtctgcatatctagctttattaacactagattatgagctcctcgagggcatcacgcattctattcactgttgaaaaactgtattggtatagtcactgtgaaaaaaataacccttgtttgttaattttggcctagtaaaattgaatgtaaatcaaatttaatactttctaaaaagcagaatccagtgtttcgttgtaagaacaaatttgcaagcctttattataaatttgagtgtttaatattatttagctccttagtttggagaacactatgcagataagtgaaagatatattgtgtaagattttgcagtagagttgagatgctgtggagattgaaaaaaaaagaaagacccatgctgggaatgctggtcaatctgggccttaaaggaagtgtctgctgaggtgtaaggctcttctaggctggggaaacaactgagtggaagtcaagaaccaggaatgagaaagatgggaagaagacctgccaactgaaacagaatttgttcagtgagaaaccatgcttgatactaaagtcagccagtttgggttaggaggaggagtgggagagggtttgaatacctgcctgaggagtttaaatttaatctgatttctatcataaattctaaatcaggaggcagtttttaaactagcagttactattcacttgcttatagtcagcttttaagggttcaaacccagatcttctgattctacaaagaaaacagatttgtgggccaggtgcgatggctcatgcctgtaatcccagcactttgggaggccaaggcaggcgaatcatgaggtcaggaattcgagaccagcctggccaacatggtgaaaccccatctctaccaaagatacaaaaaattagctgggtgtggtggtgggcacctgtagtcccagctacttgggaggctgaggcaggagaattgcttgaaccctcttttgcagtgagctgagatcacgccactgcactccagccctggtgacagtgcaaaactccctctcaaaaaaaaaaaaaaagatttgtgtggaagttttggaaaaatgcaattaaataagtcttggtaatagaaagtgtcttataatcagggttggaagaacttgaggcaagcagccaatatgtctgagccccaaggtctcttatttatgtttaaggagcacaaactagattatcttgaaagttctttccagatctgaaaattcagtgattggatttaagtagaggttgtgcaaggtaaggaggaggaggagtcaaaaatgactcttgtctagacaagtgttgaaacttggaaaatggtggcactattggctaaaatgaggaagctagaaagggaagcagatttttctattttgtttgttttgaatacattatgttttgtagggaggatatgattaatttggttttaggcaaatggaatgatcctataggcagctaaaaatataggaattaagcctggctgagtggttagggttggaagtatagtgggggagtcatcagcttaagaggggtgctttgaacttgtgaatgctgatgagcacatagaggccacaaagagtactgagaaacattgggatccagtggaggaagaggaaggagaaaactggtagaaaactagaacagcacaatgtcacagagacagagaaagtgagagtttcaagcaaatagatataatgggccatagtgtcaagtgcaccaaaaatgaggacaagttaaattcactcgtgactttgacctgcagtgtcattggtggagttgtggaagcagcagtaagttagggtcaaaaattgtatataattgtaggtaactgagtaaaaatgatgtttcattttcacaagagtaattacaaaatatgtcacagtgtggttgaatttggaaatggcaataaagtcaagtaaagggtgtgcatgtgtttcctttcaaatacaaacgatgtgaatgtagaagtcaagcaataaaaagagttcctctctttctggagagatgagtggtgaaaccaggtttgtggggtatggggcaggaaccagttggagaagagtgaggagtgggagtctgatgtgttgcagaggctcactcaacctgaatttttcatgtttcattactagaatggaaactttcagccttgactagcctcttttactgtattgatgaaatggggatccctctgtaaagacttgcagagtaggtgctgtcccagataaaagagttgtggcagattgtattttttccattgatggctgcaccaataaatgttctgtcctgtgttgcttttctttctttttttttcttttttttttttgagatggagtcttgctctgtctcccaagctggagtgcagtggtgcaatctcggcttactgcaaccttcgcctcctgggttcaagcgattcttctgcctcagccttctgagtagctgggtttacaggtgcatgccaccacacccggctaatttttgtatttttagtagagacggtttgactgtattggccaggctggtctcgaactcctgacctggtgatccacccacctcggcttcccaaagtgctgggattacaggcgtgagccaccacgcccggctgtttgtttttattaaattgtgaagctggcattcttttatcaaactggagtttgtattcccttcctttgaacctgggcagacctttataaactgctttgactagcagattgaagcagaagtgacgctgcttgactcctgaagcttaagtcataaaagacaaccactataccttccatctgcatctttcatcttgggacacaagtataggctaccctgagctaacatgtaacaagtccagttacattgaagccactctgttagagcatgtgtgcagactgtggagagatagagagatgtgatgcctttacagccccagcctgtttaatattttcagctgaggtcccagacattgtggaacagggacaagtcagctctgctgtgtctgattcctgatctacagactccatgacatgataaatggttgttttacaccactaaattttggggtcattgttaaacaaccacgataactagaacatgccaattcagagtctgccagcatgggcaaagaagaaaggataaatcaaaacgatgaagggggaggccaaggcaggaggatcacttgaggccaggagtttgagatcagcctgggcaacagcgagaccctgtttctacaataaataaaaaaaattagcttggcgtggtagtgtgcacctgtagtcctagcaacttgggaggctgagacggaagaatcctttgaacccaggaattcgagattacagtgagctgtgattgcaccactgcactccagcctggttgacagtgagaccctgtctcaaccacaacaggaaaaaggatgatgggggttgtggctacacttacgcaatttgttggtacaactgaatgacaaatactggggaacaaagctccctaatggctgagatactctttcttctcattttacttggcaaacttggttagatgcaagtaagaaaactttgtgattttttttttttttggactgtatttggactgaatgtattacttgtggccccagaggctagtttggtgatgtaccatattgggaggttgtatggaagaggctcaactatctgacgagggatcaatgttgggctaacttcaaaaataaatgaggttggtttgccagaatcaactttttatttatgaagaatggaagaattggctgggcgcggtggctcatgcctgtaataccaatactttgggaggtcaatgtgggtggatcacctgaagtcaggagtttgagaccagcctgaccaacatggagaaaccccgtctctactaaaaatacaaaattagccgggcgtggtggtgcatgcctgtaatcccagctactcaggaggctgaagcggggtaattgcttgaacctgggaggcggaggttgtggtgagctgagattgtgccattgtactccagccagggcaacaagagtgaaattccatctcaaaaaaaaaaaaaaaaaaagaatggaagaatctgaatgctcagatgactttattttgtttttcccaaaagatgcattcttcaaagatgtgggcagtgtttccatttttgacagctacttactgggaaagttctgcattgcaagtggtcctgtgggcattgtggtgacttgccatgaagagccttcattctggtgtctgtagggagtttaatccttgagaagatgacaggttccatgattttgatgggctgttttgtagacagcagggaggaaaagccacatccctagaattgccaacactggctcttggtatctacgaaatgctacctgtatcagatgaaactgatttgggcagcatgtgtgacggatagcgcaagatttgcttgatgtgtggagatagccgtctttctctttcaaggatttgaaaaaggcttctctgggtcagcagctaaaactataattcctaggaaagtcatcagcaagttttcagtgaaatgctgccagatgtgattctccaagctgtgggtgagcagattgttatttaccaagaagtttgctaagctgaagaactctgacaattcaaggtatacctgcttcaaggtatatactgcttcatggtatatactctctcatggaaagttctgggtatcaaactttaatttttctgattacatagttgaggaaaaaaatagctaaatcagacataaagataagggataaagaagcactatctgtgattgtcacctttctggagacagacaaaaatggatctctgttgcctgagcagtcagcagttgtatctgctcactcaacgggaagtgctcctcaaagtgaagtgctcctcccaaagtgaagtgctcacacgggctagttgtgtagaacggacaacagtggtgggtagacatttgtgggtcatgcctcactagccaactgatactgaaacaactcccttgcctttcctgagaaagaaatgtgaaatcaagtagatgggcacttctcttataaaaaccctcacaaatctcaaataggtgacatgattatatgttactgttttatgaattgacttacttggaatgccaagtaatcttcagtttttagttgcaagtacttacaagtggttctggattgagagggttgtctccctggttagatttgtacattattaggtgtgtcttgtggctcttgaagctgttagaaatcccacatgctttagaaaattctggttaccattaatagttggcttccaaataagacttgtgaccaacattgttttctgcttccagttcatgccttctttttcaggctaacactgaaatgatattggaagaacagttgggaggttttccacttagagagacctctttgcttgctattgagatgggattccctgatacactgcagattctggctgtctttcaagatctgagccattgctggcagtttccacctttgtgatcccttaaaacatccatcttaaaaatgtaaaataacgactagtttacctttcttatgtctgtgttactaaatgaaaactaaacatgaatcctctttttaaaaataagagctttagaatggaataagccaagttgctggtcaggcctgtagggtgctgagctttattctgcaactgctttgtagcatttttctaattcctgccatttctttcatttttttcctcaggacatgctttgcttcttgcatacttaaggattccttggcttcacactcagtgctactagaatccacccatgcacactcctcaacttcagtctaacagtgtcttaagacattgtagttctgaaagcatggcctgtaaatcacaagggatccccaagatcctttcacagaaagatccactagctcaaaactcttttcatgataatattcagatattatctgcctttttcaccatgttgacatttgcactgatggtgccaaaaaaagctgtggtggctaaaactcctggtgccttaccaaaaatcaaggcagtggtgtcgtgccatgctttctgtggtattcctcatcagcttgtactaacagtaaaaaaaaagaaaaaaaagagtcatattcccctaagaatattcttcatgaggccgggcgcggaggctcacacctgtaatcctagcacattaggaggctgagccggttggatcacttgaggtcaggagtttgagaccagcctggccaacatagtgaaactctgtttctactaaaaatatgaaaattagctgagtgtggtggcgcatacccataatatcagctactcgggaggctgaggcaggagaatcgattgaacccgggaggtggaggttgcagtgagctgaaatggcaccactgcactccagtctgggtgacagagtgagattctgtctcaaaaaaaagaatattcttcatgaaacagtaaaaattaataattttataaaatcttgaccctcaagtataatttttctcatttttttaaagttataatttacctacaataaaaagcaacctttttggtgtacacttctgtgaaattgactaattcatatagttgtgtaatcatcacttccacaagcaggatatagcacagatccatcaccccaaaacgtttctctgtatgccttctggtccttcccccatgtcgagcacctggcaaacactgaactgttttctgttcttataattttgccttttccggaatgttatgtcagtgaaatcgtatagtacgtggccttctgaatctagcttttttcacttagcctaatgcatttgagattcatctatgttgttgtatgtagctgtagtttgttcctttttattgctgaatagtattctgttatacatatatactacagtttatccactcattagttgaaggacatgtgggttgtttacaatttttggctgtgtgaacataagttttcatttcacttaggagtgggactttggggtatggtaaatatatgttcaagaaacaaccaaactctcttccaaatggctgtactattgtgctttccaccagtaaggtatgagaattccagttaccccaccacctttccagcatgttgcattgtcattttgttttcattttaatccattctaaatatgtagtagtatgtaattgaagatttaatttgcatgtcattaatgatattgggcatcttttcctgtgctatttgtcatatgtatgtctttggtgaagtgactggtcaaatcttttgcttttttttttttttttttggaaacaacagtcttgctctgtcacccagattggagtgcaatggcacgatctcggttcactgcaacctctgcctcccaggatcaagtgattctgctgcctcagcctcctgagtagctgggattacaggcacccaccaccatgcccggctaatttttttgtatttttagtagagatggggttttaccatgttggtcaggctggtcttgaactcctgacctcaagtgatccacctgccttggcctcccaacatgctgtgattacaggcatgagccactgcagctggctttgtttaattgggtttttcttattaagttttgagagtttaaaaaaatatatattctggatatgtcattaatcagatatataatttgtaaatatcttctcccttagtatatattttaatattccactggcaaaatggaagtttgcgtgaagcatttttgtgatgtattgttaaataaaatggttgtctctaggaaaagcacttatgtgattgagttgtgagttgaaatagctgttttccccccgccccgagcaaaatctcatttttactggagagaatgacaaactggtttctcagacttgcaggctttctcaaatctcaaatttatctaaaaaattctcgagatattttctcacaaatgagtgaggtgaacctgtcacttcatggaaaataaatgacagtatttttaccagtgataaaattagagccttttgtttaaaaaaaaaaaaaaaaaaaaaacaattttggaaagcttatatcaactactatgctcttacagatttccaacacttaagtttttctgatgaaactggtggtgataataacaaatatgattttggatactgtgtattgaaatgagctggcatttggaggttctgcaatactcagtagactaatactttcctaatgaccagtatttgatgttataaaatcatccaaaagtaaaagatccaaattacaggttgagcatctcaaatgtgaaatgttccaaaatccaaaactttttaagcaccaacaagatgctcaaaagaaatgctcactgggggcattttggattttggattttcagattggggtgctcaactggtaagtacaatgccaatattctaaatctgaaaaaatcccaaacatttctggtcccaagcattttggataacggaatctcagcctgtacaagattgaccaatggatcgtagtataagggaaacaaagcgccctaatgactgagatactccttcccattttacttggtaagctaagaaaaacaagaaaattattactgtaaaataagaaaatctaaaaagttctttaatacagttttaggatccacattgcagctaacctttaacagccagttgtcaagttttggtatactatcaaaaaagtacatccacaattgtccgaaaagactattaaaattctcctcccttttccaagtatgtatctgtatgaggctggattctcatcatatgcttctaccaaaatgtatgtccacagactgatggtagaagtggatatgagaatccacatttattgaagagatttgcacaaatgcaaaacaatgccattctcactacattttttttgttttagaatttttaaaataaaaacattgttaacatgtaagctcacattttaaagttgacaaatatttttaaaatgtctgtttgaattcctaatatagtaaatagattagatacatagtatacataactctgagctcttcggggtcttcagtaattttgaagagttcaaaggagtctcctgagaccaaaaaagttcatagattgctacttagaatttaattccagcatcatcattgtgtactggtggtggagaacaaacctaagccctagcccaaggcttcttggtttgaggcttctagttctcaagaaggaattcatatttactttacagaattgatatattttatattctttaaaagatgtctttacagataacctcttcaactctgtcttccattatcataaatgatactcagtacttacaaataaaccaatgcaatcagccctccatctctgtgggttccaaatctgtggattcagccaactcaggattgaatgtattcagtaaaaaaagaatggttgcatccctactgaacatgtacagacttttttttcttgttccctaaacaatacagtataacagcaatttacatagcatttaaattacattaggtattataaataatctagagatgatttaaagtatgtaggaggatgtgcgtaggttatatgcaaatactatgccactttatgtaaggacttcagcatctgcagatttggtatcctgtggaggtcctggaaccaatcccctaaggataccaaaggatgacttactttgcattaaggaatgatacatagctctttctccactaaatcacccagatcccataaagagtaaagaaagtagattttcacctcacttaattcttccccattttatcttaaatagggtttctcattagcactgaaagtctaaaggctgacgtgaaaggaacaatgaggtgacttgcctaagccttaaactagatgaatagacgttggtagatttgttgtccatatagtttgcttatttactcagcctgcacctagaagctgtattctctgtttaacgttccgcctcttagctctcatcagtatgccatagacctaaatattgtaaggtgctttttttcatttttgttagcgctttcttttttccaatacttgaaacatcagagggtataggatgcgtgtgaattctgttttaaagccatagacaacaaacaccctaatcagctagaacacgtttttgtggtctttgttccagaagaaatcatagaaggatcaaaacagttcttatagttcaggagcagtgggattatcatctttgaacatgagagaccatatgattataaaatgactcctttttggcttttatatgtgatagtattagattataacatttaaatagtggatattggcccaatggtgggggtaaaagttcttaaaatcttgtgactatatctaatctaaaggcatgctagatcatagcacttaatggcctagtctcattctctaaacaagaaaaacactaatgtggctgggcgtggtggctcatgcctgtaatcctagcactttgggaggctgaggcaggtggatcacctgagatcaggagttcaagaccagcctggccaatctggcaaaaccccgtctctactaaaaatacaaaaattagccaggcgtggtggcgggcacctgtaatcccagctactcgggaggctaaggcagaagagtcacttgaacccgggaggtggaggttgcagtgagccaagatcgcaccatttcgctccagcctgtgcaaaagagtaagactccctctcaaaaacaaaacaaaaacaaacactaatctggtatatggtattgcttaattaaggaaagtaggtatatttaaagctaataatgtttggaaattgaatgagattttgggtttaagaatttctcggattaaaatacttaacctataataaaatggtagctatgtaagagtaaccttccctccagcattctcattcctcccacaccaagaaaagaaaggccatattaggacttatcatctgagtataaattattaatactgtcacaccaagtggaagcatgtgggaatgctcattgccctttagttaatttgtaggattgcttcattatacttttacgtatagtctgttcagagaaaaatattaaatttgtccttccccaacaaacttgatattgtagctgcttaaataatggctattgtattccaagcatcagctgagaacataatactcagactgtgtatcaaagttttgaactttgatatttgtctgtgaagagccttctgtgggaatggtggttgctgaggatggtgtatgatcataaatgttaacctaaatcatgcagtaacttgaccatggaatgttgtctgtgatttctctcctttgcctcatcttgattacagagaggtacagaaagcagtcaacactgcccagggattgtttcagagatggacagagctcctccaggacccctccacagcaacaagggaagaaatcgactggaccaccaacgagctgagaaataacctccggagcatagagtgggatctagaggaccttgatgaaaccatcaatatccttttctgtggtgtctgtgccattcgggataaatagacaaatggacaagtttttctccagttgtttccagtatgtagatgaaacattttataatcgattaatgtttgttgctcttacttgtaccatgacatgtttaaagtatttgcccagtaacttaaggtacagtagccaaattcttatacagtgtgtgacaaatcctgtactataaatgtatatatatatataaaggcagcatagtgtaatgattatgactgtggaccctggagtcagatttctggtgttcaagtcctgcctccaccaatgtaaagggaaaaaaaaaaaaccctttttttcttttttttttaagtctctaccctcacactcaagtcagtatgatatttctgacactgtctacttggagatagcatcaggtccacaggttaagagctcagtcccacaagactgcccccacttcagatgccagttgcaagccctaggttgtgaccagcgcttccaactgaccacgtataaattggagttcccacgaccccctccatagatcgaattaatttaatttgcaagagcagctcacagaactccgggaaacagtttccttaggtttatccatttgttgtaaaggatattacaaaggatacagatgaatgaccagatggaagagatgcatgcaaggtatgggagaaaaggtgcagcacttccaggccctcttcaggtgcctccaggaacctccacatgttcacctatctggaagcttcctgaactctgtccttttggtgtttgtggaggattcatttcgcaggcatgattgatcacatcagttggccattggtgatcagctcagccttcagcccctttcccctggggtggggttaagcagggggctgaaagcttcaactgtctaatcacatggttggtttctctggggaccagcccctcgtcctgaggctatctagaaacccccagccatcaattatcccattaacatacaaaagatactcatctggagattccaagggatcaaggagctgtgtgccagaaatgagggggcagagaccgaatttgcatttattacagtatcacaaccagttaccatgtgacttgggctcatcacttaacctcctgtgcttccgtttcctctttagtggaaagttaggataacaagagtacctagctcataggattattgggattatacaggtaaagagtttagaatggcacctggcacacagcttatgtaatagtgttagcagtcattatcatatagaggtccatacaggccagtgttacacttcggtaattagagatcaaaaaatctttttgtagactgtcttcatgtttaagaagtgatgttacagtgctaccgtccattgaagagatgtcttgttccatgaaactgcatttagtaaaagcagatctgctctgctaattcatggtattgatgtgaagtaagtccactgatctgactcatgcactggagaactgtaaaaacttcattatatagcctttttttccaactggaaatcccacttaaccaaaactttagatggaagatatgccacttgcatgttctgagttctgttttgttttttccctaagtgagataaaacataaggaaaccagcttctgtcaggatcaccttatagttagcacaggttcgtatgcagttgatacatggagtaaataatttttgttattcatgatgaccctggtaccttttacattattaaaaggcaagtatgttctctaaaattagtggcaaatatgtgagggggcaggatcaaaagcacagttacagggagataattcttcccttgagaaaggagggaaggaaaaaaagttaggggagatagagaaaatgtgagattaaaaaaacaaaagttttaatagatactcatcattcaaccagcaagtgtttattgagtatactatgtgccaggcattttgttggttacagagattagattaataaacactataccagccctcacagaactttgagtggatagggatgggggacagatggtaatcaagtaataacacaaatagatacctgcagactatgaaagagaagtatagagagctatgcaagtgtctgacatggtgcgtcggaccaggctagagggtaagggaatgagggcagcttctctgaagaaggcccgatctctctagattaagaagtagggttagcatcttggcataatgggaagtggtttggaatggcaggagaaaaaggcttgcaaaagctgtcttagtaaaggtgatcaggagtcaaaaaaggatagacacaagtgttggcaaacaggaagagcccagctcacctgtggtcagatagccctaagtgtttgcagtgaagctcatcagcaggggctatgcttcctaaccagacagatcatctctgtcttggagcaaagggatcctccctcctgtggctgtgggcagaggaagtctgagaatgattggtgtccagctgactgtgttttcagaaagtttgagccagattttatttgtttgcatgtgagagattcagtgagttaacaggatgttgtcaggctttgatgatgaaattgttttaccttgactttttgacctacgcatagttgaagcaaatcctagaaaatttaaccttgatgcaactgaattgagtataagaaaagccttcattacaagtactcggcaagttgtcagggtaaggaatatgatcttattgtgttatctgtataagaaatagccagacttcttagagctctttcccttaattgtaaactaataggtcacctctgaaaccactttttaaatatgaattaaatgtgagcttccccatatataatttctctgattggctgcgcatggtggctcatgcctgtaatctcagcactttgggaggtggaggtgggtggatcacttgagcccaggggtttgaaaccagtccgggcaacatgatgaaaccctgtctctacaaaaaaaaaatataaaaattagctgggcatggtggtgcacacctgttgtctcaactacatggaagaccaagatgggaggctgaggtgggaggatcaggttgaggctgagagctatgatcacgtcactgtaccttaaaaaaaaaaaaaaatttccgtgattgaagaaaaagaaatctgtttttaatctttctttttttgacacaaggtctcactgtgttgaccaggctgaaatgtagtggcatgatcttggctgactacaacctctgcctcccaaatagctgggactacaggcgtgcaccaccacaccaggctaattttttgtagagacagggttcaccatgttgctcaggctggtcttgaactcctgaactcaagtagtttgcctgcctcagcctctcaaagtactgggattactggcgtgagccaccatgcccagcctgtcaggcttatttccgagagcaaaaatgagacagtaatctgctggctttgggcagggtacattcaaatggtgtcatcctgaatgattagacccttgtccatacctctagtttcttcaagctagttatctttctcactttttatttcttagtgtactctatttcttgacgaacaaaacaattgctattgtagaaaccatttggttttttgattgattggtaatcacttcgcattgttgaagagtgactcttagtgggtttggatagcggcctcttccgccatctgaattgcttctggaactcttgcaacccaagatactgacatttccatatgtaactacttgacagccgttccagagttatccagagcaaacaagcatctatcagagtgtaaaaaattgatccaagtgaacaaatctttagttctaagttatttagaataatacccattattaaagaatctaagaaaaaatattaagtacaatcttgtgtcattaaaatgtttcatattttgaaactatatggctaagccatttgattagcataactagatgtaagagaaccagctgtctttaacatatgtactagaaagcagcttccttgaataaaaagacttgggatcataccagtgctaacatacggctttttaagagtcatcttaggcaggaaccttagtttgtgtttgccaaagtctttatatcatgtgatttccttttgaaattatttcaaatggtagattatcactgaactttatatattcttgttacttgttttattcattagttgcctttctatatacatatacgtaaattgtttatagataaacccacattttaatgagggagaaacctttctggacctcagatgccccatccacagtgagtgtttggattggacattcttaatttctagccagttcaaaatactgttctgatgaggaagccttgttgttaggtgacatattttttgtaagataagtaaatccccaattattttgtataagcttttttttttttttttttgtagtagtaggttttttgaaggatactcctatagacgttaatatttaagtggggccttgcagtgaagcatatgtccttaaccttaatcattatatttatttctgcaaggtagacttaggaagtttgcaaattgaaatttagaggttcgtatattaaaaattaagttcattggtataatggaaagaagaatccaaagttcattttctaatatctgaaaagctttttaaagtacattcttagaaagaggttgatatgatttagctgtttccccacccaaaatctcatcttgaattgtaatccccataatccccatgtgtcaaaggagagaccaggtggaggtaattgaatcatgggggcagtttcccacatgctgttctcatgatagtgagtgagtctcatgatagctgatggttttataaggggctcttcccactttgctctgtcactcttccctgctgccttgtgaagaagttgccttgcttctccttctgccatgattgtaagtttcctgaggcttccccagccatgctgaactgtgagtcaattaaacctctttctcttataaattacccagtctcgggcagttctttatagcaatgtgagaacagagtaatgagaggtattccaaatcaagtcagtacttcaaaatcttactgtccttttagagttgagatctaaaccatactcaactatgtgatccacctgaatattttagggttttaaatcattcttgtttaaatttatgacccctttgggggaagctgttagtatttaccagtggtaggctaacagtacctaactgagcttttgctgatctgattgtaataaattctagttgaaagtcctatagaagaggaggaaatagcaatggtgctaactcgattaaaaataaaatataccttgtataattccacattaccacatttagctaaacagtgtttgtatgtagagatttctgggttctgggtggaagagctcgatagagagggagcagagggttagcagatttggaaaatgagatgaaatgaagttcaaattaggaatttgtacaaatttatgttagttcttctgttactattactagtgggctttcatttaatattgctccaaaattttgattgactttatctttcaaacagtgtattctacttatgctttctcttttgtaggcaggggagtcagtgatactctatgcattttgtggtttttttttttctttatttgcttcaacctgaagaagtaaatcgcctgtttcttcttgattaatgtccattggttatgcctttagtaagctttccttgtttagagttttgtgtatgtttttccaagcatcttttaagtctgtacaaatccagttttgctggcagtttttagtgaagaaccaaaatactcacatttttgtgtaaatagctttcatatttttgaggtaatcatttttactcttgtggagtcacctatacatcaaagattccacatgtgaaatttttgtgttttagaaatatatcctagaagtgactttggttttactttaggatcaagaggttttgcagtatatggcagaataatggtgaatataaggggtaagggaacctgagttctaggctaagctgtgaccttaataaatcttaaccatggtaagtcattcaacctccctggatctcagttttatctatgaaataatcctcactaacattctctgactttaaaagttagaactattaccctctccatgaaaaaaccgaacctgctccaatgtaagaattgtttacagtcaattgtaagtcaagatggaaatggctttggttaatcaaaaagggtgaagtatccagtgtgagcacagatgaccttgaaatgtaagaattatgagtgggaagcactggggtttatgatgtctcattcattcagcttggaagacagtgtgaaatgggaacagaagcataaataaccaggacatttgttgttcctttggcagatgaaccatattttattgggacttgttgcttgactgctggttctaaacgtcatgtgttagaaagaagatgagtaattatgtttttggcatgatagattgttataaaatgtttaaaactatttagtaacatagtttaagatcccgaattccaatatgaaggtgttgtgtggtatctgctaacttttgacctacatggataaagtgccatcttagaagtgaaagctggcggggtgtggtggctcatgcctataatcccagcactttgggaggctgaggcgggcagatcacttgagggcaggagtttgagaccaccctggccaacatggtgaaactctgtctctactaaaaatacaaaaattagctgggtgtggtggcagctgcctatagtcccagctacttgggagacagaggtgggagaattgtttgaaccggagacagaggttgcagtgaactgagattgtgccactgcactccagcctgtgagacagagtgagactcctcaaaagaaaaaagaaaaaaaaaagaagtgaaagccatagatccttagatccttacccgcggtggtggtggtcacatacaggatgcctacccacagggctattggaggaatctgcctcatcagggctaacacccatgcaggcacacacataaccccacatggtttttattaagcataaaactttaaaaactgcaactttagaatacacatttaattatgataatgcaagctcaaagaaaattagagaaaattttcaagaagtaaaagtaggaaaaggaatctaaactcagaataatacatagcacaagactttgcattttcttcataattttcctcccaatgcagggcagttgtatttttacatagttgtgatcatactgttatgcaatcatagcattttattttcttaggttaaaaataatctgtacttggtatttataaaatgcaaataatcctgatgaaaaaactttgaagagaaaatgcctcttcgttctccaatttcactccctagaaataattagtgtcaacaattttatttttcacagccattttatggacattgaaatatgcaaacttttaaaaagcagtggcatgataatctgtaactttttttctatgaaaaattacattgtggacatagtcttacaatgacacagataaatctagagaagtgctgttcagtagtaataaaatgggaacctcttggtcatttttagttttctagttgccacattaaaagagtaaaaataggtgagcttaatatattttatttaacctgatatatccaaaacatgatcatttaaatatgtagtcaatataagagatattaatgagagatttaaattttttaaactgtttttgtaataaatctggcatgtattttacactcaagcatatctcaattcagatgtgaaattttcattggaaatacttgatctgtatttagagtttacagaacttacaattgaaaaagtagagtcacaaacccaattttttctagacatacttcaaagttttctaataactgagtatcaattaattaaagtaaaattcagttcctcggttgcactgaccacattttaagtgctcagtagctagtgggtcctgtattacccaggagcagactatcctttttaatagttgcatacgtttatttgctgataatgtttattgagtgcttactatattgttggctactgttaatcaggcttcatgtgttacctctattaatccctacaatgattctaaaagatattattctaaatgtacagaagaaatagaaacttagtgcagctattaaaaagcataactaagtcttaaacctaggtctttgacatgaaagatcatgctgtttccctctcctttaatgtggctctgttatgatttatttaatcattgacctaccagtagatattttggttattgtttattagtggaaattgcaaaccatgcttcagtgaccatctttgtgagcataacttacataattgtttcgtaaaaaattcaatgagaatacacattttaaatattcattgccagtcatgatggctcatgcctgtaatcctaggactttgggaggccaaagcaggaagatcagttgaattcaggagttcaagaccagcttgggcaacatagtgagacctcatctctaccaaaaatttaaaaaataaataggcatggtggcacgtgcctgtagtcccagctacttgggaggctgaggtgggaggattgtttgagcctgagaggttgaggctgcagtgagctgtgatggcaccaccgtactgatgatgcctgggcatcagagtgaaatcctgtctcaaaaaaaaaaaaattgttttcaaagtatcctacaaaaagaccttatcagtcatatttctgatagagtatcagaatataccttcactaagtattatcaatctttttcatctttcttggtctaattggagaaaatgtctcttagctacacttctttgattaccagtgggttattgcatctattcatgtttgatcatttgtggggtttttgtgaattgtctgttcactgaactctcttcataagcacaatgcctagtacataatgcctagtatataatactgcattgtgtggattgtgttgctgttcccttatttgggcttgctgcttatttctactttttttcttattataaataatactgcagtacacatctctgcatgtctttttttgtatctattttatgttatctccttaaaataaattcctgttagtggaattactgggtcaaggcagtgaatattttgagactcatggtacagaatgacaaatttattttcaaagtgctgttctagtttaccatccagccattgtttgggaccagtagtattaaaaatacatatatttactaaaatataacggtacagaaaagtgtaattaacctaaacatatagcttaataaatttataaactgaacacagccatgtcaacagcacccagaagcattgcagggtgttaccagcacccccagaaggtgcctgtgctcctttttagccaatgtctctaccccccactgcactgacttctaacagcaaaagtatgttgtacatgtaatgttcaaaggctaacatgtcactttcccatacttgcatgttgatatttttattatgcaagtaatgtgttgttttaaaaaaacactattataaaatgcactgactatatttttattttattaattttgtagagatggggttttgctatgttgcccaggctggtctgcaactcctggcctcaagcgttccgactgccttggcttcccaaagtgctgggactataggcgcaagccatagtgcccagctgagtatatttttaaaggcatgtattatccccctagtgaatgttgctctgcgtagtttttaataatattaaataaatcgggctgttggattgactgtcagaatgtcatcttaaactctgattgataatcagaaaacgaatcctgcagtccaggagatactagcatagtgatcagtttctcttgaaggcttctagatttccattgtaagacaaggaatggggatggggagggggcttgttaaaaatgtgccgtcaagagtctgacttcgtaggtctcataggggcctagggaactacatttaaaaaatatttttaggccaggcatggtggctcatgcctgtaatcccagcactttgggcggccgaggtgggcagatcacaagatcaagagatcgagaccatcctggccaacatactgaaaccctgtctctactaaaaataggaaaatgagctgggtgtggtggtgcgtgcctgtagtcccagctattcaggaggctgaggcaggagaatcacttgaacccaggaggcggaggttgcagtgagccgagattacgtcactgcattccagcctggtgacagagtgagactgtctcaaaaaaaaaaaaaatttttttttaaatttcttgatacataatggttgtgcatatttttagggtacatgtgatattttgatacatgtatataatgcgtaatgatcaaatgaaggtaattggaatatccatcattttaaacatttatgctgcaaacatttgaattattctcttcttgctattttgaaatatacgatagattattgttgaactatagtcaccctactgatctattgagcactaggtcttatttcttctaactgtattttttacccattaatcaacctctcttcatcctcctttccccctgcactcttctggcctcaggtaaccacctatctattctttgtcttcatgaaatccaccgtgagtgaaatctcatccacttatgagtgagaacatgcagtatttgtctttctgtgcctggcttatttcactgagcatagtgacatccaggggaactgcatctttaacaacactcacgtgactgactcaggcatgtcatcatgatgtgaactccatgtgggcaggggcctagctagtatcattcactgctgtatgcctggccacatagtagacatcagtgagtgtttgctaaatggatagatgagtggtttgaaagttgaatcaggtggttctcactcacatttaccacagttctgggattgtaaaagcggtggcactgtctcatctgtttacttgtcatgggtctttaaagaagtttctaaaagtcttacactttgatgtttgcataaattatattttgacgaccttttaaaaactgttgttgcagtcatgtattcagttcaaatcattctatagtagattggattgtagctaaataagcagaatgactcatatttaataaagtgttttgcttcagataaagtaatggatctattcacttttcattccatacaaaattatttttgacaccactctggaaattcactctgatgttaggaatagtctatacctttcatgaatccaactcagaaataaaataagtgacctgttgtaccactatttggaagtattctttggtgtttaatggtaaatatactttatactaaaagcacatggttttttacatatattgtaaaaaagatgcaagcccttgaacacgtgcttttgtgtttgtaccccagggatgttctttattagtgatgtgactttgagaaagtatcatcgtctttttggacctaggtctcctcaaccttaaaatggaaatagtaccagcttcacagggtccttgtgaaaattcagtgataatgtgtgtatgtgtttagcactgtttctgacctgtggtaggtacctggtaaatgttaattcctttctctttcctcctattcaaattagtatccaggttacttctttttaagggaccatctttctttttattttattttctttatttttgagactgaaaataaagccaagaaatgcggtcttctttttaaaaagtaataataaattgtgtgttttgctaatgtatgaaatgttaactgtgattttgtttaaggatatttttcatttgttttcgtatcttctttctcattaggacatgaaagatcagatgtcaacttcatctgtgcaggcattagctgaaagaaaaaatagacaggtgagaaaacatcagaatataattatcaatgacagaaagcatacagttagatatttggaatttaaaaatgctgaccatccatggatcatgtaatcaagaggaagacttctgcttgcaggccctggtgtgaccatgggaggttttgtgacagtccaggcagcctgtcccagcaccctgtcaacatttccctcccctcctcttaccctctggtcttctcctctgggctccatagcaccttttgcctacccttactatagcacttatcacagagtacttttacttttttaatgtgtttattctgtacctattgaacacattttgtgtgccaggctctttgaagggctataattactgtctttctctctgctgggctccaggccctttgacagtgaggagagatgtgtgtcatggttttttgtttcttgtttgtttgtttgttttgagctctctagcagttactacattgcctacccatggaacacattagacatctaaggattgacatttgatgtaaagacattagaggaaccttaaacttgtgtgttaaattaagtttctctttgttttaagtagttttaaaagaattacatactttggcatattgatagaagctcctttctaattgttaaaatacagtccttttaaaaaatgtagaatgatcatctagaatttggactttcatttagattgagatttgatttagactttttttggtgggatagaatgtttttgcctgttgctaaactgttaggtaatttttttgacagaagtagttttttaaattctgtggatatccattttccttagaagtaaaaaagacttcatgaaaaatgatactatttgctttaaatgacttaccttagtctcattttattaagattccagaaagttatgaattgtccatttagtaggctcttgagaaatttcactatttatactaactagcaatcagtacttcatacctgtgggtatttgtcaagacacttaattttgaaaacaaatattatggaagcttgaagaaggggcagggttctataaatatcacctaacttaattttcctgtttccttttcttgcattccatttttcaagtcattgttttgtttttggctttttaatcttatttgcctcctttgctttctttttgagcaatatagctaggaaaagccactagctggtccattccatctggctccctctcttgaaagaagctagtgaatgccctcaagttggctagttttggagttctcttcttatttgcacttgagcttataggaagtggaagtaactgaagtagttgtgacagtgaggtcagtaacacctatgctgttactcttaatttgaatgttttattctctagatagtatagttgggctaatgtaaataaaatttatatttatatatttataaatatatataaatatataaatttaaatatatatttatataaagtatatatacatgtatgtatttatatattgcctatctagttatggcttggaattttgttttaggctatgagtgaaatgtcaagttgcaaattttcaaggaatagcaggatcagggctctctaagcactccagcaggcatgggccttgccacgttgtgccaggtgccaggctctgtgctgctccttgcctcaccagcacccctgctctggcacccacacacaggtgcatcttccagtccttgggccctctctcaatctctatcctattatcacaaacatttgggatcagactgatgaactttaagctatttcacaataaaacgtggatgatttgccctatacttagctctacctaagtgtacaccatggaaaacgtaggaaaaatagccctgtgacctcaggagcacacaaggccctggtggtgtcccagttctctgtccttaggccagtgatgcattatagcatttttctgaccctaaaaaaattgtcactatttcctcatgtcttccatagaggtccttagagtgtggatcataatgagcaggatcttttcagtcttgatagccctaagaccaggtcagggcagagccacccacaaaaagccttggatctgctttacaccagagacagtcaccatccagctggactgaagctctgggcccctggaagctcttgtaagaaaagcttctaataactgagcttccctgatcctagcccctgaagtctggccatttgatggagttcacccctcgcagtctgagaagaggtcagtgtcagtatggaggaaggtcatggggctgttggaagggttttcagacagaaccaagtaaccaggcaggcttttaatagtgcctgagattttttttaaattacccgataggaaaatttggcaactctacaaggaaaaagagtcttagttgctagcgtcttctggctcttgcctgcggggctggtgtgagcagttactttgaccagtcaggaaggcttgtggggatctggtcagaaccaactgctgagatggaactctcacattcctgcctgtcttcttcatgtgaggaagacatacccatttatggctgcaaacttccttgaattcatacttgggaaacccgacccttgtgtctgggagccctggtggagaactctgactttagggcagcccttgcctcggttgccagggtcaggcattccttgtggtcatacctgcctgtaaagtaacccccagttgtcatctggaaagcctgaaggaccctggattctattcatgggttaaacttaacagacattgatggttcttgtgcctttgtgtgtgaagggctatggcttaccttcttgtcattccagggaactctcccttttccccccaccaaaaaaacccacaacttcccctgggtcacactttttttaaaaaagtactctagatcttcggaatcaggttgactggaacctatgggttgctgaagttccacaggtaccaggaagagctcttttacaagagattgaatgcttttcaattataacacagtatatagatgggtgtttgttgatttagcagacgtttatttgcactttaaggggacaaagcccattgtgaggcctattgggagagcttaaagacatagagggcccttcctggaattccttaaatagtaccacccaggcaccaacctacaccactacataaaagccttgcccaggggaaaatagacaagaaatgtgaaaactctttatatcactcttgatgcatcacttgttcagagatagtaattgtttgtttctcctgactcctctggttgttcttctcacacaggcactgctgggagacagtggcagccagaactggagcactggaacaacagataaatatgggcgtctggaccgagagctccagagagccaattctcatttcattgaggagcagcaggcacagcagcaggtaccccaaggaccccagacttaggacgggccagtgggaaacaagacacccccttagttcctttgccagccatggggtcttgtggcttagtgacaaggagggtaagccagagcttgtcctgtgttgattgtgtttaataattgcatatgtaaagggtttcaaaatcttcacagcgtgactgcttcaagagaaccaagctcagccaggcgtggtggctcacacctttagtcctagctactgaggaggctgaggctggaggatccttgagcccaggagttnnnnnnnnnnnnnnnnnnnnagaccccagctcagttagttctttaagaaaaaacagtcctttgtccatctcagcaaagacactttcagaaagatctctcatttttttcttcgaaaattattgattggtttcttttttttttttttttttgtgagacggagtctcactctgtcacccaggctggagtgcagtggcaccatctcggctcacggcaacctccgcctcccgagttcaagcagttctcctgcctcagcctcctgagtagctgggactacaggtgcacgccaccacgcccagctaattttttttttgtattttagtagagacggggtttcaccttgtttctcaggctggtctcgaactcttgagctcaggcaatccacctgactcagcctcccaaagtactaggattacaggcatgagccaccgcgcccggcctattggttggttttgttatatgtaaagatgactgcttttgtgtaggttaaggggtagaaggaaaatgaaattgattatgtctgttgatgcctttgatatgtagctgtattaataaaagcaagctaatgataatgtgtctggggatttgaggagcatgtacccattgaaactattgattcttaaatattgtgttttatgtatacatgtagtttatatgttcttttgttctttacattagtatgtctgcttaaccagttgtctacttaaattgctattaaacccaggaaattttttttctatagaaagtgagaagaatgcaacacaactaaaagtaaatatttgtcagtcagtagttgtccttgaggtaacttattgccacagggcatcctttcgtttgtccttgaagagagaggaaagactgcatagtttccccacatccagagatttgccagactctcttgtatttaagctgtggcagtctgttgtggattgagaccttgatcttggcaatgggcttcctcctcccaaacatccccatgtctcaatggtcatctgcacgtgtgctttcaaccattgtctgctccattattggacgtcagccaaccagagtaaatctctcttggtggtttcaagccccgctgactgttcacaagttggatcagcaggagatatcagtagcttaacaatccagccttttgagcagtgtgttctcagaggcaacggtctggtcctttgatttctgggctttgcttctgaatgtgaattgtcccaagttggcaaagaaactagcagctgctagagtgctgggcttggaaccaggtaagatggattttaattgcttatttcccatttctctggcaccagttgatcgtggaacagcaggatgagcagttggagctggtctctggcagcatcggggtgctgaagaacatgtcccagcgcatcggaggggagctggaggaacaggcagtgtgagtattgagacacccctctcgcttcagtgaaattgaggggcagagccatcctatgacacccctaaaaagcctggcagctacgtggctggtaaaatcaaaagctattttattcatagctgcatttttattctgttttacagattagcctccccaaaagaagcaattctacttcgtaaattttactacaggctttaggtgaagttgttattatttttaaacacctccaaaaacagacacagatttctctgagcagatactcgaagtatagttatgaatgggaatatgaaacagagaagcctctgtaacctgtgggaatttttgttccagagaggataggacatgagctgactttatcatcccatgactctcctgctatattgaacagatacgttttgctttgaatcttaaattattgtaactttgtttttttttttttaaaaaacttacaaatttaacgccagttaacaaaaactctttcctctcagaaaaataaataaaaacaaaacataacctcagtttgtttttccttatgaacaatcccttttgcacccagaagttcgatggcaaaaactgcattcttaaatgctgccacatcattttgtaaatcttttgaaagagaaaaatgaaaaaacagtccaccaggatatttcagaaactttcctgtctcgatattacgtttatcatgacacattgattgattatgaattcttagtgggcccgtgttctacaccgggccttctggaagccaagggatatagaagggaacagagcagacaagacaacccatctctgccaaagagtttgccgcttgcagggtagaacggatattgggtaagtggcgaggggtcattaggtgatggcagtgaagtgggagggcccctgtgatggggccagtgcatgctgcctggagagccctgacttagcccaaggtccctgaggaagaggggtttaactgaaatctgaaggatgtgtggatgctagccaggtgaggtgagagttggtgtggaggcaggtggtgtggggtgtgtagaccaggaggaagaaaatgcacctgtgaagatggagaggtgcacacgtgcatggagcagagaggttccatgtgtctggaggcagagaacaaaccagggaaggccttgtcagcatggtaaggaggtacgactacttattctcagcatgatgagagaccagtggaggtgaggtgaggagtgatggtgtgatcaggtgtgatttagatgatgtgctgcagtggagtcaggtagggagaccaggtaggaagctggagtagccagaatctgtttcatgtctatctaaaatgggtcctgaccctaaagttcagtttgaggaggggaaaggactaatggcctgagcttctctgttgatgaggcagcctggctgggcagtgggtaatagagtcagagggacttccagttaaagatggtgcattgacacacccctacctccactccctctccacagctcactagaacaatagtaaaggggtttgtttttaagggcatgaaaccgctgggcatggtggttcacacctgtagtcccaagtactagggaaggaggctgaggtgggaggattgtttgagcccaggtgtttgaggctgcagtgagctatgatggcaccactgtactccaacctgggtgacagaggagaccctgtctctaaaaaaatagaaataacagataaatgggaaaaagcatgggatttggacttagacctgtgccatccagtataatagctactagccacatgtggctgttgagtaagtgttatgtggccagtctgaattgagatgtgctccagaggtaaaatgcttactggattttgaagacttcatatagaaaaatataaaatagcttattaataatttttatattacatgttgaaattacagtattttggctatattaaactaaatacaacagaattaatttcacctgtttcttttgaaatttttacaaacatggctactagaaaatgtaaaatggcatatgtgactcatatttttgttggatggtactgagatagatttgggctagcaacttggttggtgagtgtccatggactgaaggtcggatgatgtgcctgatgatgtgcctgttttgtcttcagtatgaaaagtcatacctagcgcagaaaggtagctcttgctttttagagtttggccctgcctggataggcctgccagctgcagcgccaagatgctgccaggatctaaaatgagttaaatattttttaatttgaaaatttaggtaagggacaaagacttattttagttgtcaacatatatgtaacagttgatttaatgaagagttggttgccctgaatcctgcaaggctgtcaggtgtctattgtgggcacagatcaagaccaggagtttctaactgccattgatgctgtcagagttaatacagcctttttagtaagactgttagtactaattggcatattacattctagcctcagaataatcatttactaatcaaaagttgaaaagtctggaatatttagtgacttatgaaataggcactgctgaaatagtattttggggttttctttcccagctgcacattggacagcaaatagtgtaagcctgctggagtcagttttcctagtgggaaatactggtttctctgtgaggacagatggggaaatgcgcgtgtgcatgcacagacacactgtcacacaccccatcagggatgttagtcctgaggccttctgggtttataataaagcacgtagtgccttataggaggttattttattaaagtacattccttaactcatattgacataaagtgcttttgtttattacctggttctcacaagagccctgtgagggaagttgagctgataggattgccctattttacaggtgaggaaacagtcccaaagagttatagagtatgttgtcgaaggtagcaatgtaaacaagtggcaaagcctggttgtctgcctcagatagcattgtttctaccacattgcactgccactgagtttgtgttattgtatagacaggtctatagtcttgcagttctgaaatctaggaagctctaaagaaatctcgttgtttttttttctttaaatttgccgcaagctcatgttacagaaaaaccttacctgaactgactccaactgtgattcctcatagttttctctgcagaaatattaagtatctgattacggggactgccccagaccctcctggtggtgtcctcctagtggtgtcaactaatacaaaggatatgtaatttaggctttttttaatcccgagaattccaaaatcaaaatcctatcttgtcccaaggattttggataacagagtgaggtcctgaaacccagtgttgcctattttgtttgctaaaatggaggcctggtccttttaacccagtgcaagtgcactgccaaggctttgtgcttaccagcgaccttctgtgtctgcttctctctagtatgttggaagatttctctcacgaattggagagcactcagtcccggctggacaacgtgatgaagaaacttgcaaaagtatctcatatgaccagtggtatgtatggcgtttaaagcttaagcatttgtacttaattctagaactctgtcttgggggtgttgtctcatagttatgcccatccagatccctttcttattttttacagatccctttctcttttttttgagacagagtctcactctttcacccaggctggagtgcagtggtgccatctcagctaactgcaacctccactgcctcctgggttcaagcgattctcatgccttgacctcctgagtagctgggattacaggtgcgtgccaccacacccagctaatttttgtatttttagtagagacatggtttcaccatgttggctaggctagtctcgaactcctgacctcaggtgatccgcccgtgtcagcttcccaaaatgctgagattataggcgtgagccaccgtgcctagctgatccctttcttatggcacattttttttttttgtgatgccttagaatcagagaatggaagacttgtatgtgcagtctttatcttctccttgtagctttaacttgggaaaagttaaggctttgtgatcccccaccgtgtttggtttttttcccagtagagtcactttcgttgtgtttttttttttttttttttttttttttgagatggagcctcactctgttgcccaggctggagtgcagtggcgtaatctcggctcactgcaagctctacctcccaggttcacgccattctcctgcctcagcctcccaagtagctgggactacaggcgcccgccaccatgcccagctaattttttgtatttttagtagagatggagtttcaccgtgttagccaggatggtctcgatctcctgacctcgtgatctgcccgcctcggcctcccaaagtgctgggattacaggcgtgagccaccgcgcccagcccagtagaataactttctttgcagttacaaaatccttctttattttactggttttttaagatttccttgccaaaatagggaacttatgtaaaacaacagttaagccagttactgtttctcctgaacattctttcattgatagaaaaatacctactacttcagaataagatggcatgtgtggatctattttaaattgttatgtttaaatcaatactgaaatatttcagcaaatttgcaccaggatgaggatgaataaacaattttcataatagttactgtataagatatgttccagtgactctttacatgggaaataatatattttaaattttaaaaaatccagtatctcttctttatctggtgggggttgcttggtggaaggagaaactgagatgctccttgaggtaatctgaatgttccctgactgtagagcacctcccttgtgttagaacatgccctgtttcttgacaccttttcttctgttggtttcctactgtcaggtacatgttataaggtctaataggttagctttttgaagcaatatttaaatacatatgcaggtttacttttcagaagtttaactcataggttacataacagttctctggggctcagtttcttatctgtaaaaatatgttgagtcctacctctccaggtaattgtgaggattaaatgaaataccagtaaagtagaagtgcttaactgcgtttaccatttatttattggtacttagtaaatgtttttaagaaattgtaaggcaacaaaaattgtaatggccccaaggcgcaatggacctattacatccaaaacaaagagaagctcctatctagagtcattttcttctttctctttagggacaagtatctttgtttctagcgggctcttcattgcctgaaactgtgcatatatgggaagcaggcaccagcttagttcatctgtcacacatttagagaaaggtttgcaaagtcttttctgattccctctgttctctcttctgccttctcccctctacttaaaaacaaaacaataaacaaaaaaaaggtgttttaatgaagaattgtataaccagtttaaactccaggcctctcactcatgtatgtagtagttgcaaagtcaagtagctacttcagcaccagttctgtttggggaagagcaagtgaacaaagatgcactgtctttgtttcccagcattctgggtatgaataatttagaaaagtacttgcattgtgagaagcgacccagtgtgtataaatagcactgaagtttgcttatgctttattctactttttcccaaaagaaaaattggggaagcaatgtaataactttggttatatttgtataggaaaaagagccaggaaacagagcatttatcctgaacggtgcttcacttttgacaggttgcttgtgttttcattttaatctttgcttgctacccaaagaaatactccctaaggacctcttcctgcttggtgctttctgcttcaatttgacaaacaagcaatttgtattcgtctctgctctcctccataatttttgcagaagttcactgctttagtaatcaaacctgtacataaaggaagcctatggaggcacagcgaagtgtgattaagtagttacaggcacacaggcggaccatctccgctccccgtggctgtctgcttcatggggagaaaccaaccaagactccacatttacttttttgaatgacccaagagagacactaattgtattctcctacccacagaagtattttattttaagtagatactgagatttttttccctcttactttccaacattccattaatcttttctctttaggggagaaaaatattttgagagagagaaaaaactaccattggagttcttttgttcccctctgactttttgaggcaggtcctgagcttgcaatgctgcttaaaactttccacttgaggtcacaagagcccctgtggttagtacccgttccttctatgcatgaagcctctgcgggaagtgctgagaagtctgctggggtaacagctccctggggttacctagttcatgcttcgtagaggcagcttagccacttcagaggaaaacggctttaaaagaacatcctcgggttgtgctggcttgtgtggtatatgcttctccttggtgaaaattcctacttaatacagttgtggaagagaaggtgattggagggtggtaggaggcatgagtagaggctgatggaaagccaaaaaatggaaatctggttcagtgttggaaatctggtgctgagaatagcgagatgcctgagggaagggggtaaacataggagtgtgtgaggttgagggcggggttggagaaggaatactttctccgtttttgtcctgaaagaatcgcaactaatcattttagcaaagtggttttaaattattgtaagcattttaatctttttaaaaaattaataaactatttttagaacagttttaggttcctagcaaaattgagcaggaagtacagagagttcccatatagcccccttcccccatgcataacttccctgactattgacatcaagcatcacggtggtacgtttgttacaatcagcctacgctaacacatcattaatcatccgcaaagaccgttgtttaccttaggattcactcttggtattgtacattctctgggtttgaacaaatgtataaatgacatgtatccatcattgtagcatcacacagagctgtttcactgccctaaaaaatcctgtgttccacctgtttatccctcccttcccccaacccccaaactactgatcctttgactgtctccatagttttgcttttccagcttgcatatggttggaatcatatatcacagatccttttcagattggcttctctcacttagcagtgtgcatctaagtttccactgtgctttttcatggcttgatagcttatttctgttttaacactgaataatattctattgtctggatgtaccacaatttatccatttacctactgaaggacgccttggttgcttccaagttttggcaatgatgaataaagctgttataaacacccatgtgcaaattagccaggcgtggtggcgtgcgcctataaccccagctacttgggaggctgaggcaggagaatcgcttgaacccaggcggcagaggttgcagtgagccgagatcacaccactgcactctagcctgggtgacagagggagactctgtctcaaaaaaaaaaaaaaaaaaaaaaaaaaaaagtgcaggtttttatatggacataagtttttaagttcatttggataagtaacaatgtatgtggttgctgaatggttatggtaagagtatgtttgggttttgtaagaaactgccaacctgtctaccaaagtggctgtaccagtttgaattcccactaggagttaatattgctccacatccttgctagcatatggtgttgtcactgtttggggttttgaccattctaataggtgtgtattgtttcttgttttaatttgcctttccccagtgacatctaatgttgaacatcttttcgtatgcttccctggcagctctttcatggtgtttttttttttttttttgagacagagtctgactctgtcacctatgctagagtgcagaggtgcgatctcagctcactgcaacttttgccttccaggctcaagtggttcttgtgcttcagcctttcaagtagctgggattacaggcctgcgccaccacccccagctaatttttgtatttttagtagagacagggtttcaccatgttggccaggctggtcttgaactcctagcctcaagtgatctgcctgccatggcttctcaaagtgctgagattacaggtgtgagccaccttgcccagccccatctcttttttgatgaggtgtctgttcaggtcttttgcccatttttaaaatcaagctgttttcatactggtgagttttaaaaattctttgtataatacattctggacaacagtcctttatcagatgaatcttttgcaaatattctaccccaatctgtggcttgtcttctcattcttttgacagtgacttcacagagcataagtttttaattttaatgacatcccaatttcaattatttatttcatggatatatagtgtctttggtgttgcatctaaaaagtcattgccatacccaaggtcatctaggttttctcctgtgttttcttccaggagtttgataattttgcattttacatttaggtctgtggatacattttgagttaatttttgttaaggtgtaaagtctgcctccaacttcatttttttggcatggatgtccagttgtttcagcaccatttgttgaaaagactctctttgctccgttgtattgcacttgctcctttgtgaaagatcagttgactgtatttatgtcagcctatttctggactgtctgttccattgatctgcttgtctattttcctaatactacattatcttgattgatgttatggtaagtcttatagttgttccacatttctggaatattctgtgccaggttttttttcagtctttttttcttttttcaggtttctgttgacaaattgtgaagctcagagatcctttccttagctgtgtttagcctactaatgagcccattaggggcattcttcatttgtgtagtctttttgatctctatttttttcattctagaatttccatgtctctgcctacattatccatgtgttcttgcatgttgtttactttttccattaaagcctgtagcatattaatcatagttttaaaaattcctcttctgataattccaacattcctgctgtatctgactctggttctgatgcatatgcagtttcttcctactgttgctttttcctttagtgtgccttttacctttttgttgaaaagtggacatgatatactgggtaaaaggaactgtggtaaatagacctttaccatagatggggtggtgaggccggggggtggcattttctagtcctgtgattaggtcttagcctctggtgagcctgtgcccctggcccgtgaacttcactagtgcttcccagtttttctactgttaggtggaactggatggctagagaagactggagttgggtattttccttcccccaggttagtcagactctggttagtttcttttgagggcagactttgtttagaacagagtgctctggagtatttcgtagtgattctttttcccctccgcctgctggaagcatgaggggatttttcccaatattcgctgagaacctggtcaagctcctggaggtaaaacccacagaagtgtgggggtccccttcgcctgggtccacctggagtgtttttgtttgtttgtttttcatctcagacttgtccacactgagccttcagcgactcatcaattaaagctaaggttttcctaccagaacactggttcctatggagtttgttgcttcgtgggtttctgctctgataagctgtgattctctgtatgcatctgtaggtttctgcagttttaggggcagcagtttaccatgtgacctcacttctctgatggatctaagaagagttttgctttttcagtttgttcagctttttacttgttacgacagagtgatgacttctaagcttcttacatacttggctggaaattaaaaatttaacatttttaatcagatgagagaatgccagttataaaagttttcttgaccattgaagtaatagttaaacaggtcaaagtgtgacctgcagtaggccatctctgccttccctagacctttggaacagtcctacctgagaacaacgagtgatggacctggggtctttgtcctgctcagagttaactaaatgagtttctagtatgtctgaggtagaccaaggtgatcaccacttagaaggtacttgctttacttataatttggtggcagttctcttgtccagttctaagactttgatatccataatatttaaaataattttaagtacatgttttgccttgtggagagtttagcagtttattttcatagattgagatctttttgcaacgtgattctcaataactatagtgtgctaaaatcagtgggctttcaaagaaactttagtgaatcaatatgtctttatatttctatttaaatggaactcttattcctagtggttgtactgcattttcatacgctagtgaattctgttatcagtcgggccctttgtggaagatgccaaaactcatcagtggaaggactgctcattttttctacatgtctccaaattaaggaagcatcctgatgttgacagcatcctctgtgccctaggtttgggtattgcacagtgtgtgtatgacagggttgtgttgtttaattctcacaacagccctgcggggcagctgttgtagagttgggaccacaggattgtgagctgcagcagggctcccccagggcctgtctgggcccttctgtctcacagggcctccctgctctcagccatttggatggactctagtcaagttgtttcctgtgcctgctgttccaaattgttggtagggcagaaagtttcagaaaaaacattccactttcatttacagaggagctgtacaaggtactttaacacagttactagttaagtaatcttacttgactaggtgtggtgtgaaattaatcatgctgtctcactggagcttgctttttcagctgtatatttcctgaagtgaccagcagtagctttcatctcctttccctcctcccgttgtgctcattgagaaaagaatgtgattattgtttaattaaatgacttgacttttatgggagattaaagcaggcaggctttgatctgtaacaccattgccaacaccttttttgaggatatgctaactaccagcagaaagctaagatccgcagattttaattaaagacttgagacacaaagcatgtaattattacgagacattttcaggggactggcaaagttgtgactgcatgcgaagtgcaggccaagaacagagcagcattagagcatcaggcacctaggcaggtgtaagatcatggccccgtcatttgcacgttctgccccttttctgcttcaaagggtgccataaattccatataactgtatcttggggaatgtggagtccctgtgagagctaatccccatgtcctgccttccagatcggcgccaatggtgtgccatagccatcctctttgcagtcctgttggttgtgctcatcctcttcttagtgctgtgacggcggggcctctgggtgcgagttcctcctgcatatgaaccgaggggaggaggagaagctgagcacgtgtgacattgccgtctactcacattcctatcctggaaacatactgctgcactgacttttctccgtgtgaccccacaattgacatggctcctccatcccagcgctggaagggccagtgggaagaggaaatagatgtctgcactcctggctgcagctggacaacagaagccccatgccgcctgtccagttcggaggagaactagctgctgccttgccttccgggacctcgtttgctgaggagggacttacagactccactggtgttttgctgttgctcattccatgcatctttggcagctcttttcttctgctcagacccttccccgtgctcagacagtgcaccgctgtcccatctaaagaaacctgtcaggaatacgagcttctgggtatgtttcgtttcccattgctgtagcatttcttatcccctgagagctgatgattattgaggacagaaggctcagaaacagtttgtgacagaaaatgcagtgtttcatttttcagggataaatgctaagataaaattgcttttccaggtcatttttttttgtggtaagaataactaatggaaaataatgaaacaccctggggtttgggggtgctaacaacttgtggctttaactgacaggagcaattaaaaagagcaagagggttctgcattggcatagcttagggaagggttaatgatgtcgccacaggtcagctcctgatccttgccgacttgatgttgctgtaccagggcttcctccccagaggtgcagcttgcgttttgagggtgattgctacatatgttgttgctaaacagctcagtaacacacttgaatgaatttggataccagattgtcctcattacagttcttttactcttagggcactctacactgggggttggggttgggagtggttagtacatttattacatttattaagaaacgtaatgacataaaaggttagctctgggccagacttctcttactctgtgggtaatggcaaggatgtgtaggtaaacttggttcttttttttccctaagatgacagcttgattttatcatctgcagtcaaataactgagccaatccaaatttaaatgatagatgctttaattgagtttttaagtagctgaaactgctgagacactaaactttaaccttctgatgactttttaaaatgcctcaaatgtgcacatgtatataggatatttttataacttccctgatgaataatctgatattaaagtagtatttggacccagagccagaactcggtggtggaggctgctggtctctcctcaccaccttcttttgcacttggaaagaacagcaacatctggatagagttctagctttgacttctcatttccttgtctttttgggtgcattcctcagcacactttttttttaaacctttttgttttgttttgtttgtatttcatgtggttttatttgggggttttggttttttcacccttttttgtgatttgcaatgatgtgcttgcccagctaacttttgaattgcactttttaataaatattcttaacaatttttgaagaaggatattttatctcatttgagatcatggtaggttaagaaaatatgcctgttgatgaaagctaaaagcaaatttatgaaactaaaagggtgattgacatccatgtttacactccgctctaatgtttgatatataaataagttattttcaaattaggaaaaaacagtgagtattacaaagggcttcagatgtttagagtactaggttatttatgttttacaaagtttgaatcttctataaactaagaaaggggatgatccttagatttgcattaaaatatagaagtcttttaaagtaaatgtgaaccttgtctaagtactgtaatccacacaacacattataagaagcaaaccagcatcttaaggaattataaaattaccctatttaaaagccatgctattgttctgctattaccagatttattgtgccacacaaaaggatcatgtgtgtcagcaggggccgtttggaacaaacctagtcattaatgagtaagatactcctgttagttcagggaccaagttttatgacccagaggcttaatgatgtttggatatatttcaaatcggcgtgcttacctcactgatttaaattattttctaaatagtggccattgtagacctgactcaggctgaagctaaatagagaacaatttagaaagttaactaacaatacagtgcattctacccgtagggccaccatgcccttctgcccctggctgatttgatcctgtgtctgatcccattgcaccctgactgggcagtccctacagaaccagtgttaatttgaagggcctccactcaggctccaaatgtggcagccaaagagaacaatccagggaacctacatttatttttaaggacaaatatttcctcctcagtggtcctaatgttcagggctttagagggaacccaggtggtctcttcaccctgtgtcctagaatgggagagtaagtagacagtggtgataaccccacactgcttataagtgcatctttatagtatttggggctttcctacccctttagccttctgtacctagtaccatattccagttttaaagaactggcagaatgtgatggataacagaggaagagctcaatttatgtttattggaagaacattttacttaaatgatttgaggggtgggagggagtgaactactgagtttgccagagtgaaaatccatctgaaaaactcagctacctttagtttttagtcctcatttttggtcttgtctctgcggactgtgaagaatcacaatgctctatatgccctggactgtgtggcaaatgcaggttgcagcgtgtgtgttacatgaggatcttccacaatttcagaatgcacgccagagctgaagggggaaacttggtaacttgcccattattctctgcttttagccagagttaaacagactgatgggtctggtagccaacaacttggcaacttccactccttctcacctcgtgagattaagggctgtgaaaagaaatctagtctaactccaacagaaatctgtctctgttaagtgttttaccttctgtaagtagagatggtagagccaagatttttcttttggtaatttccctgtctataaagtgagaccaaagggatatctgttccctgttacctttttggagaattcataacatttgaagatcaaaaaattgaatgataaatatgaatggcttttcaattctgtggactttgtaccatttggcttcaccttgtactgcaagatgaatttgtaaacaaaacaaaattggactgtctggaaagctaaagttctgaaatatggaatgtactgcctctaatttttctttgtcttcctctcactggcatttttttctctcccaggtttcttaagaataatgttttttaaaggaggctttttgcccatcaagaataaaaagaaataaaaccaaagggttaccggacttaagcccccgcagtcactgtgcgccatccctgagcaaagtccgcccctgaggacagtgcccctgccccagtgacaggccttactcctcccagggcctttgcttctaatagggggtggtctttcttttctttctctcctttttttttttttgattaaaaaataaaaccaaaccagaatttgctgaaagcaggtacctttcagtagctccgatcagagtaactcagcttagagatactgttactcaggacaacagtatgtacaaaagtctccggaaaaggaaaataaaacaacctgaaaagaattcaacttgaaaaggactgaattactagaatgatcatatagcagaataacacaaaatgcaacaaagagccacccaagcctgagggtaagacctctacttcccagattcttggatcatagcccatgacttcttggggcacagaggctggcttcagcatgaggatctcaccactaactgcatgtaactcatccatgccttgggcagaggctaaacacacggaacaaggccaccagacaggtacacatgaacccatgagagcggtgctctctgtagagtctatagacctggcagggaccatggatagcttagaggtacttactctgcagctggtcacataagaccctagactggccaggcgcggtgtctcacacctgtaatcccagcactttgggaggccgaggcgggcagatcacgaggtcaggagatcgagaccatcctggctaacacggtgaaccccatctctactaaaaatacaaaaaattagctgggcgtggtggcgggtgcctgtagtcccagctactcgggaggctgaggcaggagaatggcgtgaacctgggaggcagagcttgcagtgagccaagatcgcgccactgcactccagcctgggcgacagagccagactccgtctcaaaaaaaaaaaaagaccctagactgacctaagccctacagttcccttatccaaattcccactaaccagtgagagagagggacaagacttggaagctgcctccaaaccaatttttggtctacagtaaacaaggataaacataaaacaccattccacaggccagcttcaaaagaactagtgtgcaaagaaggtgagagatcccaaagccccatttagtaacccccaccgaaggagggggatgggtgtgggtggtgagatggcctgttctgctgctgtgggcacccctgtgacctgtcctgctctgccatccggccttaatttgtacagttacccccgcttcctagatgtgcactctcatggcccagagctctcacctttctgagcctgagcctcccggcctccagcgtacacagagtggaaatgccagatcctaagggttctctgaggagggtgaggtggcagtttttctgagaacctggggtccttccatgccacaacagttgtaggtggggcaggccaaagaggatgctgagttactggaggcagagagcagtcggtcaaagagcagggaggagaatacagctgggaaaatgatgagaagtttccattgcatggactcagcaagcaatttctggggtcacctcagttatgaggcgtgaacagcaaagctttaaaactgatgtgagaacagtgtgtctccctttttccaaattccccagaggaacactactccctgctctggaacttcacatcaaagaaacaatacacctgatgggaagaagtcttttcaggaccccagaagtgcccattggaggcccatcagaaaagtctggctgcttctcgtttgtgggtccgcagattttgggcaagatggctagagggctggaggtttcccaaggcctctagatgcagttgtgcaaaatcaatcctccacaaatcactggcccttggtagtatgctcgttccaccacccactggaagtgaggaagatctttttgctgtcagagagggctgtccttcactaacaccataaatctgctccctggctgctggagtgcacaggccaagggggtcttgaagatcctcgtgtcaaacttgagtgtcaggcttgcagttggtttcaccgtagataacccttgttgccctacagcttgggtaactgttattgtgtcttgaccttttgctcttcctcttccttgtctgaactgcgttcccttcttagataaaggacaacttttatgtttattttcttcgtccactgtcatgtcacccacttgcacaggagtcccaccttatctgcggtttcactttctgaggtttcagaaatgggttgcactggaaagcactgtgcctatacaaagatttcagcaagggagttcctatgtatataagggaagaaacagtttatctagtcagtacaatctgtggtttcaagcatccactgtgggtcttggaatgtatccctgcaaaaaggcggtggggcagggggcacttctgtatacttcaaaacatgtgcacgatgaaaacatagtgttatctgtcaatctgaaaacaaaatcgccatgacttctgggcactgtagtcctacctgtggactggctgcctgactgtggagcgtccttgtattggacactgagggactaagatggcgacttctcatttggcagcctgtggcagctgagtttgaatttggtggtggccgtcgcatgttagggtagccatagagctgctcgctgtcagccggagcagcaagcacagtttcacttgacccattttacacctgttgtctccacccaagcaccatggctccagttaggaagggcaaccgttgggtggccaagaacaacttgttacggagccagaagctgacctcctttcttaaggatttcagctgtgaagtgcaaatactatggaagccaattcagtcaggcagaacctctcccagaagattgataagatgcatgaccaggccactcagcggcttcctgaggcacagtgtgacatgaactggtaatgcacagactgtgcattcgtagctgtttcgtgagtaatatgcagagtgtgtgtcttgggtattttaaagtacgtgagagggttgtttcagcagctgatgggatgccaaatgtttgactttttattattccagcccttcagatttccccagaattgtcaccttctagagcgtgtgtcttcccagtgtgttccaggaattctctataccactgtcgtgttgctcagaaaacaatagagctctcagtcagttcaggtaaccttagaatctgcgctgatgcctcagaaaggaagaaaggccaggacggcctcgggggtggcactcttatttctcccttggtttcacttccttttccattttttgtggcttcccacttcatcccgcagcctcctctcataggctgtcccccctttcccccactccattcttcccactctctagcccatttgtgtcctcagaggtctggctgctgccactgcacctgcctcagacccagtgtcacctcgccagggcttcagccagcctggccttccagctgccacccagcagcgcagcaactcagaaccttctggcccagaccttcacacccaactctcacccagggcaaatacagaagcctctgctggtgcagccaacacggagtggggaaaaaggggagaggaaaagcagcagcttcctgtgcttcccagctcagggcattggtaagagtggatggaatttggcattctgcttctaccattttgaatgaattggcctattcttttataccatcacccctcccttccaaatcattcattctggtgtgcagcccatttctgtctattttctaatgaaatgaccagagccaccatgtaagcttgtgccctgcacaaggatagataccccactggggaacaaacgggaccaaaatccactctgtgttctgctggccaagccgggtgacctggcctgggctggcgtcctcccagaagaagggttcatttttccagtttgcacacatgtgctatttgtgggttagctgaggccctgctcatgtcttcggttggttcacaaatcagaaacagaacaaatggccagagattagtgttgtaatcaaactagatttacaaccaaggcacgctgagtggcattatgggttttatcctgcggcatggcaagccgctcatgcacaggctgtgctcagtgtcctttttcctcagccatgccagccatggggaagcaggaggggagcttgttggagaaggcggcctcagtgagagccttggtgcattcccctgaagccacagttgggggcttctccttcagcaggggtccccatagtctgagtgttttcagaaatcttaggtccaagggacccccaatttttttttgtttgtttttttgtttttgaggttgagtctcactctgtcgcccaggctggagtgcaatggtgcgatctcggctcactgcaacctctgcctcccgggctcaagtgatacttgtgcttcagccttctccctagtagctgggactacaggtgcatgccaccaagcccggctaatttttgtatttttagtagagacgaggttttaccatgttggccaggctgttctcaaactcctgacctcaagtgatccacccacctcagcctcccaaagtgctaggattatgggtgtgagccaccgtgcccagctgatgggaccccaaatcttatgtccaggccccagggtctgaattcatatttaactactgaaaggcatcagcatctcctctctggttgaacttgaccttcttactgagaaccagccaggcaggcatcagaagcctcaggctacagaggagaagctggtgggcaaatagatcaggagcaagtgctttcaccatcatggatgaaagttgaaggccaagaacacttccttgtcctgtggtgcaggggttgggatggaggggtgagtcttataaatggaagagaactaagtattgtgatttcaaggaagaacatctgtcccctgcccccaaatacccccaaacccgccaaaattctacagattcatttggcttaactcctctcacagaggtaagctaaggtagtcagtctcgctgtggttgcagtgaatttgtttaatgatcttggtttcctaactgctagataatccactggagccaaaggagttttggtggattgagggaacctacagaggttgggtaggggtgtgttaggagttgaattgtttcccccaaaaaattcatgttgaagttgtaacccccagtacctcagaatgtggcattctttggaaatagggttgttgatttaatttgggaaggtgaggtcatcctgcagtagtaaggtgggcccctaatccagtatgactgatggcctcatgaaaagggaacagagccctacagtttacacagtgcttttatgcacgtttttcctatccatttctgtggggtaggcattatcatacctgttgattttactctagtttattgcttttttggcctaccatctgttagcctcactttttctaacaacaggaaccccttctgccaaacacacaacatattttggaaagttaccctaccccattccaacatgtgcttgtgttgagaggtaccagtcttaatcctcctgcccagccctagcctaaaaaagtgtgtgtgctggttaggctctccccatcagcccccagctaatctcttctctgcccttccatgccccaggaggctatacgcatcagattgcacttccagagcccccggcctctggttgggcttggccactgcgatgagcatcctcaaaaaagaccagagagctggaggagagagaggctggggcttcattccccaacccacctcactgcagtcccgccaggggccacggtcacagctctcacaaggagcatcctctgccagggtagcagctcttgccggactatgataacaatattctcttttacccttcagctctggtggaggtaatagcttccctctgtcacacgtctctggacacttcaccatcccgtactggtttcctcagttctgattattcccttacagatgctgtctgttgaattcatttaaaccatattgagttgtaccatttagttcttgccaggactgttagctatggcttgtcttagaggcttatcctgatggtcacggtgattaggcccagaggtgccacatgatccaacgcacgtcagagtcctcccgtgacttccttttccttttagtaaccagagctgggagagagacacccattcttacggagtggtgaagcgatggaggatatgagctttgtgctggcagccacatccctacctcttggataaaatcattcacatcttggttttgatctctcgggtccccacactgccctgattcccacctttaaaatagcatcccactttgtgcttgagccggtttacataggtttctgttacctgcaaccattaagagatagtttttcagctagtgaacaggagagtcgaagctcagactccaggcatctgcctccaaagcctgtacttttagcagatgctccatattcataactgtggccagacacctcccctgctgttggccacagctgagaaaatccctcctactcctgtgaggaaaggcacgtgtgtctgggtatttcccgtagcatgatacaggggtaattcattttgaataataagatcatacatgaaaagttctgtattaactgaaagttgaccaattgaatcatatctttaaggtataagaagagctctttgctggaaggaatcttgtcattagtcctttagtaaagcagagaccctctgtttgtcctgttaaatccagattttcactcctactggtggtgtgtgagccctttgttaactaaacaatttgtaagaattgctccacctcccaaagaatttcccagcttattgatggaatggaagaatttgcctcaatggatccccaaaaacaaggtgcccttggaggtactccactctgtcaagacaaggggaaccgccaaatcttgtcaagatgccgctcagaagtaaccagagggctcaaaagttcgcagggggctctagccatgagatcactacaggccaactaaagagatggcttcaggatagggtgaatgtaacctagattagaggatttatgaaacaattgttcaggcaatgcaggaacaaggcctcctctctttacctgttctttgttgggtgtctttcccatattccaggaatctctttagctaggcaatacattcttcttccagccagttcttttgatattgcaactcatgctgattggcctcccgtgccctcttgatggtgtgagccacattatctacagccagtcaggagagggtgtctttattgaagatcaggaaattctgcccatcatatgcatactgcagaaatcctgtagtgcttccatcctccagcagctcacagccaatcattctctggtaagtgtgagaccctggaacacacacgcaagcccagaggggtccacacagagacagaggtgggctctcaagtgctgggagcaggggcatggctggaagcatcctttggtctacgtcaccccacaggcctgctgtggcatcgctaagtccccaggaggtccctctttggaagcccacctgacagcagggttgttttttaaattttttttggttcatatagctttagggatacaagtagtttttgattgcatggatgaatcgtgtagtggtgaactctgggcttttggtgtatctgtcacccaaatcgtgtatgttgtactcagtaggtggtttttttcacctcacccaccttccacctttccccttcctgagtcgccagtgtccattataccactctgacaacaggtatttgtgaagtacctactgcatgccaaaggagtgtgataattcccttcttggggagttatcctgtaatgggaatgattgattgataaactgtggctatttgagtgcagtggaggagggagagagatgcaggagctagaaatatccctgggaaagttaatgtcattatgcataagcaagcaggtcactaggcctggctaccaagaagtgagacacagaatgggcaaatttagaatgggaaaggagatggggatatggggaagggggatgcggcagaggataaagggctcctgggggagagagggacagtccagaagatgcacaggcagatgggacgctctgaactacaccaaccagatttcccaggttttgccaaaagccacagcaggtgcaagtcagcattgctcattggaggtcagcccaggggcctctgtggggtgagggaagcgtctgtctctgctgcatgcacacctgagtgattgtagtgtctctgctggcgcttcagttccaccctgaacatctgctgccagcccttcagcagctgagtgtacctctcccagtgatcaggcacgaggttctctgccatccatggggcccgtggctccttctgctgagtgacactgtcatatgtggtgatagggtgcgagtccacatacccaactgaaataaattcagggaccccatggatgggatccgaaacgcccaggcgaaaatatctcagagagtgcgtccctggaaaggaggcaaagaaggaagacatgtagggtcccagatgatccaggtccttcaactgcattcatttagccccacacgagtgctccctgctcagctgtacccaggcctccaggccccagctgccatttcctcttacagaacccaggaaccggggcctggacaggactttagagctccagaccaacgacttggagcctttctcgttcaggtttgcaaatgcaggatggaattttataggtaatctcaactcataagcaaagtacagtgcaagcttgtccaacccacggcccaggacgtcttcgaatgcggccaacgcaaaatttgtaaacgttcttaaaacatgagggttttttttttgtgatttttttttaagctcatcagctattgttagtgtattttatgtgtggcccatgacagttcttccaatgtggcccaggaaagccagaagattggacacccctggtagagagtgctgctctggttgtagggggaagggagaagacacagggggagctgtccctacgggagcccttgggaactctgaggtcttgaaaaccctgataatccagccctcttgttttaccaaagaagtctgtgggtggataaatgaggaccccccactccacttctgtgtgcacgtgtgagcacgcacacataagcacatgcgcatatataccaggtcggtcagagcgagatccctgttaggattcaggcctaagtgggcaggtagcatctatagtgtggagatgttggacaaaggatgattcatgttctgagtgggaccatgtgagatttcttcatgctaccaagaacagtgagcaatttaaaacttatgaattgtgtatttctggaattttccatttaaatttttggaaccagtagctgaaaccgtggaaagtgacagcaaggataaggggctactactgtccataaattgtggaatggttagatctagcttcctaacaactgcataacctcacatcattcgcatagagatgatttttttttttttttttgagatggagtctctctctgtcacccagactggagtgcagtggtacgatctcaactcactgcaacctccacctcctgggttcaagcaattctcatgcctcaaccttccaagtagctggaactacaggcttgccccccaacacctggctaatttttgtatttttagtagagacggggtttcaccatgttggccaggctggtctggagctcctggcctcaagtgatccacccatctcagccccccagagtgctgggattacaggcgtgaaccacagtgaccatccaggatggtcttcctttaatgtccaactgcctgcacccaactcccagccttaaaaaaaaatatgcttatacttaaaatagtgaggtcttattcttgtggggctcacattggtctgctgtatgtaaacaggatgccattctcacctgtttatttggcaattaattaagggctcacggggaaactgtgctctc

SEQ ID NO: 1883 - DNA, 4338 bp, Homo sapiens
ggcggccggggccgggacgccatgtccatggaggaccccttctttgtggtgaaaggagaggtacagaaagcagtcaacactgcccagggattgtttcagagatggacagagctcctccaggacccctccacagcaacaagggaagaaatcgactggaccaccaacgagctgagaaataacctccggagcatagagtgggatctagaggaccttgatgaaaccatcaatatccttgaagcaaatcctagaaaatttaaccttgatgcaactgaattgagtataagaaaagccttcattacaagtactcggcaagttgtcagggacatgaaagatcagatgtcaacttcatctgtgcaggcattagctgaaagaaaaaatagacaggcactgctgggagacagtggcagccagaactggagcactggaacaacagataaatatgggcgtctggaccgagagctccagagagccaattctcatttcattgaggagcagcaggcacagcagcagttgatcgtggaacagcaggatgagcagttggagctggtctctggcagcatcggggtgctgaagaacatgtcccagcgcatcggaggggagctggaggaacaggcagttatgttggaagatttctctcacgaattggagagcactcagtcccggctggacaacgtgatgaagaaacttgcaaaagtatctcatatgaccagtgatcggcgccaatggtgtgccatagccatcctctttgcagtcctgttggttgtgctcatcctcttcttagtgctgtgacggcggggcctctgggtgcgagttcctcctgcatatgaaccgaggggaggaggagaagctgagcacgtgtgacattgccgtctactcacattcctatcctggaaacatactgctgcactgacttttctccgtgtgaccccacaattgacatggctcctccatcccagcgctggaagggccagtgggaagaggaaatagatgtctgcactcctggctgcagctggacaacagaagccccatgccgcctgtccagttcggaggagaactagctgctgccttgccttccgggacctcgtttgctgaggagggacttacagactccactggtgttttgctgttgctcattccatgcatctttggcagctcttttcttctgctcagacccttccccgtgctcagacagtgcaccgctgtcccatctaaagaaacctgtcaggaatacgagcttctgggtatgtttcgtttcccattgctgtagcatttcttatcccctgagagctgatgattattgaggacagaaggctcagaaacagtttgtgacagaaaatgcagtgtttcatttttcagggataaatgctaagataaaattgcttttccaggtcatttttttttgtggtaagaataactaatggaaaataatgaaacaccctggggtttgggggtgctaacaacttgtggctttaactgacaggagcaattaaaaagagcaagagggttctgcattggcatagcttagggaagggttaatgatgtcgccacaggtcagctcctgatccttgccgacttgatgttgctgtaccagggcttcctccccagaggtgcagcttgcgttttgagggtgattgctacatatgttgttgctaaacagctcagtaacacacttgaatgaatttggataccagattgtcctcattacagttcttttactcttagggcactctacactgggggttggggttgggagtggttagtacatttattacatttattaagaaacgtaatgacataaaaggttagctctgggccagacttctcttactctgtgggtaatggcaaggatgtgtaggtaaacttggttcttttttttccctaagatgacagcttgattttatcatctgcagtcaaataactgagccaatccaaatttaaatgatagatgctttaattgagtttttaagtagctgaaactgctgagacactaaactttaaccttctgatgactttttaaaatgcctcaaatgtgcacatgtatataggatatttttataacttccctgatgaataatctgatattaaagtagtatttggacccagagccagaactcggtggtggaggctgctggtctctcctcaccaccttcttttgcacttggaaagaacagcaacatctggatagagttctagctttgacttctcatttccttgtctttttgggtgcattcctcagcacactttttttttaaacctttttgttttgttttgtttgtatttcatgtggttttatttgggggttttggttttttcacccttttttgtgatttgcaatgatgtgcttgcccagctaacttttgaattgcactttttaataaatattcttaacaatttttgaagaaggatattttatctcatttgagatcatggtaggttaagaaaatatgcctgttgatgaaagctaaaagcaaatttatgaaactaaaagggtgattgacatccatgtttacactccgctctaatgtttgatatataaataagttattttcaaattaggaaaaaacagtgagtattacaaagggcttcagatgtttagagtactaggttatttatgttttacaaagtttgaatcttctataaactaagaaaggggatgatccttagatttgcattaaaatatagaagtcttttaaagtaaatgtgaaccttgtctaagtactgtaatccacacaacacattataagaagcaaaccagcatcttaaggaattataaaattaccctatttaaaagccatgctattgttctgctattaccagatttattgtgccacacaaaaggatcatgtgtgtcagcaggggccgtttggaacaaacctagtcattaatgagtaagatactcctgttagttcagggaccaagttttatgacccagaggcttaatgatgtttggatatatttcaaatcggcgtgcttacctcactgatttaaattattttctaaatagtggccattgtagacctgactcaggctgaagctaaatagagaacaatttagaaagttaactaacaatacagtgcattctacccgtagggccaccatgcccttctgcccctggctgatttgatcctgtgtctgatcccattgcaccctgactgggcagtccctacagaaccagtgttaatttgaagggcctccactcaggctccaaatgtggcagccaaagagaacaatccagggaacctacatttatttttaaggacaaatatttcctcctcagtggtcctaatgttcagggctttagagggaacccaggtggtctcttcaccctgtgtcctagaatgggagagtaagtagacagtggtgataaccccacactgcttataagtgcatctttatagtatttggggctttcctacccctttagccttctgtacctagtaccatattccagttttaaagaactggcagaatgtgatggataacagaggaagagctcaatttatgtttattggaagaacattttacttaaatgatttgaggggtgggagggagtgaactactgagtttgccagagtgaaaatccatctgaaaaactcagctacctttagtttttagtcctcatttttggtcttgtctctgcggactgtgaagaatcacaatgctctatatgccctggactgtgtggcaaatgcaggttgcagcgtgtgtgttacatgaggatcttccacaatttcagaatgcacgccagagctgaagggggaaacttggtaacttgcccattattctctgcttttagccagagttaaacagactgatgggtctggtagccaacaacttggcaacttccactccttctcacctcgtgagattaagggctgtgaaaagaaatctagtctaactccaacagaaatctgtctctgttaagtgttttaccttctgtaagtagagatggtagagccaagatttttcttttggtaatttccctgtctataaagtgagaccaaagggatatctgttccctgttacctttttggagaattcataacatttgaagatcaaaaaattgaatgataaatatgaatggcttttcaattctgtggactttgtaccatttggcttcaccttgtactgcaagatgaatttgtaaacaaaacaaaattggactgtctggaaagctaaagttctgaaatatggaatgtactgcctctaatttttctttgtcttcctctcactggcatttttttctctcccaggtttcttaagaataatgttttttaaaggaggctttttgcccatcaagaataaaaagaaataaaaccaaagggttaccggacttaa

SEQ ID NO: 1884 - protein, 255 aa, Homo sapiens [sequence omitted]

SEQ ID NO: 1885 - DNA, 30412 bp, Mus musculus
  misc_feature (1)...(30412): n = A,T,C or G
gtgagttccaggacaaccagggctacacaaagaaaccctgtccaaacaaaacaaaacaaacaaagtctcaggtctttcctgaacctctgaggtaggcaatttagtgagatgtgccttaaaataaaaggtcaagagagccaggcatggtggcgcatacttttgctacctgcacaggagatgcagctctgtgagtctgaggctaattgtcaactgtattttactgtgtagacatggtatactgtatccagtcatcagatgactggtttttcttgaaggacttgcacattcccgacagaaatggaggtgacatggtggcagatgactgttagccctgctgcgtctatgcctattttgttgttgttttctttttctaagaaagtaaaccaaaatgataggtgaatggtggtcagacttcagcatcacactgcattgcctattcttcatccctgatgtgtgacaaagtttttcctagggaggtgtaacacacaagtccactcactccagatggggatcccacagcagaacacagtgtggacagcaccaaggtccaacgtggtgaaccagcgagttttactgtggattacttacagggatatgggtgaggggttccttacagaagcagaaaggattcatcatagacatctgcatcaccaaagcccactccagtatggctgacagcttaccaaagctgggaccttggaacgcactgcatccctgcagacagctcagcaggttgaagaataagctcagcccaagtgactctgttctacacctttcccaggcagctgatcttatctgagatcttctcagacagggactctcagcttttattgcttactatagcagggagtggtctaaggaatctggtcagttttagggacttcctgaagctattttgaattgtttacctttctgcttatggagcttccctgtacggcaggatagagtgttttaatctaagaggaaacttacacaacactaccacagaggagatgactctaaatcacccaccttccttcagtaaaactttttcaaataaattgttttattctgtggaagaatttccagtagatgaaatggtgtggcatggcttgagaattctcatgccagcctgtctagctgctgccaaaaccaagagtatgtttcatttggaaagggcccttattcttattttaaggtaaatcttttgcagacttgaagtttttttgttttttgttttgtttttgtttttgtttttgtttttgttttttgtttaactgtggaaaccatcaatcctttggatgggcaacgtgagccaggatagcagcagtcttctggagaccttggcttagagctgttccagtttgatttccatgctgcttccgttgggataactcttgtttcctgtacatctggggccaacacagcaaagagggagaaattcactcagggatacgggagagtgagaccctcagagacaggaccagagttatccttccctgggatgctagacccttgtccagcagcccaggcgatgaaccataggcttcagaattcatggtagagaaaggaaagacagtgctcagagtttctcagattgcagtggctgaaggtggaatgaaaatgaagttctggcttccctggctggttcagatggtcctttttcaatttttatctgaacgacagccccacctcctaaagcaatgtctcttccttcagatgcctattgaccagcagtccccattccctattcccacttctctgcaggaagatccgggtctgagccttgccctcccttgggatgtaagatagatgtttgcctgtcacataaaatgaaaagtggggactaagcatccattcagccctcctcctctgctctgcttttgtgcatacttaggggccacatacagactgaggggggagaggagcagaagtgacccagcaggagctgccctcctaaggcattcacatttaaatctaaaaccaaccaaccaaaccttgcagaggaacagactggtccctgacctgcttggtcaccctcagggtgttacaggcgttcctgatacatggctgataccccttgctatcggcattacatactgacattacatttaataccatggcccttgcatgcttttctgcgagcaggattacaagatgcaggaggctttggggttttactctttcacgccacactgagaagtttggcatcttagggaacctcttcactgtaccctataaatggacactgaagtcatttccagtttagaaaaaaaaaacattttcctaaataaggcagtattgttcagccttggacatgtgccagggagcatacgtgtaggatagtttgacaaagtccattttgatagtcgagctgtcctcccaaaaaaagatggatctactgaattctacccacagtgttcctctgtttaactttggaccccgcctccactgatgcgtctcattagtcgttcccatcagtagctcccgccctcagcgccccctccccagggggtgggccaagtgaactactcaccgaaaattctttactctgtttgttgaagaactgaaggaacataaatatgttttgcctacatcaagttaatggcctgtggtagagaatgtccgtgcctaagcagccttccatgttgtttggctggggaaacagtggggcagtgtgctagacacctggcgtgggtggggagaaagggggtgggctctcaagggctgtgctggcccccgaggaggtctctggcctcccctttacctccctcttaatgtacacatcactgtgtgttgtacttggctgtttcttccgtgctaaggaggacctgggactgggggatgggactgggctcttctgttcaggagcctgctcatcctacttggacttctggctgcatctggaacttcctttgagtacagggctaagccagcataggtttcaatgacttcttcctccctttttgattctctggtatctttttggtacagttataattttagaaaattctgttatcatgagacctctggatgctatctaattcccttgcacctctccttgttccctcatagattgctctctatatggtagatgctctctattttggtaacagctatattaaataatctctccttttacatcactgtttccctaacactgtgttgagagctagttatattaatgacaacagtaattggggtaatatagtgttcctgtgggccaggtgcattagtgtcacacaggaacttgattggaccttacagagttttggtatctccatctctgacaacttcttgaatattctagtgattttcaatttagatctccgttctctgacttagccatgaattttggggaaaacaacagcagagattattattagcaaaaatattcatcacacttataaattaggatgctatgaaatcctagtagggttgttttctcctttagcctctcatcaatactattggcttcttaagctttcaatgcctcaactgaagctctcattggatatagacagggtctggcacaaaataatcaacaattactcattttttcgttgttataaaatattaggtggacagaagagacacaaataaatgacatggtcccttgacctcaaggaggagttcaggtatgtaacaggcgaaccaaggcagatctccaagtctctccacaagagaatgtggtaagtgaggctgttgaaggttgcccaggggactcagtagaaggagggagatacttctggaggtaaaccagcaagagatacagtaacgaaaccaacttttgatgaataagtaggattcttctttaaaggtagacaggtgggaaaggatacatttgattagggcagaggacctgtgagaaggcttggagaacagaaaccacctggtgcctttgatgagtaatggttggttacattatggagataatgaacaactaggagggtaagagagaagattctagaggaagccaaggccagacctagaagcatacaaagcattttggatgccagtccaaacaggttggatttaacatcagtgaaaaagaaaagagatgccatcaggttttcatttaagaaaaatcactttggcaggtgtgtcagtgaggagacagggtgtggccatggagccctgtgagccaattaggaagaaaggtcccaggtagaaggtaagggggtatgagctaaggaaaaaggtagtagcaatggaaaggtgtcagggacatttaagagggacttgggaggtaaaatgcaaaggaaacggaaacttgctggaatctgttcccatgctgcctagacctggggattactttgtaatgtccagtttctgttgcttgtgtatggaaggctggaacagatggtgccggtcaaaacaggttgcagaaggaggcagggactgaagtcaaatttaacctagactttggtgagcatgaaatgtttgttacctttgtaaagacgaacagaggtcatgattaacgttacagatgtgagggtagaccattcctcagccttcagaatgagatccaacatgggagtcttaagggtaaggaccaagtgagaaaaggcggatacacagaagactcaccaagatggctccacagttaataaccatcaaaatactgcttcgcttggccttcactttcactgatggaatgtggcaagtattcagaggagaacccatcgacttagaccaaagtcaaaggtgcggcctgccatttcataccctttgcaacaggtggcgctggggcctgaccgggagaaggcggcagcacgcgggtgggctgggggaggtgggctgatgcaccgagctggagacctctagccagagccgggcactcagtggcttggaccaatagttcctgggaactgggctaaggagagaacaaacctttggtcccaggaagggcacgtgcaccctcctcctccccgccatcgcgggggtgggggaggtcctgtatgtaggacaggtcttatctgaattaggtagaaggagggctagtcccattctcacccttgtagcccgcccacgagtgacactggtacatctcggtgggattgtgaaccttgctagtcctggcaccacggcggttaatggggcgtgggtgctcctaccagggcgcgtagaacacaaagcccagacctctgtgcacctctccggttaagggctggtgcgagtaagtgcccagggcagggaaggtctagctgaagggtagagtgaggcctggacagccaggcaggcagagggttcaggctgctggcgattaagagccctcgagacagaagggctcgtgtgcatggggcccttgcagaaccaggggaaggacagctgaggaagatgtaaaccgagggctaggaggcaacccaaatcacctgccccaggggctgctcatccaagctggagagaaaatcctgctgtggcagagagcaaataaagagggcccagcggggcggcggggttggggtagagagaaaaagtgtggaaggctgcggtctagtcttccttcttgggcagctgggaagagaaagccagcttgtttggaagtcgctgttccttagagggcctgtggtgagcagcaaatgagataatgtgtgtgagaagggtaaagagctgtgaacatgtaagatgctattagttaattagaatccttcaagcccattgatgtttgagtggctaagatggcctctatctgtggagcagaggggttcggtagtcgcggctgtggaattacgggagtagagggtgggtacagatcatctaggggtatactgcagcgtgaggggacagctgctgtctgtccttttggttcatcttatttgtttattcggcttcgttattattccccctccactactcattttttggagctctttgctgtaaagaaaaacaaaatttcttttttacttcaaaaagagtccaaaaagggaggaagctatcacttaggaatctattagatacagtcgttggagggtggaagtcctggagggagagggaaagggagagggagaaagagtgagttggtggggatgtggggagttagttgctgtgagtttattgatacatctgcagttttgcctcaggtagggaacagcctgtgtagtactgaccctgactgaggatcgtgactgggcaagactgggtggtagatttgttccctgggcagatgcatcgctttggccaagccagcatctctgtgtgccttcatttccactgaatggtaaaaaaaaaaaaaaaaaaacaaaaaaacccccaaaacctgaaaggcgattcattgagctaaagaccgggacttttgcatccctgctgccagctcatcgggtctctagtgatggggatcttgtcatgagcccactcaaccctccctggcaggcttgaaaaattctttatgctgaatggatttctgtttctgtgccgtttgtgctccttggagccatatggaataaaatgtctaacaccgcttccacaaatatttgaagactgtgaacacatttcctccttccactcacaccacaaggctccttttctttagactaaacatgcccagttatttcaaacagcgaggtagtgtgggaccgtgcaaagaactccaggagcaagagggttcagctgctggcttctgccgccttagcacagggcaccctgagctgctgctgtttcttgaggatgaatggaaagtctcacctagccagtttctgtgaaaatggggcgtgctcggtgtgtgtgtgtgtgtgtgtgtgtgtgtgtgtgtgtgtatgtgtgtgtgtgtgatatgcccatagtaggaacttaagctatgccagttgctttgccagttgagtcacatgatttacagaaggttttagttttaccctaaatacattcctgcatgtctaaatgtttcttaatatcgactctgtagagcagagtactctcagtgctgcctgaggagcaaaaaagcacaggattaggttattccaagtatatttgtgtaactgcagacacacagtagtttaaaaataaaaaaccaaacccatcttccataggctcaatgaaacccccccccttttttttttaaatcaagtaaagctctaaatctctttaacaaagtgttattaggtcgaacgggtttgccacattctgccctttagtggtttattcaaatctgttactctggctttagaaagttgctctaccttgggtttgtccaacctgttacagtgctcaaaatgggttagaaaacagaaaggacgattgaacctacggtagaagccgggctggtggtctcttactgcttgctgctgtgatacggtaaatggagaagtttctacactgctggtttttgcacacatctgaggtgctgttctgatgtgaaccatggtacagaaggatgtgaaggcaacgtcccgattcgcggctggccgaggcaactctgctgtggctcacaaccgcgaacgataggaaatgtctgctagaagtcagggtaccggcagcaagcgtgagcaagatctgacttcatttatcaactttcatgttttctcaggtgctccaaggggttttagaacgtaggtcacattctcctcgctgcggaggaagctccttctagaaataagttagtcctggttacaagattccctaacactttagacttttaaaagcctttctcccagccttagctggtccccagcagtgcgcgccttcctgcggctcagcctttgtgtccgagctgctacccgctttctctccctaaccagttctgcgttccacgccatttcaaccgcatcccgccctttaccacccaagttattcctagtcacctcgagcaagaaggatttccctgggcctggactggaattgcttttgtggttgagagctttcaccgactttcctcccctccagggcttaaccgtgccctcccctccccccccccctcttgttccttgtgggtagactgttccccggccttcagaatgagatccattgtggggcactcaatccattaattagaaaattgccttcatcttagatgctggtgcttcggcctggtgagaatgaaagtggaattgtttgtaaggctcaaaggttccattgacagcgaatatgaaaatagataatgcagaggctttccatgcgggaacttgttaagatcagaatggctttactctgtagaaaacaccagtgcaaattttgctaagtaattcagtctttaaaaggtttggttgttagttaatataggtaggtaatcctctacttgtaaaggggtgaatttaaattgcggtcttacaggatttaaacatccgtagcttctcatttaggacacattccacattccttctgatgaactactctttctggtctgccctccaccccacctctccgcccccagcccccagtcggcgctggcgcccaaaggaaacacttttttttttttttttaaagaaaaaaaccaaaggttacggtgcagagccccgggtgcttggcgaaagccgtcccctcgggctggaatgttctttgtctctggtaaatgtctattcatcactcaagacaaccccttcctccctccccttaattacttcctcccctgtgcgccctcaaattcttgaacttattcatgcggtatttgttaggggcctgctttgttgcccaccccatggcgggatctgggatacaaaaggttaatgagacatggtttcagactttgagggtcttaggctgagaaagaagggcccgacatgacagaaaatattctgaaatcaaaaagaaaatgtaaaaaagtgccacccttcgatccctcattcacttcacaatcttgtgcatcgcctgcggaggctccacacaagcatttgtttcctgcggtccccgaagaagtataccctggaccgcattacgtgttctgatgaccctctctcaggtgctggcattttcagtgtcagctgggtggtcacgaactccccgaacatgggaagatacccacaggttagatcccccaagggttcgactgacccattgcagttctctggcccaatcttgatcgactgcacggttgggcttggacattgcaaagccaaagctgcagcaaaccaggctccgaagagaggcctgcagcgcccccgctgggccagcctgcgttcgcagcatccctagcttgcccgtgcctaggctgctagaatttcagggaacggttccaaacctcacacaggcatcacgatgctccgcactttgcgaaggtgtgaaagatgacttttaagggatttgggattaaaaaaaaatctacagttttgtccgcacctctagggtgtttgcactgtgattgtgttgcacgtaaaggaggcttgtgcccccaatgaacggtccccaacgctgctccagaagggcgctgcagcagcttctggcatgtggaccacgttgtgctgcggcaaaggaagtgtaccggtgccaccgtggtggtgactttggcccattctatgtgatcgcagcctgtccatgaatgtgtccacttagccactgataccagagaatttgtccattccctagccatttagtgtgcccttccttctttgttatcatgggctaagggcttggggttgccgcgcattggtgacccgaatttttagatgcgtactcactcttagggctcaaaacacacgtaggaggtagaaaagaagtgggtgccgcaacaagaaccccagctttggggtgttttatgtcttccagggtctagggaccagtgcgtggtccaagggatatgttggggagggactctctcagacgtttgtcatccttgcccgcggcattaacacatgggaaggctttcttcactagaatctggggttcaggattagagatctataaggaaagagggggtagcgggtcaatacccctggaggcgcccacgggaaaggccccccctctctgcagcggtggggaggggctctgcggcgggagcgagaaggaggggcgctgcggcaggatgggcgggttagaggcggggctcagtgggctttaaaagtcggtgcctgcttgctcctctctgcttcggccaccagcacatcccggtgcttcttctcaggcgcagcagctttcctctgcggcagccgcacctcgccaaacggcgtagtgctgcaggctcgcccgagttgctgcttgctgcctctgctgccgctgccgcgggccgccctgcgcggaccgtaggctgcgcagacgccacctccgatcctgtatcgctgcgggcgcctcggcgcgccctgtgatccgcaatcctgcggcgggcggcatgggataatgcggccatggtgcgccgagatcgcttgcgcaggtgggtgctgccagcccgtgccgccagagggggtgtggccggcccgcaccccggagatgcgggaggcaaaaatccttatccaaaggttgccgcccagcccaaactctcggaatcgccctcactgatgatttttagaaccagggtttagtcgcgtgagatttacgaatttgaggatttttgcattaacatgtgagaattagcctttttttgtctgggtcttcgttgtggtacgatttaggaggtggtggtgaagcaacttaggattcgagaaccttggtaatgcctggtgtgttctaggatcttcagagctggtcattgttgtggcgtgatttaagatttctagaccacggcatgtgatttaggaattcaggagctgagattgtcacagagcgacttaaaatttccaggttctggactcacaatggcagggttaccgcataggtgcgactagatcgtgccgcgcagtgtggccacggctataagtgttgtttgggagccagaaatggaaaccccgggggacaccggcacgcggccaggctcttaaaatgtaaaaagaattgtttgctttggtttgtgggtgcacagcgtagttctcaataagaatgagtcaggtgggctggtttggtggtattagataaatatgtttttacatcatttaaagcagtaagaaatcaaggcacgtaaagtttgttgtgcgagtgtgttgaatttttgctctaaatcatggtaccatcaaatattagagagtggacttaaaaattattgtttaaaccttttggtccgattgctagtttccttgactgctaaaaatcttaaaatgtttggggtatttttaccaaggtaactaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatggggggtggggtcaaacctcacagtgcccaggtttcccacccatgtttcattctgatttttggaagtgtacaatgttaccttggctgctttttccacaggatgagagagtggtgggtccaagtagggctcctggctgtgcccttgctggctgcgtacctgcacatcccgccccctcagctctcccctgctctgcactcatggaagacttctggcaagtttttcacctacaaaggcctacgcatcttctaccaaggtgagaactgggctattggagaatcccaaggacgtgggtcgtgtaggtttcagctgaagttacttattttgtgtcccttggtctgttgctccacagtgaaggtgaggtgaaggtgggggtagaattgtgcctggtagtaattgcagccccatttgtatttgagaaattacttttctcttttgagcgcccctagtgtcaggtaagctatatagtatttcgagatctatctatacctttgtttcccccacgccccaccccattcccaaattcatgcactattttccgtgatttgttatatgtagctgataagattgacttgatgactgctatttaattaccacactcaggatattcagttatattttaaccttcattatttcatttttcacttaatttttacaacagcatttggagataggtgccattaacctcattttatagctgaagaaaccgagaaacagattggaaaagatttcttttgggcgggggtcaagagcaataacgaaaaatgtttgtttttcgtaaaccgtttttcattattgctcctgaccccctctcatgggttatagccagtcgagtaagtatgcatttttttttttatgttggcttgttgttctttcccagacttgatattcagtgttacatcttatttgcataggttctttaggttaaatccagtatatgatattttaattgcttttaattaaataatttctgaaaacatgctaccaaagttttattccactagcagtattaatttcaatccagtactgttggcaaggtattttattgtttgaataatctgaaatatgtcacatacagaaaaagttcccatcactattagcccatctttgtaacagtttgattttttgagttgcatgaattctgctagtatatggacaaatggtataagctcaggtgatccactgggaagaactgtcacatcttagatattaggtgtgataaatattgattagggacaaagaagttttagcttgctgtgattatagtattttaactgtttttcctttttatttaaaaatttgagttttatattaatgtcagcgaaaatatgaggatgtctacacaactcttaagtgatgatgaacaaactgttttaagggttttcatgtaaagcatgccattacgatttaaaagcgcagattaggaggaagctcctgaagtcctgtcagcttgctttctaacacagcatggtgatgtcattcatttagtctgatccttttgactggattagattttggtgtcgtcaaggctgccttgcatgcagtttgcctcatttctcattttcctcctagattctgtcggtgtggtcggaagccctgagatagttgtgcttttacatggctttccaacatccagctatgactggtacaaggtaataatgtttctaggtctggcttatgtcctaaaaaaaatactcaaaactcaagatattttttttgttgttgttgttgttctggtcagccctagaattcttttgcagatttgaactgtttgataaaatctcattaaatgtagaattgctttttatgtactgtaaggggagtaaaatactgactgcagaaagggacactgccaaattaaagctggagttacgctctccgtacagtggcatgcaggcctgtttgctgtggggctgggcagtgggagcagagtgctcaccatgcttgctttcttaacagatctgggaagggctgaccctgaggttccatcgagtgatcgcccttgatttcttaggctttggcttcagtgacaagccggtaagcagcagctgggtgtggtccgtgatgggggtaggtgggtgggtacaaatgagggtctggcaggcactgctaacatcatgttgtatctctggctttcctttcctcagagaccacatcagtactccatatttgagcaggccagcatcgtagagtcccttctgcggcacctggggctccagaaccgcagaatcaacctgctgtctcacgattatggagatatcgttgctcaggaactgctgtacaggtcagtgaaaccggacttctgtcctctgcacaggtgtcgtagctttagataatgggaaactcaagtattctgggaccatcacacctctaggggtcgtctgcagcccttgtggggagtcagttactgagctacatgtgtctttttttcttgccctgctccaggtacaagcagaatcgatctggccggctcaccataaagagtctctgtctgtcgaatggaggtaattgccttggtggtaggtggaaaagtagggtgtagtttcaaaaagtcacccttttaagtcacacaagaaaaaaaatttaaaaataatctgatattataaacagacaccatatatcgggcatcttttaccttcattgtgccatgagtagttttcatggttgatggtatttatggaatacatattttcaaatctatagcaaataaaaggatagccatgatggcaggagcctcaatgggtgaaggggcttgttgcccagtctgtggatatgactttgattctggaacccacgttgtgggagaagattgatccctctgggctgtcctcagacttccgcatgtgtcttggcacgaatatatacataagcacaatgaacacacatttttgttgttgttgtttgtttctaaagagccaggtgcagtggtgcacacctttaatcccaacacttgggggacagaggcaggtggatctctgagttcaaggccagcctgatttacataatgagttccaggacagccagggcctggaaccctgtcctgaaaacaaaaacaaaaacaaaaacaaaaaataaaggagctatcacaaatgtgattctattgatctggctggtaagctacattaataaactcttaattggtggtagtgccaggtgccagctgggaatgagtcttaccatttggaagttttgggattttgtgtgtgtgtgtgtgtgtgtgtgtgtgtgtgtgtgtgtgtgtatcttttctatcatggagatgctcattaatccagaaatgcccaaatgccccaacctgaatgcctccagggcagcctgggacaagggtagtgggtccgtccctttatcagtggaaacaaagagtgatttttcttttacaagagcctacctacagaaacatacacgtgtttgcagatgagcttgttactaccactgtgctctgagcactggggtgagctgaagggagtgtaagcataggcagccgtgcgtgcggtatggaggagcatataaattactctccatttttgtaccttaaagcgagaaaagcaagcccagcgtgtggcaatttgtctattaaacagagcaccttgtagtaattagcagtatagtcatgcctcagttggtacatgcgcatgcagttctgtgttgcgtatgagttgttgtgcagtgcctcgctgtttgtactcataattctgttttagcagcagagacttcacgtgtaccagcgaataggtacagtcgctggtagtagctgggaaaggactcacaagcctctctttccacaggtatctttcctgagacgcatcgtcctctccttctccaaaaggttggcagcttcactgcataactccttggtcaagacatctgtgacattaaaaaaactaaaaaccaaacaaacaaacaaaacaaaaaacctgacaccttttaaggaccatacctgtggtgatgagccagtctattgaaatctaatttattatgaattcacattaatcaagtaattgttttcctcagtcaaataaagcaggctctactacatgaaatcaaacatttctgagaaataagagatgaacaaatatttagcaaaatacaactctatgaagatctgtatcttaagtatgatatttaactaagctgagatcctaagtagatgccttcatcagttataagggattgtacacttttttcagaagatatggctaagttctattttagtttctgatgtaaaagcttgtcttggagttgtgagctccgtctggatccttgatttttacttccatttcttattccctgcagctcctcaaagacggaggtgtgctttcccccatcctcaccaggctcatgaatttcttcgtgttctctcgagggtaagtcatcgtcagagactgactatgcaccaacagcagtgtaatcaaacagtcctggaccacagctagcctgggcttggagatcttgtagccgtctgccactctgaactctgtccacatagcctcaccttcctttctactcttttcagtctcactccagtctttggaccgtatactcgacccactgagagtgagctgtgggacatgtgggctgtgattcgcaacaatgacggcaacctggtcatcgacaggtaagccctcaaggagggcagatgtaagattatttgtgtgccccttgctggcttactcaggcacaggaaggctgcttagggattccgagaccaaccttaagcagtcctggtctgtttgccaggaacgaaatcaagcataggatgaaccttgctcctaaagcatttggcataaatagaatttggataaatagctgcaactcttaatgcttatttacatgaaaatgactcattggctggcttatccttctttgcttttgcttaacatcatatgtcacagaatgttttaatcatggttttgaaaggaatgaatgtctttctaatacaaagctcctcctctcgcctgtttgttcagtagcaacagagaaacttaggtttaaagaaacgtgtctaagtcacagagctggctagtagtgggatcaaaactggattcttagactcgtgctttaaattaagcaacattaattactccttctgaagactgcattccctgtgttatcaccacatgcttatgctggtgggcagtgtgctcacgtgctgacatgggtggatgggtggggcaagctctcctgtctgaggctgcttctgggtggcgggtggcgacacttctctgggccagctctgccctgctgactcgcctgtgttatagtcttttacagtacattaatcaaaggaagaaattcagaagacgctgggtgggagcgcttgcttctgtgtccatccccagtgagtatttgtgcatagttttttgttacttctagacaggaacatttggggaatagtgacttaacataattacaactcataaaatctccatgtggggttgccagatttagtaaataaaaacatgcactcaagtaaatctgagtctcccaataaaaaccagctacgtttggcctcttcgttccatttagaagactgacttgctctataaagctcacctaacaataagtgaggatttgtatcataaaatttttagtcacttttttttaaaaaatttaatgaatgaaggttaattttagggtagcagcaggagcacagatgtgagttgttagaaattccttcctcttctttttcctagttcattttatctatgggccattggatcctataaatccgtatccagagtttttggagctgtacaggtgagtcctcggagtagttcaccctgacacttcttggcactagcatctgacctcactggaaacaaaataaacagaccatccagggaccggtaatcttaactcttcccaagaggacagatcaagagatttgtattactttctctggattcatacattctcttctcactgtcatggctgccatcattccatgtgtccatctgagccagttcactcatctcagctgagcagttatcaacagaaacaccccttcactggctgttaacctttaggaacttacttagaaggtgcttgtctgtcatacaagaatctttctgaccttcctatgccctagtggatacaacctggcaaaagccagcttgcgtataattttaaacaatctcctcgtgagattaaggaaggttctttgtttatctttgcttgggcagtgagttgctgggtgagccacttgttgatgcttctctaaggagctgaaagtcatgttgtgaggcctgcgatagaagtgttgtgtttgccagatgttgtctgttgggttctgaacaactgaaaccactgtaagtggagttggcaagtttatctgcctaaggtacagtttcccagtaggagatgagtaatgctgttgattccttccagtgtggtgtgtctgtagggcatctgcggggcttcccatgccttacatcctctcatctccagcctcaagttcacctccatgctgttctcttccactaggaaaacgctgccgcggtccacagtgtcgattctggatgaccacattagccactacccacagctagaggatcccatgggcttcttgaatgcatatatgggcttcatcaactccttctgagctggaaagagtagcctccctgtattacctcccccattctcgtatctgtgtgtattccacttagaaatgcccaaaagaggtcctggccatcaaatactatcctttcatcaaagtccatttccttcacattggtgaacaaactacaggaatcaggcagctggaactctatagggtgacacaatagtccacctcatctctaagggtgacatgataatcctctcatttctgtgacatctgaccaaataaatagagctgctgttgttttgtgttattaggacattctgactaataacacttttcatttatgtagaaaaacagcattagatattcttttttggtgttaaatacctcaaaaaacccccaaaacataataacaacaaaaacccagtttctgtggactttattaaaatatttagaagtgctcccttccggcccaatcctaactggaatacagagtgagggaggagcttgctatctccctttcaggatctgttacagtttatgagagggatcatcttgtcactcctttacatttagtttcatcggctgcttctaacagacatttttgttaaaacagacattggcttagggggctggggaagtagctcagtggtagtgtgcctgcctagcatgttaaagcccttgggttcagttcccagcactctccccaccccagcccatcgaacctaaatagacattggcgtaaatacagtgttctgagtatgagtctaagactgatttgcatactcatgtatatatttacaaacagttggcccttgctaagaagaaaacctcattatatatagaatttgtgaataaacaggttgaaattatttgcagaatttcctaaaactgccaggcattaagaactgcatctgtgccagagatttactgttactgtttagaaagtccaagctgaatagtaaataacagcctaggggcagctcctccagggctgacgtggaggggaagggacatgtaagtgcggaatgaatgtccattggctcctctatgatggccgctcagcatcccgctggctgttcagaaaggctttctcatataactcctgtacttaaacaggcaagtttccagagacattaagaacaaattctgaaagacctaagagcaaatggtgctgaatacttttttaagccacagttttaacttagttaaagcagcattattgattattttaaattcgttttttaaattagaaatttcaagtatagcaactttgaaactggaatgaatgagtgtttattttctattaataaaaacaaactgtgacaaaaatggattccggcttcccctccccctccacccttctgggataaaattttccagcattgccaagagtttttcacacattaaatagaagcatataatgaagctaagcagctgtagaatagcataagtagtatctgattttcaagcccactcaaagctgcattgtcgcaccgaggctgagtgagtgagacatgagatgagggaagaaactctaaagctcatgctcaaagacagacagacagacagatgtttgatctgctggcgcagggccaaacacttggatttgcttcttcaaagtcatcattattaatctttatgtgtgattcttggaagatcatgccactagcctaaaaaccaccaatagggagggcatagcaacatcacccttcccagcaagaacttatcccacagaagccaagataacatccacaggcgttctctctttgcttctcacagtcacctgcatggtcactccatcagctagggccagcctggaccgcaccaataagtcatagccacctctgtatacacctgagagaaaaagcgaggaaaagtatattaagaacttcaaataatctctgattaatagaatttatcatgttttgcccatacctcctttctattattttagttcagcctttatacaaattcacaggaaattaatcctacaaacaatcctacttttttaatgttgatatgaaataccaggtacatggaggtagtcagtgacactgcctggtgcactcaggtagtggttagtgagagtagcaacagcatctgttatacattcaagtattttagccagatggtgcccctaaaggataacctaaggagagctgtaaaatcaactcctcattctaactagctttcctatagttacataatggatgacagaagcagcagggcaaggagggcctctccccacccgggcctgatggaagtctcttacctgctagatagagggagtgggagttcttattctcggggactttatctgacctctcacatggctgcataccaagaaatgtgatgatgttgttgacagcttctgtggagaaatttaatgcaacaagaattagaaaagttaaacatgtgggtctgcctctgccccaccatgtcctaagagctgcaggtgcacagggctgtagactagagggaggctcctagcctagaaaatggctgatttggtcagatgatgaagacaggcccctgtttttgagcagagaggagttctttgagaactgcatgcatgcctcctgggttttatactggctccaggcaacccattgcagcaaagttcttaccttcaagggtttttgtagagctcagggcaaaggtttcttctttttcaaaggcatctcccacctcttcccaggcagcagcgaagttaggttttagtatcttctgaatatgatcagacacagttacttcaagatcttccagctagtgggcaacaagcaggggtcagtaaataaaagtcctttgagtctacaacaaagatagaagaaactgatcacttattattatgtctccaaaccatacaaagggcctgagggaagcccttcctcactaatgtggtctgggtgagcccaatgctagctataggtcctagtagagaggagcaagaacaacctggaaagagctaagtgtaggctgagtgctgattgccccgaggtgcacagtagtcatgttgtcacactcagagttgagggcatatagcaccttctgaacttgacaccccacccctcctttctgtcaaagcttttcagtccaggacttgccaatattaaaaccaaccaaatgaaagtttgcagaagcaaaaccaaaacctatattataagtaaattcaatcacattaaaagtgatgtaattatctcttagttattcccattaaagggcgcggggaaacagtgagtttctttgctataattacaaagtgctccatttaaatcctggcatgacagttcctttacagagaaggctagtctaggtcccgtgagttttgtcagctgtttatagaaaaatgcgcttgtggcaagaaatcatttaatgttgcaaagatctcggcagggaagactcaccacatattcatcatcatatccatcttcatctggaactccagtattagggtcacaatcccggactgtgaacttcatggtacagctaaaggtgcctgcaactggagggagaagcagggaaaccacatgagtggacagagcatgcacactcccatcattgctgaggacgcaccacccatgctcagcactgtgctccacatcctcacgtctaacatagacgtgcatgccctgtttgaaggtagtagttcttgaagcagcttgcaagctgatcaaaaagtcagtttcacaaagcaagatttgaaaatatttctgtactgtggactagaacagtgcacagaagaggatactgtttttgtgttgacgtggaaaaagtagggggagagattttggtgggactttttgtcatgtaggtcaaaaagtctattttgaaaaatttagaaccactcattgctctaatatacaacaaagcaaacactactaacagcaaagcagacagctcattagagtaacactgaccaagtgcatggtctcaatgctgtctttagattgtggactgagtggatccacacaacaccagaataaactactctacatcaaccttcaatgtgcagtaaagaggtcaaagtgaggttttattattgataatgtctgtttcacaatggaaaaacacacagccactgtatgtgtcagatgattgacaaatgagtaataaaaaattgacacaattttggaaagtaaaattttgatgaagacagggttttccaaacagtttgaaggagagaatttggccagcagggatggaggaaaggtgtctctgggctggtcagcgatctggacagggcacacatgtacacagtactagaaattgaaacaccaggaagctattgtgggggctaagcaagagaagaaggagactcaaatgtaaacagatgacagtgtgagcaccaagaggcacctgttcagtctgtaaacgttcattccatccctccataatgcatccatacctccataatgcatccatccatccctctttccttccctttctcccttatataattgatatatatgagtaatctattgatgacactacaattcaatgccataaatccttcaatataaattttaatagagtgctatgtaaagttgcaggattaggagtctgggggtaaattagaaacaaaatgaatggcagacagctagaccacagattggggcaaactggttgaattttatgcaaaagacaagaaagaggccatttcagtgtggatgtgacagataggaaaggatagaagagggatgtgtaaaaagaacctttgtggcaattttcattaactgatctggttgacacaacgaggacttgtaaggaatctgccaagggctacagtacaaatcatggtagtaatgcatcagtgtggctagagaaaagggaaaccctgggagaaccgagaggaagtcagaggggccgtcagggcaagagcagaactttactatcataaagactacagcttcatgaaacaggaaaggcaaaacccgaagggaacaaagaaaacaaaacctgcagacccctgttaaagaggcttaaaaagtgaggtacattttatgaggacttgctaaggagatgagtatggaaagaatacagagttgggaagataagtgctgaagctgcacaggaagaaggatgtgtagccgggctgggatatagtgtctagtgagcacaagccagagtgggaagttggaggagttaaccatggcaaaagaatacagacctgaagaatcctagatagctgtagaaaaaggtgtgccaagagagggttgaaggaaacagtcatccacataggtctagactgagctgaaaatagattcaatacaggacacaggaaattaaggagcatgaaaagtatgttaagcagtgatggggtgggggtgggggtggggggagagtggttgtttacctagcagcactgaattcatgggaatgctgcacccagaacagaagatcaataacctcatatataaaagagccggcactaaggaatgacaggtattagatgaaggctaacactgtattcttgggccccaattcaggagggaatgaaaatgaaaagatagactggaagcaaagggaaggaaacacatgcagaaggccaccaagcagagacagtgtagaagagagggctcagatggtaagccctggcagagcccagcgtacatctaattggctacatttgggcatagagaccatggtgaacaaacagtacgaggaggaaggactgaacaggaagagttggagggaaatgataggatctggttgttaagggagggaaagtttataaggatgaagatgccagattgctgataaagtgacagctgacagctttatggaggtattaggattgcttagtggacagtatggacaggtagcttgtcctgagactaggttactgttacaacatggggagtgagtgaagattatgaggaagtaaagacatctgaagaagaattgtgcatccatgatgactagagtggggtggaaatggacctcgtggcaggtagtgaagatagtgcagactattgcatggtgtgggattgacattactgacatgctctgtggagcctggctgacagtgagtgacatgatccctacgcagccttgtatgacagtattacagacaagacaggttggaatctgaagaaggaaaaagtaggtaacattggggtggaaggacagtgagtacagagggtgtatagggagggcattatagaaaccagacgagaaatgctagggagaaaagtgacagagttgactttgcagtagagaattgtgtgttatgctagattgcaaccaaagatggagagaagaatgtggctaaaacactgtaatgaagggtgtcatctggtaatctttccttgactggcatgtgaaacaaccaatatgaccaagacttaagggtcatgtagtatataaataggtgagatctgaaccatggccaattgcaaggaccctctgaaaatcccagactgaaaagtgggggaaagagatgcaagagaagacagcttaacccataatgacataaagatagccactgggggtaaaagcaattatggggttaacacaagtgtcagtgtctagggtcacacaggaacaaggactgaagagcacccaggaaagatgggagcatctgaatgctggcaaatactgacaggaaggctatggaggagaaacctgggagcctctctgggatccctgtgtgaaggagcctgaactggcagataggtaatggtgtgcccaggatggaatctgtaggactgaaagagtgggtttcaggctgcatggtggatcttaaagcaaatgtaaaaaatggcatttgcagtgggggaaaaataaagcactgagttaggtgaggctttggtgggagttttaattcaaggaatcaagaaaagctggactaggatggacctggataaaatgacaccaaatctgagtagtttgtccatagaatgaataaataatactgggagaaaggttgaaaattatgatgggaacccaactcagaagtaaaacttcactttcattttcaaggagaaatgggggtgagcatgcatataatnnnnnnnnnnnnnnnnnnnncctatcagaacatcagaggggagcagcagtgacctgctcacaaacattaacaacaaccctagctcagaagatggttctgataggctacttgggggccatgcacccccgggtgagaatcactggtggaaggggtagggggatggagaaggctacagagaaggaagggtgagcagatggaggaggcatcagagtcatgactgtcagacttgggaggaaaggtcctgttggtgcagggggatgacagtgagcagcaactggatgcagtgaagaagggaggtgggaggaagggtgagagctgtgagagggtttcctgtcaggggcagggagggcactgccaactgtgcttcctgctgaggactgaggtggggcagtgaggctgatagagatggcagatgcatagatgtgatggggctgtgtgactggttgtccatgggaggcaggagaactcagggaaggaaatgagtactaaaagagaaggaaaagtgagggactagtttccaggaagagaactgtgagcccaccagcagaccaaagtgaagtgggtacctttgtgtaagaatgtggtattctgtgtggaaacagcaatgggggcataggacaaaaacatgcatggacaggaacacagtaaagaatagaagactcatttctcctgtgcatgtttttagaagaatataaaaagaagaatgtaaaaggtggtgtgatatgtcacctcgtcgaggtaggatgctgggagggtcccattgtttaggccatgaggaggcaaactctgagtgcctaggcatgggagtacaggctaccgaggtagggtgctgggaggatcccatagtttaggccatgaggaggcaaactctgagtgcctaggcatgggagtacaggctaccgaggtaggatgctgggaggagcccatagtttaggccatgaggaggcaaactctgagtgcctaggcatgggagtacaggctaccgaggtaggatgctgggaggatcccatagtttaggccatgaggaggcaaactctgagtgcctaggcatgggagtacaggctaccgaggtaggatgctgggaggagcccatagtttaggccatgaggaggcaaactctgagtgcctaggcatgggagtacaggctaccgaggtaggatgctgggaggatcccatagtttaggccatgaggaggcaaactctgagtgcctaggcatgggagtacaggctaacgaggtaggatgctgggaggatcccatagtttaggccatgaggaggcaaactctgagtgcctaggcatgggagtacagtggtacagtatggctccagcttagtgaatccaatgacacactgggcatcaagggtagttcaggagggaaggacttaggaaaaggtctgctagaggattcatagacagtagctcaaagcatagtggtaagattgttctttattacacactagagagaaaagcagaagaaatgattactcggggcccagaagaggttagaggttttcaacgcaagggagattgtgatacataagttactccatttgcaagactaagaaagactaaaatgaaggagcccagaaggaaggaaagaaaaagcacagtgagaagaatgaggagagcattgcatctagggagacatggcaaagaacagcgggggtggggatggactcagcagtgcttgctagggataacagggacaggagtgagcataggtcaacaactgagcagatagcaagataacaacttctgagtccatggattgactaggaggtggcagaagtaaggctggacagtgattgggaagtggagggtctctggaaaacatcagggagaagtgtaggggaatgccatgcaaatttaaattcatgtttagggcagaaagagaggctgaggttgggctgctaggggggaagtagcagggaggagtcagtgtgcatcagagaggctgataggaaagaggggtcacatcacgtcaggagaaaagtccgtcatcttgtctggtggtttgggcaaaaggaaatgggccactctaccaaaggggaaatctgcatgtaatctctccaaatggggacactggaagctctcacggggcaagctggtaggatgggaatatcagtgtcaagccttaggaggagagaagagagataagctccaagtgtttccagaatggagcctcaggaaaaagtaaagcaaaggagtcaatgtgacttgggttaattagaagaaaccaaatgacacgtactttatgacagttcctgaacaaatggctctggaaggcaacctcagggacatgggaatggactcaagtagaaagactggagcaagtgggtaggtacagggtgcatgtgaatggtggaggcacagctgggcaccaatgcgagacagccatttcgcagtgagcactaaatcctgtgtttctgctgttcaagacggctgaagggtgtgctgtggaacagagagactgcaggtggttagtggagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctgtagactgaggaactcagtgactataatggaaagagaaacaccctcgactgccatctaaatcattgaaatatggaagcaaaggcagcctaagtgccatttgaagtcagaaccacaggaatatccatacgagtgacagccattggttgagaagagaagggagaggatggaaagaggctgagagtgggttcagattagaacattatggagaacagggaaggacgggggatgaagtggcaggcactaggaagctgagaggagtacaaggctcagtgcaatgggagaatgaactctagaatacaggtggcaatggaggaacaggtaagaaaggacgtctgcaaataaaatatgatcacaagacaataatgcagtcacaatatggcagtcactatggaagacaaatgacaaaaaggcatacagggaacatagacaacaagggtagggtagaagggagacaggttaagcaacagtaggctcggatgaaataagagagaggtgtcagagtgggaaagaaggcacttggaagactcagccagccttcaaggctgggcatgttgaaggagaagaggaaaatgtgttcttacagtattgtatgtgcttgcatattgcaatttttggccaggctctctgttacacactggttagggaagggtggctggtggataaaggtgggtggatagggttagctttattttcagatttgcacaattggataggaagtgggggattgagaatagtgggactgaacatggagaaatcaaagggggaggttgaagagatacaacccaggattcaagtactgagtttagcccatagaaaattccaccctgagtacagaggtgggtaaatacaggttggtgattcatctgagtttactaaaagacagagagtacctgcagtagggaagggggagaaggacaacaatgacagcccactgatctgcagcaattagacagacatgataatagtgtctttctacccagacttctgtgatggaaagaagagggaagaataagaattggggaggggataatacagaaacctaagaacaagattaaagtcaaaactattgccagaatgcttgaaattcatatttggtgagagttatgaggaatggggaggaataagtttgtttagaaagttctctcatataaaccaggctcagtgtacattgtgtgtgaaggagtttaacagagagggaaaggaggtgttttcaactacttagtgttgagtctgtatgacagagaggaaacactgaggtgcttgagtgaggagatctaatggtcaccaccagaaagctggggacatggaataggggaacaaaggccagggaggacagggggnnnnnnnnnnnnnnnnnnnnnnnnnnnnnnnnnnnnnnnnnnnnnnnnnnnnnnnnnnnnnnnnnnnnnnnnnnnn

SEQ ID NO: 1886 - DNA, 2543 bp, Mus musculus
ccagcacatcccggtgcttcttctcaggcgcagcagctttcctctgcggcagccgcacctcgccaaacggcgtagtgctgcaggctcgcccgagttgctgcttgctgcctctgctgccgctgccgcgggccgccctgcgcggaccgtaggctgcgcagacgccacctccgatcctgtatcgctgcgggcgcctcggcgcgccctgtgatccgcaatcctgcggcgggcggcatgggataatgcggccatggtgcgccgagatcgcttgcgcaggatgagagagtggtgggtccaagtagggctcctggctgtgcccttgctggctgcgtacctgcacatcccgccccctcagctctcccctgctctgcactcatggaagacttctggcaagtttttcacctacaaaggcctacgcatcttctaccaagattctgtcggtgtggtcggaagccctgagatagttgtgcttttacatggctttccaacatccagctatgactggtacaagatctgggaagggctgaccctgaggttccatcgagtgatcgcccttgatttcttaggctttggcttcagtgacaagccgagaccacatcagtactccatatttgagcaggccagcatcgtagagtcccttctgcggcacctggggctccagaaccgcagaatcaacctgctgtctcacgattatggagatatcgttgctcaggaactgctgtacaggtacaagcagaatcgatctggccggctcaccataaagagtctctgtctgtcgaatggaggtatctttcctgagacgcatcgtcctctccttctccaaaagctcctcaaagacggaggtgtgctttcccccatcctcaccaggctcatgaatttcttcgtgttctctcgaggtctcactccagtctttggaccgtatactcgacccactgagagtgagctgtgggacatgtgggctgtgattcgcaacaatgacggcaacctggtcatcgacagtcttttacagtacattaatcaaaggaagaaattcagaagacgctgggtgggagcgcttgcttctgtgtccatccccattcattttatctatgggccattggatcctataaatccgtatccagagtttttggagctgtacaggaaaacgctgccgcggtccacagtgtcgattctggatgaccacattagccactacccacagctagaggatcccatgggcttcttgaatgcatatatgggcttcatcaactccttctgagctggaaagagtagcctccctgtattacctcccccattctcgtatctgtgtgtattccacttagaaatgcccaaaagaggtcctggccatcaaatactatcctttcatcaaagtccatttccttcacattggtgaacaaactacaggaatcaggcagctggaactctatagggtgacacaatagtccacctcatctctaagggtgacatgataatcctctcatttctgtgacatctgaccaaataaatagagctgctgttgttttgtgttattaggacattctgactaataacacttttcatttatgtagaaaaacagcattagatattcttttttggtgttaaatacctcaaaaaacccccaaaacataataacaacaaaaacccagtttctgtggactttattaaaatatttagaagtgctcccttccggcccaatcctaactggaatacagagtgagggaggagcttgctatctccctttcaggatctgttacagtttatgagagggatcatcttgtcactcctttacatttagtttcatcggctgcttctaacagacatttttgttaaaacagacattggcttagggggctggggaagtagctcagtggtagtgtgcctgcctagcatgttaaagcccttgggttcagttcccagcactctccccaccccagcccatcgaacctaaatagacattggcgtaaatacagtgttctgagtatgagtctaagactgatttgcatactcatgtatatatttacaaacagttggcccttgctaagaagaaaacctcattatatatagaatttgtgaataaacaggttgaaattatttgcagaatttcctaaaactgccaggcattaagaactgcatctgtgccagagatttactgttactgtttagaaagtccaagctgaatagtaaataacagcctaggggcagctcctccagggctgacgtggaggggaagggacatgtaagtgcggaatgaatgtccattggctcctctatgatggccgctcagcatcccgctggctgttcagaaaggctttctcatataactcctgtacttaaacaggcaagtttccagagacattaagaacaaattctgaaagacctaagagcaaatggtgctgaatacttttttaagccacagttttaacttagttaaagcagcattattgattattttaaattcgttttttaaattagaaatttcaagtatagcaactttgaaactggaatgaatgagtgtttattttctattaataaaaacaaactgtgac

SEQ ID NO: 1887 - protein, 348 aa, Mus musculus
SAILRRAAWDNAAMVRRDRLRRMREWWVQVGLLAVPLLAAYLHIPPPQLSPALHSWKTSGKFFTYKGLRIFYQDSVGVVGSPEIVVLLHGFPTSSYDWYKIWEGLTLRFHRVIALDFLGFGFSDKPRPHQYSIFEQASIVESLLRHLGLQNRRINLLSHDYGDIVAQELLYRYKQNRSGRLTIKSLCLSNGGIFPETHRPLLLQKLLKDGGVLSPILTRLMNFFVFSRGLTPVFGPYTRPTESELWDMWAVIRNNDGNLVIDSLLQYINQRKKFRRRWVGALASVSIPIHFIYGPLDPINPYPEFLELYRKTLPRSTVSILDDHISHYPQLEDPMGFLNAYMGFINSF

SEQ ID NO: 1888 - DNA, 34203 bp, Homo sapiens
  misc_feature (1)...(34203): n = A,T,C or G
cacaggctgcaatgtttcatggtggagaaagaagggatgagggagcctgtgcattcctttaactgcagtggccaagaagggattcagaaagaggctttaaacctgagtttcacaatttatccttgctgtcactggctagttcgaactctccttgctccttatctagactatagcaatcacttcccactcagtgcctcttcttccagaatccttattttcctctattccttcttctcatggatgtgaaatgatggaagttcctagtctaccctcccttaaattatgaagtaatgtttgcttacagtgttgaaacagaaaggaaagactaaagcatcccttcagctgcccccaccaccatgatttctttcctcatttgcctctgagggccagaaggaactgagggaagcagagagtgtaagataacagggaatacattgaggaataaataggaactgtatgggagcctctcctaaaggcattcccatttaagtgaaaaaacaaccaccaccaataaacaaatcttcctgcagattaaatttgttcctgtgctgccaatttgccccacctagatctttccagcatttctaatacgtatacatctataccaatattataaatgtaactataaatgtttagatacatggtacatatatgttagacaaccaggattacaatatacatactattttgaactttgctttttcatgtaacattgggaagctttacatgttagacaacctcataactagcaccctgtcgatggacatttaggttgtttccagtttgaattttttttttcaaataatacagcattgtttgttcttagacatgtgtcagggagtatacataaagtataaatgtgaaacagtggaatagctgggtcaagtttgatagctattgccaaaatgccttcccaaaaagttgtatctatttaattctagcaacagtgttcctctgtttaattttgaacttttttttctctgtatatgttttattagttattcacatcagaatagctgccctcttttcaccggcccagagtgaactacccacagaaagtttctctactctgtttattgaagaaccagaggaacataaatatgttttgcctacataaagttaatggcctgtagtaaagaatgtagacttttaagcagccttccatgtcatttggcttaggaaacactgagttagtgtgctagacacctggcatgggtttggaggaaaaaggtgggcttttttgggcagtgcccgccaagttgggccacagctccaccgcctaccccttccctcttgctcaatgtacacatcaccaagtctgtgctccactgtttctcctctactagagagggacaggagcctgggggatgggaatgtgtcttcccctcctggagtctgaacatcctcgttggacttctagatgaggccagaacttcctttgagtactgggccacatcttcataagcttcagagacctcttccccctgttccccattctcatatcatcttggtgaaagccttgcccttctgcccagtggcccccttcccccaaccaccagaggcaaaggagtgcttgaaactgtggaaactttaaacattgtggattctaagaagtaaagcctttagtagtaaaagatttaccaacaaataaagtgtttctgaaaaaggttgcgttgctctagttctagcaacgtgctcactctgcagctgtgggatctctgggtgccatcttgttttcctgccactctccctattccctggcagaccctgtccccttggaatgcccacagaattttgatcatagctaaattacatcatttatcacattacttgttgtcagcttatgcgtttatctctaccactggattgcaagctacttgaagttcttaataagaacagcggcagcaataatacagtgcttcttgtgtgccaggcaccccaccaagtgctttacacatattaactcatttagacctcacacgtccctcacaatatcttggtatcttcatctctcacaactcattaaacattctatggttgtctttcaatttagatctctcttcttcaaaaggagtttttaagaaaaatctattactggcttgtaatatatcaatctctaagcaaaaatactcgtaacattcatataataagaacagattacatgggataaaagtaggatcattttctcatttagcctgacatcaagagtatttatttggctttctataccattagtttaaattagaacactctatttccatccactagagtagaatagctatgtgttttccctttaaaagataaattaactctgtaagcattaatactttaaaaaatgactagtggtttttcaaatattttagttctaccaaactgatgaatagataaacatgagcagatagatctggatttaaatcttgattccacaatttaccagctctgtgaccatgggcaagctccttaatctttcaaagcctgttttctcattagtaaaattaggataataatagttctttatagggtaatcatcagaagttaaaaatgtacatatgagaaattcagcacagagtctggcacaaagcgattaacaaatatttgctgttattcattcttatcatcattattataaaatgttgggttgagctgggcatgacggtgcatgcctgtaataccagctatttgagaggctgaagcaggaggatttcttgagctcaggagtttgaggctgcagcaagctatgatcgcaccactgcactccagcctgggagacagggtgagatctcttgtctataaaaagaaaattaaaatgttgggttggcaaaagggacatagaaatgagtaagatgctgtccttgtcctcaagaagctcagctctgtggtaggagagacaagacaggtctgcaaacatcatcacaaaacaatgtgataaggcaacagagggacagagaaagcacagaggagggagggatcatttccataggaaagtttcatgggaggcttgcaagaggatgtgaaaattacattgatttttaaagaacgaggaggaattttttaggtagcccaagtgggacaggacatagctggtcctggagaacatgtgtaaaggcacggagaaaggaaactgcatggtgttttgggaggaactataattagtaatgtttggtcagatcatgaggttttggtgggggtgggtaagatggaggtggtaagatagaagattctagaggaagtcaaggcaaggaccagattttgaagtgttttgcatgcggagctgaagagcttgaatttagcaccagcaatagggtgtcagtaaagagttttataagagagatgtgatcagatttgcattttagaaaaatcactttggcaggtttgtgaatgatggaccagaaatgtgtgatggtggagacttggaagccaattaggaggcagtagtccaggtgagaaataatgccccgaacaagggcaaatggcattaggaatggaggggagcaagctgaactcaagagacccttgggaggtaagatgaaaaggatggggaggagggaacttgttgggatctgtatccaagggtacccgaccccttggtctcattccactgttccacaggggttggtgacagtgtgtgggagacaggggtggacagaagtgcgttaaccaagatacagactagagaaggaagcgtcagttcttaggacaggggtcagtttgtagtgtgggaaagaggaggtgagaaagggtagtgaatttcacctggcccttgttgagtatgtgatgcctgtgttcgccatgtgaacagcagaaagcagcaaatataaggatcgagagcacggggtagagagagggctggcgatggacaccatctttagggtaattgcgaaattaggggaagggctgaaatacggaaggctcgccgaagatctctaggtagttaataactatcaaaatgtcacttctttggccttcacttttattatgtaaaagtactcagatcaggccgaatacaattttattctctttatccaatgccggaggctattgtcgaagccacggcctgccatttcataccctttgcaataggtggcgctgacgcctggcagggagaaggcggcagcacatgctgggctcgggggcgatgggcttgtgcgcggacctggcgacgctctagccccgagccgcgtattcgtggccgggtcctccctgggaacagggtgaaggccgagaacctctggcctcaggaagcgcatgcgcaaccggttctccgaaacatggagtcctgtaggcaaggtcttacctgaatcaggtaagaggcgggcggggaaggagtggagcctccccgtgcaccctcgcagcccgctccaggagtgggactagccctccttgggggtgtggctcgtgtgcgtgggccacaccagtcctaggggcaggtaagtgcgcgtggcccaggaggcgtgaggctgtgctggcgaggggagggctcccggggcgcgtgggtgcccatacgaggtgcgccgccgccggtccagaagagggccacgtgggcgagagcctcggtcgtcgcctcccagcacctcggggtcgtagagaacacaaaagtcacacaaccctcgccgaggcttgacccccgcgacagagtttagtcattccgttagctggctccacccgccctcctgggcgtggggactcgatttcttgggaggctgcgccttcctacttgtgggacagccaggcttggaggttggaaaggtcgcaggcacacgggtgtgaccgagtggtagagggcgtggctgttccgggtcggagctgcaggtgtcggtccaggtccaggcgctggggtcaccagggcagagagcggcagtggtggcgcggctgggggcctggttcagggagggggacagctgaagaaggtgtgaggtgaggagagcaatcgaggaaaacggaagcacctgctcctggttgactcattctggctggaggcataatctaatgtgggaaggtagtaacaggaaaaaaaaaaaaaagcgagaaagagcgactgtgcctgtgctgaagccctttcctcctcctagctcccaggcagctagaaaattgcctgtctgaaagaaagtagctgttttccttaggggactgtggtgagtgacaaatgagatgatatatgtgaaagggtaaagagctataaaaatgcaagattctattacttaattagaatccttcagcctatttatctgtttgagtggataaaatgtcctctaggtgtgggatagtggggcaggagtacctggtgaagaagtaccagctgtgggataatgggatgtgtggagtaatgcagagggtgtgtgaagatagtttaggggtgcccactaatactgtcacctggagaaacaaccatctgtcatttaggttcatcttatttgggtaagagattattcagttccactgcttccctcgtctgccactcatcttttgagctttttacagccaaacacttttactcaaaaatgggcctgaagaggaacacaccagtagcttcagggatatattggttaatttgtttttgtttggttttgtttttgagatgaagtcttgctctgtcacccaggctggagtgcagtgacgccatctcatctcactgcaacttctgcctccgggactcaagctattctcctgcctcagcctcccaagtagctgggactacaggcacacaccactacacatggctaatttttgtatttttggtagagacggggtttcaccatgttggccaggctggtctcgaactcctgacctgaagtgatccgcctgcttcagcctcaaagtgctgggattacaggcatgagccactgcgcccggccacattggttaatttggttgagagcgggctcgatgtgattttattgatgataatgtcttcaatttgccttgccctcagtacaaagcagcatgttgtaccaagggttctgggctgagggacataactagggaagactgagctgtgaatttgtcccctcagtagaggatcaccctggccaagttccagttcatcttggagccttattttacatcagatgggaaaagaccttgcaggtcattcattgtcttacatgcagagctcgcatacctgccacagggttacccagcccccagtggacagagaatttgtcccataccaaaatggctgagccacccaatccctctagacagcccctatgttggaaaattctttatgttgaatcgacatctgtttctctacaatttgcactcattggagccatacagaataaaatgtctaatgctgcttccacaaatatttgaggactgctaacacatttccttcttctacttactccacaaggcttcttttcttcaaaccaaacatgcccatctatttcaaacagggaggcagtgtggagtagtggaaagaaggccaactttggagccaggcacatctgcgttcagttcccagccccttcacatcctaacacttagcgttccgagctgccgtatctctctctgaaatctgtgagtgaaaatactcatctagccaggctactgtgaggatcagggatatgttgggtgaagatccatgctcatggtaggagcttaaaatacgagaactgttacaccttcagtttgcaattcatttagttgaccttctctgaacacattcctatttgtctctgtttcaatatgtatctgctctgtagaacagaataaaatgctttctgtgagttctaaccagcataatagagtaggattagcttatttttggtacttcccctcagtctgcagtcacagtagcctttttaagggtcctgtcttactgattcagtaagtttctcaaccaaaaccccttcgttaatatgtgctcctgttcaaccaagtttctcccattatgaagtgttttagttgatttgaatctacaatgatggctcttgaaagtggcagtcccggttgtgtcttgttgtctccataaatatcctgcacttgtcatattatgggtctcaaactggggttagaaaaatatggttcttgaatctgtggtaccatctctgctgatcccataccactgttgtgaatcagcgagataataaatgcagagctttctacatgaatttttgcacagatctgaggtcttatcatgaggcggaactgtgttagacttggaatgtgacaagaatgtgtgataagccactggctgagggagtactactgcatgagatatcctgcacagtccaggatagcatctgtccagaggaactgaaagggtgcaacttcgagcaagccagagccgactttgaatttatgtgtggctgtgtgttttctcagggctccaagtgttttataccttgggtcaaattctccccctgcggaggaagctcctttctggaagtaaatcaggcacatttagaagattcgttaactctttggctcctgggggattatggccagcattttctctcttagacttcccacagcgaattcctggttgggccaagctgatatctttgagctgacttctgtactcagggttcttccaaacaggaatatgctttctctgcctaagatctgggttccatgcccatctcaacctcaatccctccttcaaggaagtttttcctaactcctcggccagacatcaataatgtctgaagggaggatttctcccgagtgccagacttggaattcctgttgtcttcaggagctctccctggcgctccctccttcccccagggcctttaaactgtttctcctccagtctgcccacttgatccatgtgggtagacatgttccatggccttcagaataagatcttttgtggggtactcagtccataaacagaaaattgccttcatcttggatgctggtgtttctggcctggtgagaatgaaagtgtggaatttgtttgtaggactcaaagtttccattaacaataaatatgaaaaatatataatgcaaaggcttttgttattgttattattaaaataggaaagcctttacctttttggaagaaccgatttagattttgcagagtaattcagtctttaaaaggtagtggtagttaaaataggtaatctttgacttgtaaagagactaatttaaattttgttaagtaaccaattaaggccataaagagtttaaatccatctgtggcttctcattttctctagaacaaattcctaattccctacgatgaaattctcttgctatcctaattttttgccggctcaaaggacttcccgttttccccaaacacgcggccctgagcctccggtgctttgcgaaagccgtcccctccggctggaatgttctttgtctctctggtaaatgtctattcatcattcaagaccacccttcgcccctccccttaattacttcctcccctgtgcgccctcaaattcttgtactcattcaagcagtatttattaggggccagctttgtggccggcaccgtggcgggctctggggctacaaaaggtgaataatacttgggctctgcctctgagggccttacacgttagggaggagtgggtcaactgccacaaacgtcgctaggaaattaaaaggaaaattttacaaagtggcagttcttgtctgtcttcccctccagatggcccgtgtgttgttttcgggccggggctatttctcatttatttcgcacccccggttcttagtgccctgtaggtgctaaatcagcatttgtttcatgagtgctttttctgggggcaaccagacccctgcagaagtgtacctgtgttgtgccagaggttctgatgataggcttataggcggtagtttcctcagtgtccgtgggtcgcccccggtcccgggttggatgccccgcggtccagcaccgaacctttcggggtgcagagttgcagagccgcggagggcccgggccgtgcgcagccgaagggaggcctgcagcgccccctctggatgcagcgggcaccggccggccgccccgctcacccgctcgcaccccacgtttgttcaccagtatttcagtttacggtcagaaaatgaacacagacacttcgtgatactctacacttttcaaaggcgtaagggatgccttttaaaggattatggattagaaaaattcctccctctttcttgtgcctctgggcccttgcattgtgattctatcttacgtaaataaagggggctttgctctcctaattgtgcccactgttctgtgcagcgcggaccggcgcatgcagcgagcggggctgcgagggcgctgctgtggccaggcgtctggcatgctgaccacgtcgcgctgctgtaaaggaaacctgccccgcgcagcggcggtggctggagcgggagaaaccggactttgtgcaactttggccatagtggccatcccatgaatctgtttactagcttggtggtgggtccaacagagcttgttgctccctagccgcttgctcgtgcccttggtggttaccggtagttaagcttagggcgcatagggccctcgtggctcgccacctctcacggttcagtacccacgcttcgaacgagggatgggagcaggcgccacggccggcaccccagagccctgctgccccttagttcgagcggccatcctcctgtggggcttgtgggcagcctgtggggtttgtgggcggcctgtggggtttgtgggtggtctaaggaaagagttggggcactcaggggtctgctgtttttgcccgtggccttaactcatcaggggagggtttctgcagcagaatctcgggctcagggttggcggttaacgagggagcagcggggtcttggggagggggctcgacacccctgaaggtgccccctaaaggagccactgttagaggggcaccccatctttgtggccatggcggtggtagagcggctgggaggggctctgcggcgagcaagggagcaggcggtaggggttctgcggcgatgggcgggctaggggcggggcgcgggtgggctctaaaagtcggtgcccactcgctccgcgctgccgcggcaaccagcacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggtgagtgtgcggtgggaacgagggggtgtggctggcggccctgggactagggcgcaggcgagcggaggactgtgtgcccgtgtccgagctggggctgcctctgggcgaaaactctaccgacaggcggcacgcattccgcgcccgctctgcctacttgaggagggggtgtcactcctgcccgcaatggaatgttcagaacgcgggacctccttgggttaggatttctagaccccgggatcgtcgtggtgagatttaggatttctggaccccagcgtcatcttgatatgacttaggatccataatgaccctggtctcaccctgatgcgaattgggatttttagatcctggcatcaccctggtgcgatttaggatttttatactcagtcattgctgcagcatgatttaggatttctaacccccagcatcgccctggtttgatttaggatatttagactccggcttccctctggtgcgattcaggattcttagactccgccgttgccgtggcgcgatttaggatttatagatcccggcaaagccctggtgcgatgtaggatttttagaaccccagcatcgctctggtgcgacttaaaggataggccccagcatcgccctggtgcgatgtaggatttttagaaccccggtgtctccgtggcgcaccttaggatttcaagaacgggataatcgcagtgccgagatcgccgcggtgcagcttaggatttcaagacccaggtatcacggtggcgggagtcaccgcagtgactagaactcgcagtgcccgtcagccgccttaagtatttttcagatttcagtaacaagcgcgagtgagaacggcgatgtgaccaaactgtcatgttgcgcagggattgttcaccttggtttcgcgggttttcaaagtggttcgtctcgcggcgacgccatcaggtgggcggcaggttgggtggtattattacgggagtgtgtttttctgtttacaagatgaagaaatcaaggctcagaaatttctggaaagtttgttactggagtttgcttattgtctccgctcatggctcatcaaatagttgggattttggccaaaaaatgtttgcttaacccattttgcctactgacggctaggttgcttcacttctaaaaatcctaaaagttcatgggggcatttttactgaggtaataagacaaaaaatggccccctgagaggttgcctctttgctttcttggagtaagaggaggagggtgtggaggggggtgtccaggagtggagtatgttggtcgatagcctcgttttttaaccccccactttccctgagcagcggcggggaagcctccccatttgccgctctggccgcccctcccggggctctctgctgagtcactgcagagattcagctgctggaaccccggggatgaatgcgatgagaagcactgggggaaaggagtaatgaaatctgcacatgaaaatgtatacattgaagtacaggacagatagggctgggcaaatgatcgtcaaaacctaatggtttttgtcatctgacctttcaaggagatactgggatacagcctgctattgttgggtgaaaactgtgatataaccatcatgttctggcacttttttgaaccatttctagtattaccttgagaagtaggaccaaatggttctatccgtcttatggacaggtactttggagaaaaaaagaaatgactgccctaataatgcctaaaaaatagcctggggagctgacattgtttaagaaacatggttattttaccactgtaaaaccacaggcttgtttttagattttagcaaaaagtatcagggatatgggggggaaaagtatcttgtaagttgaggaagttagcgaacgggtaggtagattacaggcaatagggaagaatgtgtgtacagacggaaagccatttcccccagggctttagcaattaatttatttcagctctatgacaactctaattttagttttggagggtattatttccattctggctgttttgagagaacttccattctactgacaattcttgatctgttgaccatcagaagtcatagacttgaaacagaacggtttataattcctgtttggcactccttgtcaatgtggataaactgacttgtgcctttgaagtcctgggcatgggagggttgggtgtaccaaccagtgctctttttccaaagacaaaatcaattctcacacgctgggtatgagttatgccttatctgggggtgggggagcatcttaggaaattaaatggaaacttaaagagtctgctaagaaaagcagaaatgtaatctaccgccttgacctctcaagagattagatattcagggtcatgacaaagctgcttatgttggaatacacagtgcagctatcttactttcacagactgtttaccctgagcagtttctcagcccaaatccagaaaggagtactaaatggggcttcatttaggcaggagggctgaaaatcaggagtagctctctgcttgaggacatgtgataagttactacacacacacactctttaaaacatgagatatagcacatatatattttttgaacattttactggttgggggtagtgggtagatggtagagcttttggagtaaataagaaagaagttatttttttcctgggaagccttgataaaagtcaacgaaagagtgtccagcatttaagtcatgtcccttttatttatataaagtcctcttcagcaggtattgggaagaccacaagggtaggggctaaggggttaaagtcggggagcagaggcagaagattatatgttgaaataatgtattttttttccttaagattagaatgatgaacaaatatggtgagtgctatggcagacagaggtttgattatagtctcggtcagctttgtgcctatgtgaagggcaatgtaatcattgcatggtaacagcaatctcccaccccatcttaccaggttttggtttgtagatgagtggacaatgttacctgactgcttacagtgggtctctgcttttcctacaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaaggtaagaagtggactattggaagtcctgcgtgtatcggtcacataagtcccagctgaggtatttattttgtggctattggtctcttgttgctccttaatgatggaggagagtatctctctctctttctgtgtagtgtgcttgcagagaagcgcagaaaactgctgggagaatgggggtagggactgagattccaacctgcagaccttaccttttagtataagttttctttgtagcttgatatgtattccaatattagtttttttttttttttttttgagcaacctgtcaggtaatatataaaatattaatagatataaccaccattggttctctctccttaccatccctgatttcattttttctgtagattatttgtagtgtaactgtgatttaagtcttgataccattatataaattaatttgctagtgatgatgattattatgaccactacttatcaagtaattaccatatgccaggcactgagttatgttttcagccttcattgtttaatctttacaacagcatttggagataggtgccattaacctcattttataggtgaagaaactgagaaacagattggaaatgatttgttttgagcgggggtcaagagcaataacgaaaaatgtttgtcataaaccgtttttcattattgctcctgacctcctctcatttgctatattcaattaagtaagtatacaatttttattatgttggcttgggttacttccagttttactgttttaaaaaactaatgttgaagtaaaagcttcatgtccatacagtttattttttccttacattttcaaactatactacttgtataaatggaatgattttatttgcacagattctcaagaacaaaactcttaggctaaagtatatacaatttttaactgcttctaaattatttttgaaaaccttattaccaaattttcatgtcactggcagtatatgaatatacctgttctaatcccatactattagcaaggttaatattgtctaaatgtttacctaatttagatgatgctgaatgcttccatattgtcatatgcattaaaaaagttcatgtttatgttgattaagccctttttatagttgacaggattttgtaatagttttattatgtttttgatgttagattgggtctcctgctgaataaaaagtgctgagcaaacagcataagctaaaggtgttccttgggaatagttgctgtatcttagagaatttctgtgaggccattcatgataaagtacaaagaatttgtagtttatgtgttgtgatcatatgcttttaactgaaaatttacttttcactgaaaaaatttgcatattacagaacaaaaggagaaatggggagatgctgtttaaaaacacctaggtgaaagtaaacaaggtgccttcaagtattttcacatagcatgatttttacaatgttttaatatacagattgaaaggagaaaaggcctgttctcacctaacgcagttaagcttacattttacaaataattgtgtcattttaatgtcaatttggtcacagtttcttgttctttgtatcagattacttagattttaacatcttcgaggttatttttatagggatttggcataattgattgtactttccttcttcctagactctgtgggtgtggttggaagtccagagatagttgtgcttttacacggttttccaacatccagctacgactggtacaaggtaatgaagtcagacttctacgtcctactatgtcttaaaaaatctcggccgggcgcgggggctcaaatcctagcactttgggaggctgaggtgggaggatgacctgaggtcaggagtttgagaccagccaggccaacatggcaaaaccccatctctactaaaagtataaaaattggccaggcatggtggcacaagcctgtaatcccagctacttgggaggctgaggcaggagaatcgcttgaacccgggaggcagaggttgcagtgagctgagattgcaccactgcacttcagcctaggtgacagagcgagagtctgtctcaaaaaaaaatttttttttaataaaaatttaaaaaacctcaaggattttgttgtcagcaccagaaggctcttgcacatttgaattgcttttaaaaaaacattaaatgttgaactgttccttatttactgaagggaataaacaactccttggcactctggaagggatcactgccaagttaccctccctcaacagggattaattaccaggaataaagcattttccaagaggatcatctgtgggacctgtggtagtttcatggcgttttctctttatggaagtctgttaagccaagatagggctgaagctcctgtgcaactgtaggtctggtgaaagggaggggcaggagcagaaagcccaaatcatcgtttctttcttgtagatttgggaaggtctgaccttgaggtttcatcgggtgattgcccttgatttcttaggctttggcttcagtgacaaaccggtaagcagcacctatgtggggctggtgatggggtgtgggggcagacgcagactatgagggtcaggctggcagagagagctgtcctcatgacttcatcctgtgtatgtgggctttcctttcctcagagaccacatcactattccatatttgagcaggccagcatcgtggaagcgcttttgcggcatctggggctccagaaccgcaggatcaaccttctttctcatgactatggagatattgttgctcaggagcttctctacaggtcagtggagcttcagacttcagcttatgatgctaggagagtacattgtttctggactgtttgtatcctttttctctcgttttcagcggtgcactggtttaagtttgctcagctacatgtgtgtttcctcgtctcccttctaggtacaagcagaatcgatctggtcggcttaccataaagagtctctgtctgtcaaatggaggtaattgccttggcggtaggtagaaagtgggtgtaatctagaagggccatctttagatacagcggcacctaaatggtaatctgataatatttcaagtagacataattaaactatgggatctctacctcttctgtgccatcaactcctttggtggtctgacaagatttatggaccctttctcagaatgttttaaaataaagaaacaaacagcattacaaaggatagtgactttacttacatagtcaataaaaagctgcattatagtcacatgtgctttttcaatgcattagatagcaagttctagtggaggacctagtaacagctatatcagaaggagtgaggagtgtaaagactgtttgccatatctgaaacaactgcaataggttatgagagtgtaggattgaagatacagaaaaaagccacaagtgtttctaatactactatgatgttagtgtagaaaatccttacttaatgtcatcaatgggttcttggaaactgtgactttaaatgaaacgttataatggaaccaattttttttctcatcaatgttttaaagaaaggatgttattcaaggacctgctgtacctcattctgcttaaagccgaagtttccaagaacctatcctgatgttaagtgaggacttaactgtatgagattccccaactcctaactgatggcagtgccaagtttcagttagaaaataccgaacccctgattagactttctgggtagccagcttgcaagttcatgaatatccaaatgtctcctgaacgccttaagagcagactgggagagaaatccgtctctccctttatcacttatgctcatggctttcttccactgactctgaagagaaagggaaaaggaaaaactctagggtttttaaaggacctatacttatttaaaaacttcttgttttattcttacagcccaaatcattaaccctcgtgttctgagtgatagggggaaatgctaaggggagtcagagcctggttatcagcattttggatgaccatatattttctccccgtttcactatctttaagatgggaaaagtaattccagtgggatttattgtgaccagttaaacacagaattcctggagaagtaattagatgacagttttaaattgttatttgtaattctgttttggtagtaaaggctgcagaggtgatggtgaatagggtgggtagtttctgataatgggcttgcctttgacctaaatgtaggtaggctgggtgaggtggcttgcacctgtaatcccagcactttgggaggctgaggtgagaggattgcttgagctcgagaccagctgggcaacccagtgagatcccgtctctataaaaaaaaaaaaattaaagctgtaggtaaatgactaagataagtctcttctacaggtatctttcctgagactcaccgtccactccttctccaaaaggttggtacttcactgatagacctttagttttaggatttgtactgacgtaaataatgctgggaccttttaagggccatagctcctgtaactggcagtagttaaatcctcttccttgtgaatttctattaatgaagttactttttcccttcttaggcaactaaagcagaggcagtggcccctacgtaaacccaaaaccaatcctaagaataagagatcaacaaatatttggagaaattacagctatggaaagatctgtgtcacaagcttgatgtttgaacaaattaggatcctactctaaacttgaatatatcagagttaaagttttagggatttagtgaattgtagaaaagtaatcttagatggaattagaaatagatttgtcttccttgagagaagaatgcgggtaggcaaaacaaaatgccaagtaccaaaccattcagtagcaggagatttggctaaagatttagttcctagtataaaaccttttgccccggtgaggatcttcctctgggttcttgagctttacctccacttattcccctccagctactcaaagatggaggtgtgctgtcacccatcctcacacgactgatgaacttctttgtattctctcgagggtaagtgtcactgtcaaagattgtggcctagagcaatgtcgtgaaaagttgctgccattacaattctgggccaaatcctaaggcttgatattttaaagcaaaggtgttggccgcttgccagggaagtagaaggaattcataaatcacttatgggtcagactgcatggcccagactgcatggcctctgaggttccagccatattgaacattctgagttctcctcacacttatcttcctgcgttttggactctttcagtctcaccccagtctttgggccgtatactcggccctctgagagtgagctgtgggacatgtgggcagggatccgcaacaatgacgggaacttagtcattgacaggtaagaagttaccctttgctttggtttccagagaagtgtttttgtggagagtggggattgcttgttctgttccttgctggcttattccctatcacaggaaggctgatgatgacctatggggcaaaccaaaaagtcatggtctatatgaagaaagaaatagaaaataagagtgaaactggactctttgttagtattaaatgcttcaaagtattgaatcatggttgtgaaagtagcctagtgcctccctcaaggtacaaggctcttccttttgcctatctttctgcagcaacggggagtgagagggcagacttctctttctctgtcttgtacaaagaattcccatgccttggttcaaatgagaatgtagacactttcacaagggacccagaggtggtgatagctgtaactacttgggataagactctgacttctagccacctggctcagtgtagcttccagtgtttttactgatggctttgctggggattgtatgttagagggagccaatcctcccaccctctcctaagccccaacaggatccctgaatatttcattttagtattaaaaaactgaagaacaattaagactgtcttttaaaattatattttcctttccaaaaagtaaatactatttgtaagatgagatatttgaggttcacaaaaataactgtcctggagttgccaggcagaatgagtagaatacatgagtttgagttctaaaatgtggcagtggtgtcttacgctggagaaagaggaatcctctccattttatctgtggtcagatgaagctttgtgctcatcaacatctacacttagaattttgaagtagatgtcggctgggcacagtggctcacgcctgtaatttgagcactttgggaggccaaggtgggcgaatcatatgaggtcaggagtttagagaccagcctggccaacatgatgaaaccccgtgtctactaaaaatacaaaaattagccagtaattccagctactcaggaggctgaggcacaagaattgcttgagcccaggaagcggaggttgcagtgaactgagatcatgccactgcacttcagcctgggcacagagtgagactccgtctcaaaaaaaaaaaaagaaaaaaaaaaagaagtagatgtcaacacagaagatcatgtgttacaatcctcttattttaaaaatgaggaggctagccaggtcctttggcacatgcctgtactcccagctacttgggaggctggggtgggaggatctcttgaggtcagaagttatagctgtagtgagctatgattgcacctgtgactagccactgcactccagcctaggtaacatagggagaccctgtcttttaaaaaacaaaccaacaaatgaggaaaccgagttgaaagatctgtgttatatgtttgagtcagagaggtaggtagtggtggagcctaaattggaacctcagacctgggctttttagttacataaaatccaaaccaactgtcagccttcctagatctcattccctgcttaataaatacacaaacccactaattcttatattgatagtaggcataatcactactagagctacatggtggttaactctagaggttaacagaaatggataaattaagtgggacatttccaggaatgctaaactgcttctggattaagaaattgtatcttgtgttccttgtggctcgttatgcccttgaatccctgtaacagtaaaggtttcttgttctgcacatgctgacttacctgtcctacagtctcttacagtacatcaatcagaggaagaagttcagaaggcgctgggtgggagctcttgcctctgtaactatccccagtgagtatttttgtattattgataggaaactgaaggactatagggttaaagtaatcgcaactcctttatacaattagggttaccagatttagcaaataaaaatataagatacccagttaaatttgaattttagataaacaacaaatgcttttttagtatttaagtatatgttgtacaatatttgggacctacttacaccaaaaaaaaatcatttttcacctgaaattcaaattttctgggtatcctttattttactggcaactgtactcatgacatctggaacagtgatgtgtgtgtgtagagtgaagtatataaaaagctgagacattactgtaaaggtagttggtattactgatttctgtggtgtgcattgtcagtgactgccacattacatgctgaattgctcggacagaaggctgtttggattactaatcaagaggctataggtggtttgtgcttatttgtcttttcattcttacagatttaaaaaaaaattatggtgtttcacacacagtgattagtgctcaggaaattattggttgatttcaaatgtcaagggtctgttataactgaagagagacttaaagaatgatagtatcctggacttagaggatgttgaaagttgggcatatcccatttggtccagggtgcaggagagctggatgagggaccaaatggttgtctgtaggaggagatgtgtccaatgaatgaactggtacgtgcctagcagttttttagaggttacctaataaaacaagctaggttttgtatcacacaaaaaattatttatagaaaatattttcttgggctgggtgaggatgctcacgtctgtaatcctagctttttgggaggctgaggcgggaggactggttgagcccaggagtttggcaccactctgggcaacatagtgagaaaaatttttctctacagataatttaaaagttagccaagtgtggtgttgcacacctgtatgtagtctcagctactgaggacactgaggtgggaggatcgcttgggccaacgagtttgaggttacagtgagctatgactgcaccactgcactccagcctgagcaagggagagagagaccttgcctattataataaaaaaaggaagaagaaaacatttcttttcggagaggagttaattttagggtgggagtagaacagatgtgagagctgttaagtatttcattccttttctcttttctagttcattttatctatgggccattggatcctgtaaatccctatccagagtttttggagctgtacaggtgagtctccccgagagaagtctatgttttgttagtatctcatcctgacagtggtaaacagaattgcctgttgagggctattggctctagccattgtctttaacctcgctggctgttcatccaggaaacaataaaaagattgagttgaggaatcttattctaacataattgtagtatcaagacattcagttatacgttctcttgatttatacatagtctgttttcactgtcatgactgctacatattccttggtgtacaaaaagctctcatgtgagtcaaaggttgaaagtggatatacctacaaagtgtttgtttgttttagtctgattgtaaagccaattcattggtttaggctgagcagatggcaaggagagattgagaagagctcattgtggaaaagtgccttctcattggttgctattctctctaggtacttacttggaaggtatcagaatatgaaatcttgattatgtcacataagaatgttccataccttcctgtggcctactggatacaagctagtagtaaacagcttgcatataattttaaataaaataccccctgtctcatctcctcctgggattaagggaagatccttggttatctctgcttgggcagtgagttgctgtgtgatccacttgtttgatgcttcatccttctctaaggagctgaaagtcatcttgctttgacaattgttgcaaaagtgttatattttcaagttgttgtttgttggattatgaacatttaaaaactagtttgtataaatggaattggcaagtttatctgcctaagatacaatttcagagtagaaggtgaataagctctttggtggctccttccagtgtggtgtgtccacagggtcatttactggggcttcccactggcttacatccctcccgctccagcctcaagttcacctgcgtgctgttctcttccactaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaagtggactctggcttcccctcccccctcccccccacccctctgggataaaaattttccagcattgccaggagctttcaggtacacattaaagaataaaatgaagttaagcagctggagtataggatagtatttgattttcaagatcacccaaagctgcactatcgtcccaaagctgaccaagtagaataaaaagaaaaaaaaaaaaaacaacccatgcgcaaagatagacatttgcttgatctgctggctcagggccaaatgtttaatttgcttctccaaagtcattcatcttcaaaagtctgattctgggaaactgatgccactagcctaaaagcccactgaccatgtagtgtgcatcagtttcctcttgtccagtaagcatttatccaacagaagctaagataacatctacaggtgttctctctttacttctgacagtcacctgcatggtcactccatcggctaaggccagcctggacctcaccaataaatcatagccacctctgaatatacctgagagaaaaaagtaaggaaaaccatattaagaacccaaaacaagcactggataatgaaatttatcatgctatccctgcatctcctttctattagtttagtttagcttttccagagacttgtggaaactgaatcctaaacaaacataaattccaaatatatatatttttatattcccatgaaaccaggtacatagaaggtattcaaaaataccaatttggagtactcaaaaggaatgttggtggtggccttggtatctgttggagagatttgttttgggccaaatgtacatcttaaaagaataaccaagaatagcatgcaaaacaaattattcattttgactgggtatcaaattgttactcatataatgggatgatgggacaacagcaaggcataagatgcccatctatatcctattattaagctttgcaagaaaatggaaggaaaatctgatggaagcttcttacctgccagatagagcgaatgggaattcttgttctcaggtactttatcggacctctcacatggctgcatgcccagaaatgtgatgatattgttgacagcctctgtgttgagaagatgtatgagacagtattaggaaagtaaagcacagggatctccctctgcaccagtgtatgctgggagctggggtggaagggtttgttggtgaagggggttgttggtgatgtgtagagggaggctactactggactagaaaatggctgatcaattagatgatgaagacagggtgctggccttttaagtaagagatttatgaagtttttttttttttaaaggagttcttctggagtaacaaatatgcctgttaggtgttatactgttatcaggcaatatactgatagcaaaatgggtctcaccttcaagggttttggtagaactgagggcaaaggtttcctctttctcaaaggtatctcccacctcttcccaagcagcagcaaagttaggcttcagtactttctgaatatggtcagacacagtcacttcgagatcttccagctagtgggtaataagcagtcagtaaagaaaagtcctttctgttatagggcaaagataaaggaactagtcaatatggtcctccggagcctagagaaaactctaccaccaaaatagtttaagttctgtagtctggataaatctaatgttgtagcccttagcaaaggaaagcaagaaaacagaacatctggcaagagcctcagatcaacatctgtagccctgaggtacagagtagtcatgttgcacccacacttgaccactgagttctgggcacacggtaccctctgatcattcactaagaggttgatattttttaaaaaaagttttccctccattctgtgaaggctttttaatccatgatctggctataaactaacagctgctgaagcaaaaacaaaaaaccaaaaaacaaaaccaaccccctccccaaatcattttaaataaaactgatctcaatgaaaatcatgtcattattttcatctcttaattatccctattataaagaaaaaaaagggtgagtttgttttaatgatgaagtggtaaatctcaattctctctggcctggtgctgtccagttacagaggagggttagtccaggtcctcctaatttgtcatctgtttcagaagaatagaaatcccttaagtttatgtcagatgctcctagaaaaatgttctctcaaggcagaagtcacttagtgttgtgaaggtgtcaaagaaagtctctatgctgggaagactcaccacatactcatcatcatacccatcctcatctggaactccagtgttagggtcacagtcccggactgtaaacttcatggtgcagctaaaggagcctgcaactggagaagaagggaggcaaacctgcatcagtggggagtgcaagggagacgtttccatcatttcttaggaagtgccatctgtactcagcactgtgttccacattttccagttaaacacacatgccctgttgtctggggtagtggttctcaaaagcagcctacaagcgggtcaggaaggcagtctcacaaagcatgaatgtaaagtctattccacgctgtgggttacagcagtacagaaatgataacatgggcagactgtttctctattggtatgaagaaagcagcagagaggtacttttgggggctttttgccatgcctatcaaaggggcctaaatgttgaaaaataaatattttgagaaccactgctgtaggacctgaccaaaaaaaaaaacaaaaaaaaaacctgtggtaaagagcatacagatcatcagattaacattgaccaatctcatcagcatctcaatactatctttagattgtggactgatggcgggtccacagatcaccagagagaacttgctttatctgtcaaccttcagcctaaagtgagtaggtcagtaatgagtttctactattggtaaagtcagtgtcttaaatggaaaagcaagtgggcagttgtatgttttcacacaagtggtgttaagtaataagaaatggaggtgggggtacatttttggaaagtgaagtctttataaaaagtaaagacagtattttctgaaatgtttgaaggaggggatttagcaagcagggatgaagaaaaggcatttaggatcttgtctatggtctggaaaaagcttataggtacaaaaaatattagatattgggagagttaaaaaattatttgggggataggcaaggagaggaaagaacaggctcagatgtgaagaccatatacgacagattgggtaataagactttcatctgctcagtcttgactttaaattccatccattcatccatccacacatgtagtgactgtcaatacatgttgacattacacgtaaaggtataagcttatgtgccagacacttggataaaaagatgactgagacatgatctctgtctctaggagctgtctaggagttaaataagtgtgtgggctgtgtgtgtgtgtgatctatctatgactttacaactcaatgccatagatcctttaagttttaagagagtgccatgtgagggtgcgggattaacaaatagcctgggaaaactgtaaaaaatgtgaaacgatataatagtttaactggctctcaaaagatgcaaaagagctttggcaagcagaggaagatgtacaaacaggcaaaaggaaagaggccagaaagtccaccgggcagctggaaacagtaagaggcatgctaatgcctaggtgctgagaagataatttgtttaggaataaattgtaaaataccttgtatttcaaatgattttccaacaggctctggtgagctgaggcagtcaagagattgaaaggttagagataagctagataaggtgcctaatttaagccactggtggggactatgaagaatgggtctgaattcagagagcagatggattcaacagaatatgctgaaaacagacgatggcagtgggttttcccatataggaaagaatgaacctatcaagcctgcagaatcaatttcaatgccattaggggttgagaaaagaacgactgtggtttaattaggataggattttcttcagagagaaggggaaagaagtgaaagttaacacaaggccagaacaggtcaggtgaggcattttttttaaaccatgaaagagatacagaatatggtaggggaaaaggtcatgatcaagttagaatgaagagtcaggagagacattaattatagcaacccagtgtggttccaattaagcagagaggctacagcaaatgaggaggacaaagagacaacatcaggtatgaaggcagatcacagactgggcacaggggctgagttttatgtggaggtaaagacagaagacacttacatataaggacctgatacagagaaagagattaaggaagtaaataggaatggtgttagtagagataatgttcctgggaatttttttacttaaatggtttgattgatacaatgagaggttacagggatctaaggaagtctaggcagtaatctgtcgaagctgctggagaggatgacgaaatggggcgaggaggcaagatgcgggggcctttccatagcaagaaaatactgaatgcactgccataatgtaaatatgagagttacacagacaaagcaaggcaaataccaaagagaatcaggaaagaatgccctgaagatctgcattaaaactgttctctgaaattaagcttgtcttgtgaggattcactgaaaatgagagtcaaccactaaggagatttgtatgaaaagaacccagcgaattagagaaaagatagatgctggcagctaagacaggagagggacatgtgagttgggccagggtacagaaaatgcagtgtggcaaagggcagagtgggaaaggtgggagggagctgccaggtctcaaccacctgggggagaccatgacaaagtaagagacacttatgaggtatttccggaaagctttgttagaataataattaaagaaaagggtatgtcactagggcaaaagattagaaagaaggcaaaagagatggatctgtacaggctaactgcagcagtctatgcaggtctggactgaactgagaagcaatgggtgcagcatagtgtgtaggacatcgaggaaagctgggcagtgagtgccaaaataagcaatacacacctacctggaaaatcgtgttgagtctgtgggaatgctgtacaaatggtgggagggagtttttctctaggacaaattcagaaagggaaggaggaatggtactggaaagcaacattagagttgtcctcagatgaaaaggagttggtcactaaggaatgacacacatcaacaggaaggtaagacagcattgctgggccaaaagtcataagagagtatgaaataagagactggaagcaaaggaaagaaaatattacataaggaagggcctactggcagagcaggtgtggaataaagatttagaatggggtatcctgtctaggtctaaatggtcggctgcatgggaaatacacagaaagggttaaggagcaaggaattcagtaggaggcagcagcagactagctcttaaagcttttgagggaatggctaattaaaggacttgcttgataggaaagttataaactgatgaatgctgataaaaagctatagatgggccgggtgcagtggctcacgcctgtaatcccagcactttgggaggctgaggcaggtggatcacctgaggttgggagttcaagactagcctggccaacatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaatggaatggattcttgccataggcagtggcaggaaccctatgaaggtctggaatgaactgaaagtgcaagtgttttcagagtagtgtggaggtgacgaggaagaaaagactaaattcatgagaatgatacacaagatgatagctgaaaaaacaagtgactaacagttgttctactagggtcaactggggaaaatagtggaagagcctgcagaagagacggagtcatttgaagattggcaggtattgactggagggatacggccccataagtgtaagattaaataaggagagactggaaactgtgtaaagggagaactatacaaagagtaggtaagcgtaggtggagtggcatggacaggtaaaatgaggaaagtgtttcccagaatgggaaatcttgtaaacccttaaaaaatgtgggtttattcagtcaaatgttggctcttaattgcagactttgaaaagcagtagatacaatggaagaagaacaagtgcttgaaaagtaatgcgaagcttttgtgagaagtttaatgagaaggattagaaggagatggattaagatgagccctaatagggcagcacttaaagacaccaggatagatctttgagtagtttgtagaatggatgactaatattggaagaggagtggctggagatcatgttggaaacccatctcaagggtgaaacttctttgtttccaggtacagatggtagatgaaattttactctatataattaagggagggcaaatcaccaaaggggagaaacaaatgaatatcatgtaagtgcggtattaaagttactcttagaagttactctgtcatgtgaagattttctacagatgagagacagacactagagagaatttggctaggaagtgccattcaggaggagacagagtccatctgaatgaaatatggacagcagctaaaagaagggaggctgaagataaggtagcgtacatctttagggcaagataggtaacaaggagaaaaggaatagaagaaaacattaaagttgactccagatgaaaaggtcatttgaagaatggcaggactgactggagagacagtcccatatttgggccaaaagaaatgaagaggggttaaagctaaggggagcattaaataaactagataatgattctgaaaaggtggcgtggtaataagaaagaccacagcgccataaagatgcctggagaatcctgccagatctcagaatgggcccaactggccaaattcagtgggtgtaaggccagattgcagtgactagtatatgggagagaaggaaagacctgaataggaatgagtcagtagactcgctcttgatgccttagtgggagatttttaattaaagggcttggttgagggagaagttgaagagcaatgcttcttagaatgtgttacatggcactatctaggaatctgttagaaatatgaattcttttcccctcccccagacctagtcagtcagaaactcagggtgcattaatctgttctcacattgctataaagaaatacctgggactgggtaacttataaagaaaagaagtctaattggctcaaggttccacaggctgtacaggaagcatggctgaggaagcctcaggaaacttacaatcatggcggcaggtgaatggtggggagccagcacttcacaggagaaagatagagagtgggaggaggtaccacacactgaaaacagtcaggtcgtgtaagaactctatcacaagaacagcaccaaggggatggtgctaaaccatttatgagaaactggcctcatgacccagtcacctcccactaggccctacctccaacactggggatgacagttcgacatgagatttgagtagggatacagatccaaaccacatcctggggtaaggccctgcagcttgttttaaccagctgcagttggagaaccactgctttagacaaaggcaggctaggaacaattctgataaagagcctctgctagcaactgttgtgttagggtcagctgaaaattaaaagaagcaactgaagagacttgaatgaaaggagaggagagatggagagaatggaggtgatggagggtacaaaagggaagggataaatgaatgaggctggaggctgaacttgcagcacagtaagcaggccagtgaggaagggcactgaagcatgacaggatgaggaatactgggacagggagagtagcaactctggtagagtgattttatgttaatccagtcacagccactcaagtagacagaggaaggagagaacgtggctaggtaagaattgaggttatgaggggtcactgttcaggaagctgtggatctcagatccagtgtgcagtctgaacagtgagtgttgagtgtgaggggtctgtttatccaaaagacagtactgaatctatggaactgacatacacagtctctgaatgaaggagggatactgaatatagtttttataaggcaaaataaaaaggtgtacaatagtgaagttaaaattgcttccagacgagaaggcatcacttagtattgaccaaaaaaagtgtcaatgatactaactggaggtatttggcaccatacttgggcgaaaggtcatgatggaaaataaagaagccaggttagatgctatctaaggggaagggaaggcttatctgaagagtagaaaactggttttgaatgagggagacagtggggatatgaggggaggaaacctcaaaaagaatatgtatccatcactatgaaaggttaggctatacaggggaagcctccaaagggaaatctggaaaaa

SEQ ID NO: 1889 - DNA, 2464 bp, Homo sapiens
caaccagcacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatctgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagactttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacgtttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaa

SEQ ID NO: 1890 - protein, 335 aa, Homo sapiens
MVRRDRLRRMREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLTPVFGPYTRPSESELWDMWAGIRNNDGNLVIDSLLQYINQRKKFRRRWVGALASVTIPIHFIYGPLDPVNPYPEFLELYRKTLPRSTVSILDDHISHYPQLEDPMGFLNAYMGFINSF

SEQ ID NO: 1891 - DNA, 37923 bp, Mus musculus
  misc_feature (1)...(37923): n = A,T,C or G
nnnncccggacctctgcctgtatcccaagctgcccacctgacagctgagtctgtatctacaaagcgggggtcacctaaggccatcggggaaacacagatattcgtcacagtagcaaagttacagttatgaagtagccacgaaaataattttatgttcaggggtcaaatgaggaactgtgttaaagggttgcagcactgggaaggttgctctagagaagagacacagcagggtgccaccgagcagaaaaatggagcagatgcccctctaagcccccaggccaacagtcctgttattgcttggtttctaccaactccagttcctccaggtgacttcttcgggctgtcttcatgggtgcccacaggtaaacgagatagcctctggcacactctgaagagcttcctttgccttgtgtttgccctgtgccagccagcttcaaggcgcgcgttagttgagagcagggttctagagctatcatgctttgtgactctgagctttcaatggttaattctatgccacacgtccctgggtgtatgtatgtgcaggtgcgtgtacaggaggaacacatggaggtcaggagaggtacaggatcccctggaactggtgttgtagatagtggtgagctgtcatagtgggtgctgggaaccgaacccggtcctctgcaagagcagcaagtactcttaactgctgagccatctccccagcccctaaccacaggttatttagtgcttcagggtcttagtctacccatcgatatactagagctaaaaacagtaatctggtggggtttgtaacaagcgttgggtgtattagcacgtgaaaggcacttggagcaattggtactagcgcagaacagtttgggtggaagggagtgggcagccactgtagttgggaagggcggaagtgatggagctggggaaacacacacacacacacacacacacacacacacacacacactcacacacactcagagagagaggagacaaatgcctgtggttgatgagggagaattcactaagaccagatgcccatttgtggtgtcgggtgggggctcttccaggttcggagcagacaagatgggtgcatggctgaccgcattccgaatcactcctcacactggtctgcctagactcctgctggttatgagctagcagcctccacacacctccctctgccagggcagcgctggtctgagccatcatctgaagctgcaagattgcagccggggcagctgaagttctaagagatgttgttccgcacacggctttccccatctggcctcaccaccgtccttaacgccatgggccctcgctcccctcctaggcttcatttgggagcccactgcctgtcccctgggctctgggtagatctgagcaagaagtagttcaaagctaagaacatgaagctttggaagggggcggggggggggggggagaccagaaactgttataaaagggttggattcaaggaaaattttagggagtctggggtcagtgagaaacttacattctgtcctatgtttttaggttcttttgaattttcaaaaaagatttatttattttattttatttatgggtattttgcctgcatcgatatgcatgtcccttggaacgagagttacagacagtcatgagctgcctcgtgggtgctgggaagtgaacccgggttctctagaggaacacccagtgctcccaactgctgagccacctctccagcccccactgaattttaaagtagctataaataatacgtatattttaaaagtatttcttttattagattgtaatatgaagtaatacattttaaaaaattgtatgtagcatgcacaattgtgtatatatgttcaatgtgcatacatgcatgcgtacacatgcaggtgtgtgctcatgtgtatgtatgtgtatcgggtatgtgagtgcacatgtgttcatgtgtgtggggtgcacatatgtgtagaggtcagagtctagcctcggatgtcatttctcaaaggacattcatcgtgtgttttgagtcggggtctcctgctgtgacgtggccaatctgtgtgaccagtgagttctaaggactcttttatctctgcctgcctagtgctgaattcatctcatgctactatacccagccagcttttatgtcttgtttttatgaatataagtgtgctttattcataagataaaatatatatttaaattttttatttgaaaaacaaaatgtgtgaaactttggcttgcatgtatgcatgttaccattgtgtacagtgcctccagaggttagagagggtatccggtcccctgaaaacagttacagacagttgtgagccaccatgtgggtgctgagactcgaacccagatcctctggaagagcagccagtgctcttatccgtggagctgtctctccagctttttaagcggatattggagattcggcttggagcatgctcataccacaagcactttaccaactgagctatcgccctagctcctaaaaatactgtaaagccagtcacatttcactcctagaagtaaatgttcttttagcttgaggccagcgaggaccacatagtgagttccagggcatccagggttacattcagctccacgttaaaaaacctgtctgaaacaaaacaaaaacaagcaaaaaaaaccaaaaacaaacaaaaaaaaacagtattaactagagatagaggtatgccctgttttctacacacctgcagtctcttcactcaggtagcagaagcaagacgattgagaattggaggtcagcctgagctgagaccctgccttcgtatttaagatttggggctgtatttcatgtttctttgcttgcttgcttgcttgcttgcttgcttgcttgcttgattgattgattgattttgaaagagagggtactttactgtgtagcccagtcaaacctcaaagggttgatccccctgcctcctccttggattgcaggcaagggttgtttgaagctgcttgaaagcaggaaacaggctggtggcctctggagggggtcagcgcctgcatttgaagtcacccctcacactggtttgcctaggctactgctggttatgagctagcaccccacacacacctccctgtgccatggcagcactggtctgagactgttgatgctccacggtctcctggtgtcctaggttcagtcagaagagccctcctctctccatggctctcacaggccatgacaaacaagatatttcttcttgtttattcttgaactctcctaaggccctcttgcctcctcttgcccacaaggaattggggctttgttctcctctnnnnnnnnnnnnnnnnnnnntcctctcctctcctctcctctcctctcctctcctctcctctcctctcctctcctctcctctcctctcctctcctctcgaactcagaaatctgcctgcctctgcctcccaagtgctgggactaaaggtgtgcaccaccacgcccggctggctttgttctttctgtatcatggctagtgactctgagctgcaagctggggtgtaggggctcggcctggaacccaggcctttggcttcctgcctccggctgctctccccttgcaacggaggcctggtcttctttagcttcctttccacctaatatccagggactagggaggtgggttcaggcttcttgtcaccttgtgggcaagattgagacctcgatgtaaggcccagaaactcagcttgtcccggggccccagagtggaaccctgtggtgttcgcatcgaatctggagattactgagggctgtgatgtccccacaggagcagggtatctggggctctcggttttgggtgagcctggtgcgctggttcaggaaggaaacttcctgaaggtacatccaggttccccagactgagtgacctgcttcctcctgattgcagttgcttcccaaagaggtggaagtgagctgtagccaggctcctgaagaaagccccaaatccaaccaagagctgtgtaaaggcttaagccctgggcagtgttcttggtccctaaggtcacttctctctttttcatgtgatttggccctaaatcaatgacagctagcccctggaaaaggtatcgaggtcattgagaagggggagtccccaaattcaagcgggtcctgaggtgcagaatatcctctttttctcgtcagcttaccctcatcacagtgccaggagatgcctttcctcttcgcgcagagacgtagtcccagtattttgaactccatggcacttagcagagagctagggggtaaacgagatccttctagaaagtgcttttggatccagcctctttgccagtgtgcatgcacacacgtccgtgtggctcttctggacagagttttcgtcataggtcaccgccacaaactatcctttccggtctccataacaaaccacaagacccaaggttattaatttctcagcacagcacccagatctgtggttagcaggggtgcagggcacagcaggtctcaccgtgaaggggaagtgcaagtgaattcccaggatgcggggggggggggggggggatctttcaactctctggcccagctaagtccccactttgtcaagccctcagtgtcacctttcccaggctgtttgcctccctcttcctcacccccctcaccaaccagtctctcccaggtctgaggccagagagactggggcagcaggcacccaggcttacctgggtcccatctgtagaaagagaggtcacagtgtgtctgtgggacaagggaggagggccactgccctcggaaggaggcaggctccctgccacttcaggctctttcttttgcagccagctactgagtgactcagctgctcagctgcctgggcacagtgcacaacaagaacttcaggaggcccgagctcacccagcagtgccctcatgcctccctgatgtggaagatagcatcttccctgggcagccaaagcatgctcccagaagcctgaggggaaaaaggcaggctgggaggnnnnnnnnnnnnnnnnnnnncctaacagggtattcatgtgttgctgtggtaaatgccatgactaaaagtaaaagcaacgtggaggagggaagggtttgtttggctgagagttccatgccaccatggtgcacccatcattgggggaagccaggaatgtgattcaagcaggaacctggaggcaggaactgaagcagagaccatggaggagctccgcttactggctagatctctcccaatttcccagcctgcttttaccacccagcacctaggggtggcgctgttttcgtccaccaattggcaattaaaaaaacaaaaacaaacaaaacaaaacaaaaccaaaaccaaccagccaaacaaataaacaaacaaacaaaaacaaatgcctcacagagatgtccacaggccagtctgatagaggtaattcttcaattgaggcgtcttctccttcctaggtacaccaagatgacaaccaagattaaatgttattatacagaagctggcagtggtgcatgcctttaatcccagtgctcgggaagtagaaggagatgcctctctgtgagtttgaggccagcctgatctagttgcaggacagccagagttacacagagaagccctgttgcaaaatgtcaatgtagaaacctctccagaccagagcccatagaagaaaggactcctaagatgcctagaatgttgattattcctgggcagaggaggctgcttcttggaataggtgtttcttggagatcacaaaccttgagaaatatgcgtgtcttaggcaggaagtcgtgagaggatcattgtgcgtgattcattcgttcccaaaagggccttaggaggtgtgactgcagatgataatggccgataagtgctaccattgataccgttgaaattaacaatatgctgatgtgtgagacattgtgaataagtgaggggtgaggggtgaagagagcaggtcaggatgagcctgtaccgtgaggcatgggtgtgaacatatgatggacggttgccttaagtctctcttgcctggagccgcacactaagtacagttccagaaagcagcacccatctccattccgaaagtagccttctgcacttggtccagtctgaggaacatacccaccaactgctgcctacagaaagctcccagattccttgatctttctgagagggccttcagtcctttggccctgagctgggatggcaggagggtgtgttcactatggagggtggtaagagaactcatatctactgcccctcccagcctgccttggcctttctgttgtcaaccttggttctgtagtagttttgtggattctgagagggcttaggaggagcctgagggaagtggccgtttccaaagaaagtatttcgagcccaggttatctcagaaagaagcctgaggcttagtaggtctcttttcttggacaatcaaggtggcagatacagaatgggtggcaggggagagggctctatactgagatccttgggctgttgcacttcacagctactaccagatctccccggacctgcagccacagcccagtcccttccttctgcgaggaccattcctgttccccgacgttccctgaatgcttctccaggcctgctctccccagctctctcctgacctccccagccacaggctcccgcttctggccccactgcacctcccagcctgcctttttcccctcaggcttctgggagcatgctttggctgcccagggaagatgctatcttccacatcagggagggatgagggcactgctgggtgagctcgggcctcctgaagttcttgttgtgcactgtgcccaggcagctgagcagctgagtcactcagtagctggctgcaaaagaaagagcctgaagtggcagggagcctgcctccttccgagggcagtggccctcctcccttgtcccacagacacactgtgacctctctttctacagatgggacccaggtaagcctgggtgcctgctgccccagtctctctggcctcagacctgggagagactggttggtgaggggggtgaggaagagggaggcaaacagcctgggaaaggtgacactgagggcttgacaaagtggggacttagctgggccagagagttgaaagatgaaggctccagggaagggacaaagttgggtctccagaaaggaaaaaaagaaaaaaaaaaaacaacgggagaggcaactttgggtccaggctaggaagcccaacggggaaaggaaagccagacagacgccatgtctgtcctcgatggggatagtaaaacggaaaggaaagtaggaatctaacatttgtgcttagacaccccccaccctgccccagtcggcaccccgttccaccagccccacccccaacccctccccagtcagaccccagtcaggcagtgggcggtccctattcctgttttcaagtcattcgtcctcatatgggccctgcagggaggaaagatgtctcttactggtaagacaacgactttctcctgggtcctccctgctggcctggaccttcttggctgtcactcgctcgctcatccggggagactggcctgcactggactaacttcctattggcacccagatttagaatgtacccatggagctaggtctagaacggaggtgggggggcgccccttttccttcactcccgatggatgatatccactgaggatctactgagcacgtagggatccattccacatagcagagaaccagaaggcagcgggatcctcgccttaattcagctgtcctaaagcttgggaagacaggacacacggaagaaggggaggggaatggtagcaacacgtgacctctgctaaccgaaagaaacctgtgtttattcaatggaccttatccctgcaaggctccgtcctgggccactgaggagaaacagcaagatccccccgtggctctgtttactgtctgccttaagccaggttgtgttctaagtcctgggctgatgagcaatagcacaccagaggccagcctttggagcttctaccaggcccggtgctgccactggactctcacgatgctgggagcagccaaccagccaacgtggagtccaggaggaaagggtgttgcaggctggcctgcgtccagccgggtgctgagcagcagatggggtttgggaagcagacagcactggcaggagacactgttgagccaagggccaggggggaataaaaggtgcaggctttgttacaggataaaaggcactaccggagttggtggctttgttcaggtggagcagaccacgttgggggcggtgcttatggggaaatgcctacagcttctctagagagaagaaatgttaggtcccccacacaggcattccccaaagttctgaagacagtcctctgttcccagcatccctgtgctctggcgggagtcacactgaatgaaggactgtggtggctgttaggtggctgctccctagtttggtaaggctgaagccacaggcctcaggtatgggaaaaccaccttgggttctcctaagccctgtgtcatcaagggagtgacctcaggaagccagtacaccagaactggggatgtctaaggcctctcgtgggccaggaatatgttgccagtggaggctcatactcgactggaatgatttcttgggtagctaccaggcattgtttactgcgggcgacatctggatgcacagttgccctctcagagtgcttagtaactggagggccacagaaggcctcgcagtacacttctctcgtgtgacacccctttgtgacgtcccacaagctctttccttgcccagtgggagccccttccaaaggaggtgatttcctgagtgttggtggggaaatggaaccttgggctagacaggtctgcatactgtcccctctctggccctggctgggtggctccagccctcaccctgaccctcactgggataacaaatagcaatcattagcatccgaggcaggctggctcggagctgaggggggttttgttacaccacaactcttaaggttgtaacttctatggtcgtgtcaggctgctggctgagtttctaaactttctcattggtggtttgcaggggatcttacccttccctgttggtgccagaccccatggagagctgtggtgctctgtgaggggaaggcctctggggggggggagttcccccctctcttgtattctcatcctttcccttccatagggccacctcctaccctgaagcagccccacctcccagcatctctgcatccctggctgctcagcctggccagctggctatgctggcacagatcctggtctgctggtgagctataaatagctcctgcacccacggccttggcaaggtgctcctggcgtgggtgcagaggacactggagaagaggcagctgagcctgctgtccttgccagaccaggcccacagctggctggcgtaggcagcacaagctcacgggcccggtgagctgaagagggtaccctggggacagggttcagtaggccctagggctgatcgtgagctctgggctctatgtctggatcccaggaccagaatggtacagaaaatgggagggagagagtggcagctgagggtgtgggaggcccaggaacttggggactgagcagaccgggcctgcttacctgcctgattgctcccgagctaagccaggctgaccacattcctagaagggcaaaggcaaggagggtatagagcctagaacggaatcaccatttcattaaatcctgtaagcttagccccaaaccagtggacgagcattctggagaaaggcgccatgcttccagtcaaatggctcagttctagccatcagcaagcagaagggagcgcatctgtagtctgtagacctcctttcccacaggtagaatggaagccagttcctaccttcagctcaccaactggcctaagtttgaaagaggctcccctcagggtattttgacttgatgttgagtcagccccagaggattcagtagtctctgaccaagtccctgcagactagtcttccacctgactctgctgtgtctccccaggctgccctgccctccagccagacacaccaggctctcagccccaacccatggacctgcgggtgggccagcggcccacggtggagcccccaccagagcctgcgctgctgaccctgcaacacccccaacgcctgcaccgccatctcttcctggcaggcttacaccagcaacagcgctcagccgagcccatgagggtaaagacagattgccccagcctccctagaccttagctctagcctctattcctgcccctcctgagcagtcagctctgtccacagctctccatggacccaccaatgccggagctgcaggggggacagcaggagcaagaacttcggcaacttctcaataaagacaagagcaagcgaagtaagggtcgggctcgtctcccctcttctctgcctgggtgtctgggaggggtgagtaggaagggcaccatttacttggatgccctctgttggctctgcctctgaacagaggtaggtgtgggagtgtctagaggcttcacaggatgggtagggcctcggacttagtagccagctctcttggctgaggaatccctgagacatcctgtactgaaaatgtggccttggcagtttacagagaatgtacccaagagacttcctatccacctgttgccagcctttccatttctctgcctctacaggtgccgtagccagcagtgtggtcaagcagaagctggctgaagtgatcctgaagaaacagcaggcagcccttgagagaacagtccatcccagcagccccagtattccctacaggtagctcgctgtccctcaggtcctttcagtgctccctcatctctacatactcacctgtgaatgtgcacctgtgagtgtgcacctgtgggtgtgcacctgtgagtgtgcacttgtaggtatgcacctgtgagtgtgcacctgcgagtgtgcacttgtgggtatgcacctgcgagtgtgcacttgtgggtatgcacctgtgagtgtgcacctgcgagtgtgcacttgtgggtatgtacctgcgagtgtgcacttgtgggtatgcacctgtgggtatgcacctgtgagtgtgcacctgtgagtgtgcacctgtgggtgtgcacctgtgagtgtgcacctgtgagtgtttacctgtgggtatgcacctgtgtgtgtgcatgtggcccctctcctcccccacacccatcacgtgtttcttactctgtgcctaaatataatctccaatcctcctcaacccatagctgctctcctcttcccttcagttttctccctacatctcacctgaggcccttggcaagcacagaaaccctggttcctagaaaaggctcctagtacaggagccgctgagtctccagggagccctaagctccaaggctttgggatttatacctgaagcagaacatctgcattagcacgggtggcccactactgccacctggagatgcctcctgccatgctggctccacactgcccagctctgttagtggctgctttcctggcaggcatgcttaggaaagaaagtgcctgtgccaagtgagattgcaggaccttggggcatcctgggcttctgaagtagccttgacactcaccctgcagaactcttgagcccttggacacagagggtgctgcccgctccgtgcttagcagcttcctgcctcctgttcccagcctgcccactgaacccccggaacactttcccttgcgtaaaacaggtgagctgggcagatggggacctttgaggggctgagattaaacaaagggcctcagatttaggtcaggagtatggggtcgaggtggattgggacagttagcacactgcttataacccccccccccacacacacacacacacacatacacatacacactggctttgcttttttctctttttaacccatagaggagggatgttaaagggcacagaagaggcctggcatgatagtgcagcactcagtaggcagaggcgggtggatctctgtgagtttgaggccatcctggtctacatcgtgagaccctgtctcagagagagaggaagagggagagaaagagagagagagagagaagtagagaagagaaggctggctggcctatcgaaggtgtgacgctagttcctccacagtgtctgaacccaacctgaagttgcgctacaaacccaagaaatccctggagagacgcaagaatcccctgctcaggaaggagagtgccccgcccagccttcggaggaggcctgccgagacccttggaggtaagaggcaagcccggggccctggagtggccttacatgccatggtcccttctttgggccacgtggttcctccaacgtgggactgctgaaattgcgggagggcgagtgggggctaaaaacctaaccccgctgagtctcctgagctgacatttgctgggaaagtgagaactgctcagaggtgccgcagcacaggggtgatccaggggtggtccggcagctctccagtcctccagggagaaagcggtagtccatccagaaggaaagaagctgtggctgagagacctgtccagggtcgtccattcctcacccttgaccgtgccttcctttttcctctgccctcagattcctcccccagtagtagcagcacacccgcgtcagggtgcagctcccctaatgacagcgagcatggccctaaccctgccctaggctcagaggtaaggccttgttgggcactgggctctcctgggggcagttctgagtctcagcctttttttccagcaagtggcctggcctggtttgaggtttcagggtctgggcagtcccgagcagggcctcttgggtgttctggggacggcataccaggggtagtgttccaggactggtgaccggtcaccctgctccccatggcaggcgctcttgggccagcggctgcggctgcaggagacttctctggccccgttcgctttgccgacagtgtccttgctgcccgcaatcacactggggctgcctgcccctgccagggtgagtggctggggcaccctgcccccactccgtgcttctccggcctctttcccgcctgtgtcctgttacctcaccttcatcttcctctcccggaatcctctccaactctgactttacctcttccaggctgatggtgaccgcaggacccattcaactttaggccctcggggtcctgtactggggaacccccatgctcccctcttcctgcaccacggtctggagccagaggctgggggcaccttaccctctcgcctgcaacccattctcctgctggacccctcagtctctcatgccccactgtggactggtgagtcttgccgcttctcccagaataggcaggatttgtgcaccctcacaaggggccaagctctgaggaaacctcgctctccagtccctcactgtttgtaactccttgccaagccttgcctctgctcgatgcccctgtgtccttctgtggctcccggggctccttccttacatccatctcattttttccagtgcctggccttgggcccttgcccttccactttgcccagcccttactgaccaccgagcggctctctgggtcaggcctccatcgaccacttaaccggacccgctcagagcccctgccccccagcgccacagcctcccctctgctggcccccctgcagccccgccaggatcggctcaaacctcacgtccagctgatcaaggtgaggggatcccgggaggggaggtgctaagggcatgcctaactgagcccctgtggacttaggaacttaggcagaaggaaggctagagaagtggctgccagagacctagtaagatgaatgtagccttatccaaccctctacccgccacccacccttctctctttcccacttctcagccagccatctcccctccccagaggcctgccaagcccagtgagaagccccgactgcgacagataccctcggctgaggacctagagacagatggtgggggagtgggacctatggcgaatgatggcctggaacatagggagtcaggccgtgggcctcctgagggcagaggctccatttctctgcagcagcaccaacaggtatggctgtgcccaaggaccctgaagaaacttcagccagaaggcttggggcttggcataggatggggaagggaaggagataggaaatcaagcaagacccatgccaggatgctgatgcgcatgcgaatgtgcgtgcatgcgtgcgtgtgtgagtgtatatgcatatattccagcagcctgctttctcaagtagaccctgcatctacttcttggcctttcacagaaccacacatactccatcttcacacttctcgctgcagctggctctcttgtatctaaaagtagctggggcaagacgagggagagcagcgagcattccctggctttagataaatagcctgggggtcaaggcagtgctcatttgccaggacccgtgcagcagaacctagacacacaagatgccttgaaaggcagatattggtcactttgaagctctgtaggctgaaagggtgaaatcgaggtgtgtgttgggtgggggaggggatgtgttctgggggcaaaggaaggagcatctgctgcactcaaaggtccctttcacaaggacaacaaaccttttcaatgaaaccttacctaatcatgtcagtgtgagttgacttttccccgcccacttatcttcgaagggctctatgaattgggaaacaggatttgaccagcacttggtggtgaaagtccccgcgcacatttagcatctcaggcagtcgcttgtgcttagtagcgcagtcctatgagaggtgatctcagacagcagactcagggcccaaggagttcttgtgaaatcaggacatcagtctgggtatggaacttcaggaaagtcaaagagctcatatctggaatgtgtccaggaaaggagtctatccggagggtccctccaccttgggtaggagcaggcggccaagtctgagaaaccagagcctgtggtcatgtttccctcaggtgccaccctgggagcagcagcatctagccgggcggctctctcagggaagccccggggactccgtgctgatacctctggcccaggttggacaccggcccctgtccagaacccagtcttccccagcagcacctgtctccatgctgagcccagagcccacctgtcagacccaagtcctcaacagctcagagacacctgctacaggtaaaaccagagagggactgtgaaggagacgggggtggggtgagggttggggcgggggaggtgacagggtgtgagtccacgtctgcgcactgcctttcggacagttccagaggtcacagaactctccctccatctttcttgagctctatggtgcctgtgaagccggcagattcatcgggactttaggaaacctaagttgacagtgactagcttttggttaaaggacaaagcggggcagtcaggggccagggcaggaatttgagtctgctactgcgaccagctcttttaaaacaaaagcaaactcacaaacaaaagccaagaacgctacttactactgctgtgcttggagagagagagaggcgggtttctgagttcgaggccagcctggtctacagagtgagttccaggacagccagggctacacagagaaatcctgtcttaaaaaaccaaaaaaaaaaaaaaaaaaaaaaaaagaaagagagaaagaaaatcaccaagtatcttagtgtcctagactctgctgtacttcattctgggttttagttagtcatcgtacctgcctaatgtcacaaacatgaagctatattttgcaccctgcttgatttattattattattattattatcactgattttttttaatagtgctaggaactggacttagaatcctgcttggattctggtcagctgttctgtttccacgctgctgctaccagctctgtactctggcttatctgtcagcacgttattacagaaagtcttgaatcctttaaactgagaatcttgtattttatcttttttttttctcttaagttcagcttttggagacaggctgtccctcccaggttagctttgaacttgtagctgtttttctcatagatgcccaagtgcgagaattacaagtataaatcaccatgcctcgctcagttttaaccttaattcttattagttgggagtttaaacatttttaattttaatttctttctctttgtttttgttgttgttttggggttttttgtttgtttggttggtttggtttaacaagacaggccttttctatgtagtcctggctatcctggaactccctctgtagaccaccagacttggcttcaactcaagagttctgcttgcctctgcctgcagagtgctgggatccaaggctggattccaaggcatggttcatccaggcttcagtttaattttcttcatttgtttttgagatagattctcattgtgaagtcctggccagcctgaagctcacaagcctgtgatccaccctcctctgcctccttagtgctgggatcaaaggtgtgcgccaccacacttggtctttaagttgtttctttggtctgggattatctctcccggctcactcttaaggagtagcatccctgggacaaacaatgtgagcattttgaaagtctctgagatgagctttatagacacggatccttccagcagcgatgtgtgtgtataaggttggcttctgtagacttcccttggggcaaactgaactacagttcctgagtaccctaaagggttgattctgggacctcaacaccaccttgtaaacctaccaaaaccatagatgctcaagtccttcatgtaaagcagcactgtgcttgcattaaatatatgtgtatctgtcttagtcagggtttctattcctgcacaaacatcatgaccaagacgcaaattggggaggaaaaggtttattcagcttacacctcccacattgctgttcatcaccaaaggaagtcaggactggaactcaagcaggtcagaaatcaggagctgatgcagaggccatggagggatgttccttactggcttacttccctggcttgctcagcctgctctcttacagaaccaagactacagcccagagatggtcccacccacaaagggcctttcccccttgatcactaattgagaaaatgccttacagttggatctcatggaggcatttcctcaactgaagctcctttctctgtgataactccagctgtgtcaagttgacacaaaactagccagtacagtatctttccacatatttaaatcatgtcttgtttttgcttttaatacctactacaatgttgatgctatgtaaatagtcttcatgctatttgcatattgtttacaaggtaaaatcattttatggatgttttccatgtgcagttgggagactggtcatgggattccctctcccaggctatgtgtgcatatatattttttttctttatttacatttcaaatgtttttttttttttttttttttttttggtttttcgagacagggtttctctgtatagccctggctgtcctggaactcactttgtagaccaggctggcctcgaactcagaaatccacctgcctctgcctcccaagtgctgggattaaaggcgtgcgccaccacgcccggcacatttcaaatgttatcccctttcccagttccctccggaaacccccatcccatctcccctccccctgcttctatgagggtgctcacccacccacccacgcacccctttcccagtctttaggtttccctggaattgcttttcctctgtgttggcagcccctggctttgtgaccagagggagatgtgcagtgataaatagttacagatcccagctcgggggtgggggggtgggggtggggttctactcacctttgactgtgtatgttcccagatgaaaagacacacatacagcctttatattttcatatgtcttagtcagcacaatagctgtgcaaactgccaccctccatgttgttagaatccattttcctaccgataactccgagttagtacttaactaatttaccatgttccatccttggctgctacttaacccaattgggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcctcctcctcctcctcctcctcctcctcctcctcttcttcttcttcttcttcttcttcttcttcttcttcttcttcttcttctctgtatcctccttctcccccctcttcctccttcttcttcctcaccccttcttcttcttccatggcggctcctttttccctctttcctagtgatctcctcgctccaagcccacaaaaactcaacccccacctatgtctcccagctattatttaccaatcagaattaactgggggggcagggcccctcagtgtcctacacgtggagtgtctttgaggcgaacggttttggaggacccaaattatcattagaatactagcagcattaagtcaacccactacaaggatgtcctgtgttaagtctctctgggtttagggcatgaactttcaaaggcataagaggtgtgttgggcctagtgaggagtaagaggacccagaagcattgaggcctgtgcatagggaaacatggctctccacagacgggttggagagggaatgcagaagtgcgcatgcctggctccctggctgtgggcgggtctccacgatggaggtctccctggcgttcagccctggcattggcttcctgcagggctggtctatgactcggtgatgctgaaacaccaatgttcctgtggagacaacagcaagcatcccgagcatgcaggccgcatccagagcatctggtcccggctgcaggaacggggtctccgcagccagtgtgaggtgaggaggtggggctatgcaaaaggaggggtgggaggccttagggccagcgaggaatggaagagtggggagtctgagcaaggcagaggcgtgagggagcaaggcttacgagttctgtgggtccttcctcagtgtctccgaggccgaaaggcttccctagaggagctgcagtcagtccactctgaacggcacgtgctcctctacggcacgaacccactcagccgcctcaaactggataacgggaagcttacaggtaggggagggagacagatgacatctggccccaagtcatctcaagcttgcctatctcacctacttctgtgctcttgacccagcttcctggatattcccatgctagcttgctgccctggcgacatatcctctcacacacccccacctcctgccgtctatccgtagtgctccccgccccacctccaccctctctccccgctgtccacctccacctgtatatttccctgtattgcctcctcctctatacctacttctcttagggcatccatgtcccttacttacacgacctgggcctttccccacaggactcctggcacagcggacgtttgtgatgctaccctgtggcggggttggggtgagtatgcctggagatctcaagtaggcattgccaagggctttcagctcttcgttcgggtctcttggcctacttccacccctctgccacctgtgacttgtggttttgccagactgggtaaggcagggcatcccctgtagccagaagctctttgtgataggtgtatcccagtctcatgagtgtcccatgagtgcagagcccagtgcctcaccgttttagaaggtatttggtaggtgttcagtgaggcttaaggtagggtcacactggggcttgagactcccctttcgttagaccccaggggacaagcattggccattcattccatactggagtgggtctctctctcgggaacctgaggtgtgccctgcttgatctctagacctcatgtggagctgtggggtacatcccatgtacttagaggtttaggaccaaggtttgtgtccctatccggggcacagctttccagctttgctcactgcctcctcctcctcctcacctgctgggaatctttctgccgcctctgacttggccttcctgtcatggtgccagacaaggcctgtggcaatgaggtggaggctgggtcctggagggcaagtgggagctatcaagggggctgttggggagccagccagtgccctgttcacaactccccatttcttgccactttctggtttttccaactgttgttgcttctgttttctcctccctcctctccctttctgtcctttctctctctctctctccagcctcttgcgactctttctgccttcctggcctctctcggtccgcctcgcccttcccatctccccatcatgccccccggcccctccctagccttgaggcccagggactgggtttggggggcctcccagcctgggctaggggccctgagtggaagacagtggtgcagacggcccctccagctccgaccgtcccgcggggcctgagcagagtcagctggggcttaaaacccctcccggcccaaaccccaatcccacccaggtaacgccatgccccctccccagactggggaggcagagtgctggccacacaggagctagtgctgggacttaacactgggaagaagtcctcctgggactgggggacacaggaggccttgcctttgggcggtggggcactggggaggcagctctgtctgcccagctcccctgcccctggggtcctggccatggggtgggtaccgcctcgctgggccctggctcctaaggaaggcactgaatgatgcagtcctgaccctggtccccacaggtcgatactgacaccatctggaacgagctgcattcctccaatgcagcccgctgggctgcgggcagcgtcaccgaccttgccttcaaagtagcttcccgagagctgaaggtagggactttagatagaaggctgataagctcgagagttggtgccagggtgatggcagtgagtccaaatcccagcctttagccttctcattccatgtggatactgccacagggttttgcaagggaaatcgggactggaaccgaggtggggcttgacccccaagttcatgtcacttacataatcaggccactgggcattagggttttggacagtcctggccatctgagatcatttagtggctgtagacgcatggtggccatttttgaatactacaggccgtttagggataggaccctgcctactaagtcaggggttgtacttattgttctaggacagttcccctgtgatgattccccagaagcgctcagtcccgtggtctgagagctcacagcccaaggcaggcactatgcgatcagtatcacagagcgcttggcaattgtcctgatttgagtatcccagccctaccgtgtgcagccacgtaacttgggttgtttaattcacccagctctgttttctcacctgtcagtcggggatgacgacaatgttctgtgctctagggatgctgtgaggagcagatgcagtgtctatgaagtactcagcatggggctgggcacacgtggtttttactagtagtcaataggtgtcactgtggtgacagccaggacctatcaggaagggggactgtgttcaagtgcagcctgtaagccatggcagctgcgtggagggagatgtctggacatctcaggggggcactgtgttgctcgtgccttttaatccttggagaaagcggctgggcgtgagaaacaggctcaggcaagtgtggaccgagaaaggcctgctgaaccgatacctgctgcttctcccctttcagaacggctttgctgtggtgcgacccccgggacaccatgcagatcattctacagccatgtaaggcattagagaggtggccctaggtggcatgaggtggggacgggcctccgaagccctcctgtaggcggggaagtgagaggatgggctggcaggaccctctctcctctctccaggggcttctgcttcttcaactccgtggccatcgcctgccgacagctacagcaacacggcaaagccagcaagatcctcattgttgactgggtaggtcctggttcctggtgtcatcagagccaggcctacctgcagaaccctgagcctgacatggaagatggggctgcacatctgagcttgtcgttagcctctaccttattaaaatctgggtgaatgcagcacccatattatagaacttccaggaggccaaaaatgctggtgtgtgggagctgctggtgtgcatagtgcacacttctgtggtggatgggagttcatttacagtcataactctgttggcttctatttggcagagcaaaccgtttcccctccaaattagtagccataacagtaatatctaagatcagtagattatcagtcacatctagatactgacagtagcccatttatagtcctgaaatagcgcatttcacagacaaagaaagcacctacagagattcctatcgtgactagtcactcacctcatgagatgggagacctagtcagctagccctggaatgtatgcctttgactaccaagctggggtctcatctgcatggacagatgtgaaagggacatgtctaagtagatactgaggacactgggggagttttccacatttgaatctatatgcagtcttgtgagttgagggcagacaacacccaggacttcccagaaggctgggtctgggtttttttaagctttatccctggcagtgtacactgttttatgactgtgcaagtcagtgaggagaatgtgtccacagagagataatcacgcatacacacacacacacacacacacacacacacacacacacacacaccccaatgtagagaagagtgtctttgccaggtatggtggcacaagcctttaatcccagtacttgggagtcagaggcagatgggtctctgtgaacttaaggctaccctggtctacatagtgagttccagatcactctggtccacatggtctcaggccactctggtatagataatgagtctcaggccagtcgagcctacatagtcagacgctgtcacaagacagtaagaatctttccatgcagagatggggaatcactgccagacagtagatgacttggggccactcaagtcatgcgatcctagaaactgtagtttcttgaccccgccagtctagagtcgcagtgttcggcatggttaccgaccttgaaatccttccactgtgtcctgtcctttatctttccgcttctggacggttcccttatccactgcccgctgtatcttacaggatgttcaccatggcaacggcacacagcagactttctaccaggaccccagtgtgctctacatttcccttcatcgtcatgacgacggcaacttcttcccaggcagtggggccgtggatgaggtgagtgtgtgctggagcagcgtcttccggtccgttgactctccccctgtctctctgcccctgtcctgtgtgataagcctgagcaaacggcttatcctttctgagcctcagcttctggaagtgaagaagtcggatgagctcgggactctgtcctcctcacgtcttccttgcatcctgttttccaggtgggaactggcagtggcgagggcttcaatgtcaacgtggcttgggctgggggcttggatccacccatgggggatcctgagtacctggctgctttcaggtaagtcctctggggtccaaaggaagccaggccggcaagactacctcccctcccattcccaccgccctaggttggaagtgatgagttgggttgtcagcctgttcccatttggtcactagatattgtaggccagctccaatttaatttaaaaaaaaaatgggacacagccaaacatggtggtacatgcctttaatccaagggaggcataggcaagcagatctctgagtttccagccagctagtctataacgtggaagagagagaggaacttggcgtccttaattgttgccctcatagagggatgggttcactttacaaactgccctggaaggagctttgggctcttgtaaggagcccctgtctccttcaccccaggtcccccacatctgtttaggaaaatggaaccctagaattagatctgtaagtccttttctggaggttctttcatgaacattaactccgcaggagcccctgagtagaacttcctgggatcggtgctgggcttaaatgcctaaatggacaccagcgttgggcaggggcaggcagggggaggaagaaggaggatggagtttggcaggcccaggaccagagggtctagtcacccttgtgtgctctcagacggccagttctacatagattgtgttcagtttcctccaaagtactgggtgtttcagtccccagggctgagtgaccagagtcgtcccgagtagcctgctgtgtgaagcacacactgtgcttgcaccccacacttctctgtcctgtccttgatatctctgcctccattctgcctcttgctcattaaattctctgcgtggctgagttcaaggctggggtaccagagccacagccagagtgaaggagatcagaccacgaatgccattggtgtcctacgggctggtgtcctcagcgaggttggcaggaggagctagcatggactggcctgcaccgtgtgttgggccgggttgacgacgcctctccttgcaacttcaggatagtggtgatgcccattgcccgagagtttgctccagacctggtcctggtgtctgctgggtttgatgctgcggagggtcacccagccccgctgggtggctaccatgtttctgccaaatgtaagggggcctcagctgtggggggagtcgtgaggctaagagccaggctgtgtagggacagggacacgctgccaagatgaaaggggcaggtggcagtggctatggtctagggctacgtgtaaggcctggattaggcctgcaggttagcacagcctcgcaggacagacctgcttctctagattaggccaaatctcataggtcagacccccggagacataggtctgccagaaggaagccccgttgtagaagccaggtctctagactgagctttggagagagagagttagaagattggtgttctcagaacagatctgttggtgtagttcactacaccccagggcctggagacaaagaggtagttgtggctgacagtgatgttgtgatccaagcctcagccctgccacctactagctgtgggaccttgtatataagacccttcgcttctcaaagcttagtctgaagcatatggacaggtgttgcactagggtctagtctttaagacacgatctattaaggaagatgcaaacgaggaaatggcggaggcaggaaatgggtctgcctctccttcagccccctactctctcttacctcaaccatcaaggttttgggtacatgacgcagcagttgatgaacttggcaggaggcgccgtggtgttggccttagagggtggacatgacctcacggccatctgtgatgcctcggaggcctgtgtagctgctcttctgggcaacaaggtaagccccctggcccccagctagctgtatttcagtggtgcagatgagcctggctctcgtggttatgggacaaatggggtagaaaacatgggaaggggtagggatggcaccatcctcttttggtagtgtttggtaggtggcacagtgggaccctccccaggtcaggtctagggccagcgtcttctgatgtcgcagagctagccaacaacagctcatgcctgtttgtgcaagctgagtgtggggtgcctcatggaatgtttctgtaggtggaccccctttcagaagaaagctggaaacagaaacccaacctcagtgccatccgctcgctggaagctgtggtcagggtgcacagtgagtttccccctggggcacttggccaggtccaaacttgggagagtctcaagggcccaccatcctggggaccagagtctcagagatcccagtgccagccaggtcagatgcacactgacagctggggacaggatgcccaggtaccacctcctcaggagtaatggtgggcacagccccatgattgggtaacccagccctcccactgaacaaaacagtggcttcctatgacaaggactggccttccatctctggctgtatagtcttgggtcaggggtctgacagcaacactcaggtcttgtttgccaaaaaggcttaacctcttcagtgctggtcacggggactggaaagctgtgggaagggcctgcctggctctcagaatataaccacttcaaagagcccacattatgaaaacatgttaaagattcagcttcaacgaggtggaagctagttcgacactgctctgggttacacactttctgtgaaggccgagagtctctgctgggatatagtggcaaagtacattcctcatattcagggcttggctggggaaccagacagaaagccacagatggagccgactgtggaacctcctatgggccaggttctgcactgagctgggccaggttctgcacgtttatcattctgtcaaaacagcaggatgatgagtgtcccgtggacctgaggtgtgtgctgagcagctgtggggatgcttgccccttctgcgtgccctggttttcttacctactaccccctccccccatccttggttccggggattgaaccagggtctccctaggcatttactgctgggctccagctccacctagctctttagttgtttggtttccgtagcgcaggctgccttccgacttgtgatccttctatctcggctctgcctgctgggattgcaggcatttattagcatgctggctcctagggataggccgcataaggaccctgtgctctaggaagctaaggcaccagcataggagaaaaccttgacataagccaagatgtaggcacaagtgactctcctggcctttgggatccacacaccttttattatgtatgcttgggatttttggagacagggtctttctctgtagccccggctgtcctggaactcactctgtagatcatggccctgaacttagtgttccaactccctcagcctcccgagtgctgggattaaacctgtgtgctactataccattgttttttaaattattttgcgccatgtgtgtgccatacccctattggccagaagagggcgtcagatctctggaaccaaagtttgacacggtggtgacctactaagtagacacagagagtcaaacccaggtcctctggaagagcaaccagcactcttaactgctcatctatctctccagcctgtgagagtggaactttagccaaggaggatgcgaaaggggattagttatctgtggagatggcctcatagccatattgaatctgccctgttgcccaggggtatagggaaggggtgagttgggagagggtgttttgctgagagggcaggaggggaggctggcccccaagctgatgatgtggccactatccttgggctctgggcctgagtccccagctgtggtattatttgagctatatctaggatataactcagcttgtcttccccagttgacccagcttctcgtcctagggaaatactggggctgcatgcagcgcttggcctcctgtccagactcctggctacccagagtgccgggagctgatgcagaagtggaagccgtgaccgcgctggcatccctttctgtgggcatcctggctgaagacaggtaacaccagatccctagccccaagcccagggccttcgaatctcctcggatcctcccatgtcgaagacctcagaccccccatgcagctaatctctcaggcctttaaagcctgactatgagggtaaccccaccaaggcatgcctacgtctcgtggctctcctacaccccgcccttgtcccattcccaggccctcggagcggctggtggaagaggaagaacccatgaacctctagggtttcagaacagatcgcgcttcaaatgtggctctcctcgtctctgatgtcagccctggtcctgggtcttcagagatcctctgggcaggtagtcaggtccagagcacagcctaccctgacggctatcccaaggaacttgagaagaccatgggatctgggtaggggaccagggaggactctgggaggaagcaggttgggcactagggcacagctgggctcttccagaacagattaggccgtctggtgtccacacccctagctgtggtctccatccctccctcaggactgcacagagggggactggctcaactgggccacccataaccactattcttaacttggcctcggccagggtggcctttctcaggttctgaagggctaggagctggaggagccaagggtcccctattcctgagtacaggagagtttcctctctcctgtttcctcaaatgcctttctggtagctctgggctctgagagccattctgagctgctctctccctgtgagtagtagtcacctgcaagtctcccatcagtcactgtctcgccagaggccaccctatgtggaccatctcagtgccccggtgcagcagacaggtgctctctgagtcctgtgtctcctaacccaacggtgccaaaccttcatctcccttcaaaagcacaacacaatcccagggatgcctggtcactgtccccagtatgagccttctgtttctggggtccctcccacccctcagctctggctgctgccccacataggactagcttggctgaggggaacaagatgggagagtagacagacatgggggaggggaggccaccccagaagtcttcgaggcttttgaggtttaggtctgggaccaagaaagagtatttgtgtgtatgtgtgtgtatgagtgcgtgcaagagggtatatgtgtgtgtgtcttcccacaaccccaccgtaccttgtctatgtatgcatgtttttgtaaaaaagaaaaaagtgaaaaaaaaaaaaaacaaacttctgaacaatatatgttttatttgctttaaagtccttgggagaacgcctcctggatgttggtgggacatcgtcagtggagtgggtgtgcacccagcatcctgtgatgggctggggaaaggggacaagtctggacctaactcagaccctctagtcccttgtccttccttggctaatacatgcaggaagaaaccactccaaatacatgctcaccaacccaggtgaaaagggagatggccccaggctgagccctgcacattgggccctgtgggattcgggaataagatctcaggttcaggttgctaagacaccgcaaaaggttgtgacgcaggcacgcctggcttaagccaggcctagccgggaggtcagtagtctttacctcctctatcagtaggagcgtctaccagcagaaggctctagaagtgacactgttccttatccttccctgctctaaagtcccatggtgtttttacactgtaaaggccagggtgaggcaaacacaggccaggacaagtgtacccagcgtgagggaggtgctagctcctgcctttctgcttctgaatccacacatcctggtcaacttggagccccaagtagtctggctggggtagaaaaagaaagattccctttcccatctaccttggcttagggtggggagatggaatctgcagggatgttgagtctgtgggcatcctaaccctggctgggacagaactgggagagcaaaggagatctcagctggtggtctccccataggggaccagagatgaggaataccgtcaagtagccccaaacttagggagatgatcaaacagctagagccccatcttgcccacccttgtcccctctcaaaaccgccccccccaaagaaacaccctgaggctggttaaaatggccgctgtatttctgcttaagtgcccataacacaggtaaggcagagagctgggggcagtgcccaagtggaagagtagacgtgcaaagtgacaacccatcagagaaggttacagagaagagtagcagcccctgccctccctctccgcttaggtaaggccttgggcccatgtccactcagaagagttccttcaggagagagagaaggtgaaaggtcagagttaggatctggtgcagggaggaggtcctcacggtcagggtggtcttgtgcagtgaggggcaaggttggagactcagtacagatggagagctcccacttgcccccaccaggttgcccccgatcccaaagcccttctaagtgcaggggtgtgtttcctgtggtcctcaagtctagcctcatccgaggagtcctgctctggtgtgtgtggtcatgtgtgcatatgcgacacatgggaatggttggctggcgctagcaccctcatgggaaacaaactctggatgggaaggtaggacggacggacgctggattctgtccaactgtgctgcttagggaaggagccaattgtcaattccctaaggaccggtgagtttggctacccgacacttcagggtaacagggtggggaacaggggatggagatctgtactaaagattcctctcttgaccagacctttgatgcctcccccacacacagcttcaatgaagtctggggtagcaaggaagcctgtcccagcccctgtcactagccatagttccaatcctacccattgaattcattgtcgtggccctacttacagagatccctcagagggctaagaaaatagatctatttggaaaggtctaagctgccctctagctgggctaacgggcagattgggcagattggcagtatccctttaacagctctatatcttccccaaaaggggaccagacagatttctgagaaactgaacgggcccatatactctgccatggttctggagttccccaggggttggggtgagctcccttgctgactcggaagctgagtccagatcccgagggcccccaggctgtggtgacctcattccctgggttagaaatcactaaggatgctgatgtccgcaaagtcagcccggtagcggtgggcgtagaggctaagtaggaaggcccacttgaaggaaatgaagctccagacacaggagaggtagtagctgttcgggtctttgagacctgcagggaaaagagccagacggtaacttgagagatctgcccacagcatcacagctaggagccccttcttcccactccatatccttccagcctcctgacctctgaaatcagtgctatcaaagaatcaatagaggtgggcatgtgatgcaggtttagagtaacgaacactgcatgtttggttacaaagctgggatcgtgaaaggaggtcagagatggccagcaggtctgtacccatcccctgcttctgtggcacacgcccttccaacctacatcacggatacaaggatcagcctctgctagttcttatcaccaccaccagggggcgctgcccgcccgatgctaggcagagattaaaggacccccagcaactcctaccggactcgaaccctcctacccctgaggagatgggggctctcattctccctatttcaacaataaggagcccgggcagtggggaaagggtcaagcaagccatccaggccctctcccgtcctcctttccctggacggtcctcactctgatgctgggtgatggccaatgccaggaaggtgcagaaggcggaaacggagactgccgagaagagagcacccacgaagaagaagccgcgcagccctctgagccaggtcctccagtaatcctgcatgtacatcacgtgagtcaccaagacccacagtgccaggacacctgcggggacagactcagtcagcagcacccaggcacctgcctgcctgccaggtcacctggcatctagcccagtggcgtctacctaggagggcccttgaggtccactaggccagatctacctgcacgatcacaccaggactgcacgatggctctcatgactgtgatatctgtgagatgtgacatcaccaccacacctatctcgaaaatactgttagcctggtggcagtggcacacacctttaatcccagcactcgggaggcagaggcaggtggatctctggattcaaggctagcctggtctacagagcaagttctaggacagccaagactacacagagaaaccctgtctccaaaaccaaaaccaaccaaacaaacaaaactatcttaaatatatcttctaaatgcttaaaagggtgtcagttttagtttctaatacgcatatgtccatagatagaattctccctaaacaggatttgtttggagttttactctgagacctttatatatagacttcctgatgcctatctgaagccattgaagtgatgaagaaggccttctcccacgctcttcctctgcctggtcccagggaccacaccctccaggccctggagcctgcagctgagctcttgggcaccagggctcttctcaactctgcaccagtcttgggggaaaaaaaaaaagggaagccctgtcatgaggcgcccagggccacccaccactcaagtggcctacttgctttggctgaagcctactacctttcttccagtgtgtggcaaagggcagcctaacctcccagacccttctgggcatgccctctgggcctgtgggcacctctcctagcatgccagctgctctcagtccataacaatagaatccaatgcaaccctccgtgccaggcagtgcctgctggtgcagttcaaagaacaaacaaatgccaactccattggcaaggccttggagcagggccgtggggccaagcaaaggaagacggagggaagagagccggccagctgtaagctctcaagacagacgtgggttgtgggctggccctgcaggctcctgcatccagaagcagggagctttttcaaatcatcagatgcatacagcagaagtgctgtgacctttcagagggacagagggaagcaaagggaccctctgacggcccccgagcgtcttattccttaggctgggaaatgagcgcagtctttggtgattgaatgtttctgctcctgacatgccaaagatgttttaaacttcttttaggttaggaggcccggggtgcagcgggtggcaaatgaccagcttaattgtcgcaatggggcaaaaacaaagcagggataatagaaaccaggaaacctagggccaaggcactgctttgtccttggagctgccaattgtaaaacagagcaagccctgaggtccttggccggctggataagcacctacctacctacgctgctttccctacctgctcgcccaagaacattccccaccccccaccatcaccatcccttcagttcagcccaaactggccctcaaccttcctccgaggaatgggttcgcatcaccccggagctctgggtggagaaaaacaaacatgcctccatctatcttggcagaaagccgcagcaggacagaggaagccagaaccctaatccttgctttaccctccatgatctggattttattccagcaacctccacagaagtcttccctgcccctcacgttttcacctgcagggagttggttgggtgcttaggatccttaggggtgctgaggattgaacccagggctctgtgcgcatgcaaggggctggctggctttacccgtaagctccacccccgagtacgtgggcttttgttattgagcatttcattgcagggatagtccagttccttcagagacttgtccaatcgcctcacacaagaggtgcaacagccgagttctaagatcctttcccacttgaggattctggagtccagcttaggaggggaaggtggtcagagcagttcctctgtggctaagcagtttccgggttagaaaacgctaaactagaaagtgtgcagaccaccactaagaagccatctcagaccaccagcccgacccaggggtcccccaaaccctcacctccacatacgcccagaagtactgagagcaggaagagaattaggaagggggctcaggtggccctgaacccacctccagccctatacccaggccttctgcagggcagcatgctccagctggagggctcatctcatcctggccctccttggagcgatacgccctccacaagtggtcacccaacgaggaagtgtccctcccaggtccccttctctactcttgtgggaagcaactatattctgcctttctctgttccctttcctgagatacttggctccgagatgcctggtctatacaacttggagcagaaaggacaagtccccagccccaactggctgcagcagcaagctagatctcaccctggctccctctgctttctccaaggctagacctgcctaggctctgggttcctaggcctggtaagagaaagcacttccagctgcccgagggagcctatagagtaaatacaggcatttggtataggagtctgagaacacaccccaggcctgttgctctaccctgaggacaaaggagacccagggtgctagagggcctctccatcaaagctcaattgtgaagaatggagatgtttggatgtgaggaacaagtactttccatggtttctagacacagagcagacatgttacctagggctcccagtgcagagcggggtgggggtgggggtggggggggtgtctgataggcctctccagcaaacccacacttttttaggccactgccgttttgcaaagtcacttcctcccagattcctgccaggataagagtaggtccccacccccagatgctcatacataccgtgttccagaagccagcatgcccgacagccacagttgaccaacacgggcaaaacccactaggatggaccctgtgactcagcaatttctgggctgcaaaatgctgagtcagaagtggagtgcttgcaagtcagaaaacctgctgacattccaccctaaaagaggaaggagggtgactgcctgtggacccccctgccccaactcatgccgggtcgggaatgagtgcccacccgccccctccaccaagcagttttggctcctcacaaccacctcaggttgccaatgtccaaacaacctgggagttgtgtgttcctgtcccagctaattgtggccacgtgcctgtctctgaaggcagcttcgaggctagcctgcctcaggtcaggcaagggtgtcaaggaactaacaagcagggtcacagggaggcccttgtggctgccaggagtgggggctggtaccctccctccactctttgttgttgttataagacagggtttgtctgtgtaacccaggctgtcctggaactcagagatccacctgcctcagcctctcttgagtatcattccctcctagcgataagcagccagacacagcttgggagagtggacagtagcactcagcactgcacgcccagaggggagtctcagtcagcggcatctcctgccagcaggcactgccatgcctcacatggctccctccactggcctgactctgaaccaagtcagctgaccccagcaaagcttttcctccctccagcatccagagagcttatctcaagcctcagcatccagccctgggccaaggcagtgccttccaaacctggcagcagcagggccaataggaagtgtggaggagggcagtagaggggaaaggctctgtgcacaagtaggcttgggtgctggctattccagaaaggtcaggagtccacaggtgccccccaccccccaacccatacagggctcgagaattcccagccagagcatcaaacccaaccttcatggtgcccccagtctcttgcttggcacgccttaggtttaggagacgtgcatgccctctgataaggcagaaaccccacctccggccctctctctctctcagaacggcacttggtgcattcagaggccatgagtgaatttgttttggttttttgagacaggatttctctgtgtagcctaggctatcccagaacccactctgtaaactaggccgcccttgaactcagaaatccgtctgcctctgcctcccgagtgctgggattaaaggcatgcaccactgctgcccagcataaattaattctttcgagttactccatttttagatctttggccaaggattttagccatggaataaatgttgtatcttaaaacgttttccttacacatactttcgccatacatattacttcatgtggctgtcgtactgttgggttagtttcctccatagggcttttaatgcctttagcataccaacctgaatccttctgagttctagggatggaaatcgggtcggccaggctaaggctgagccatcttgggggcacatcgtgtggctgttgaaaccctggacacattatttatttaccgtaagcctcgattgatttttttctaactgtaaaatgggcacaaataatgttacttcagaggactactattaggattagatgacataaggagagtagatttgtttagcccagcaaaaaaatattaaatgatgataatacgtgtaaataatatatttggccttcacacagagaggctaaacggcgtgaccaaaattacacattagagagcacggctgggccttcgccacctcctcgtccctcagggattagcagattcccactggttccgaccagagcagatggacacaggtgtaaagggaatgtccagtgacaccgggtccacagtacagtcctggtctcggcagagggcctctggggctggaagggggctggctgatgggtttccccacgaaccccacttattataagagatgcggtaatcccgcacagtgtgcgtgttgagggagcgagggtggnnnnnnnnnnnnnnnnnnnntgtggtcgtttgaataggaatgggccccatagtactcttgtgtttgaatgcttggcccatggggaacatggctgttaggaggtgtggccttgttggaagaagtgtgtcactgtgggggcgggctttgaggttttatattgcttaagctatgcccagtgtggcccttagtctcctactccctgcagatcaagatgtaaaactctcagctctttctccagcaccacatctgcctacatcatcctgcttctatgtttcctttatgatgataatgaactgaacctctgaaactgtaagccagctccaattaaatgtttttctttataagagttgccatggttatggtgtctcttctcagtgatagaaccctagctaagagagctacataagagtctctgagtctctcaatctctctctctctctctctctctctcttcccctcccccgtgtgtgtgtgtgtgtgtatgagagagagagagagagagagagagagagagagagagattaaaaagtgatcactgtaccaggctcgggtaaaggcatatttccaggcccggcgaggcctttctaccctgacactctacgtagatgtatctgagctgaaccaatgccatggattcttgagcaatgactacaggcagcaacagcacagggcatttctaggtgagactcatgaagatatcctatatgtcctgaattccctccttccactgtgatgaccccagaggctgtgttgaacggccctgtggggtcaggagtaaatgattggggccaaggcagtcaacccctctgtctccccaggtcttcagtggatcctaacagtgagtgtgccctgcatatttatggggttacaccgctgggcttaggggttgcctttatcctcagccactctgtcattcctcttcaggccatctgaaggacacttgtcttgactgccagtctctgaagtcacttttgaactttcccaccaatgttggtaactccctttggcagacatcctgcctcctaagaaattccttcctccctctcccccaaagacacattccggacatttctcttcctccacggtgctagggctacatccactaagctatcttccagaaacctgagttaagccctgcaagggcttccttnnnnnnnnnnnnnnnnnnnnctggcctagaaataccgtctttaccggagccggctacaatgatcatttaaaaatattttgtatatgtgagcacactgtagctgtcttcagacacacaccagaagagggcatccgatccc

SEQ ID NO: 1892 - DNA, 2858 bp, Mus musculus
ccccaggctgccctgccctccagccagacacaccaggctctcagccccaacccatggacctgcgggtgggccagcggcccacggtggagcccccaccagagcctgcgctgctgaccctgcaacacccccaacgcctgcaccgccatctcttcctggcaggcttacaccagcaacagcgctcagccgagcccatgaggctctccatggacccaccaatgccggagctgcaggggggacagcaggagcaagaacttcggcaacttctcaataaagacaagagcaagcgaagtgccgtagccagcagtgtggtcaagcagaagctggctgaagtgatcctgaagaaacagcaggcagcccttgagagaacagtccatcccagcagccccagtattccctacagaactcttgagcccttggacacagagggtgctgcccgctccgtgcttagcagcttcctgcctcctgttcccagcctgcccactgaacccccggaacactttcccttgcgtaaaacagtgtctgaacccaacctgaagttgcgctacaaacccaagaaatccctggagagacgcaagaatcccctgctcaggaaggagagtgccccgcccagccttcggaggaggcctgccgagacccttggagattcctcccccagtagtagcagcacacccgcgtcagggtgcagctcccctaatgacagcgagcatggccctaaccctgccctaggctcagaggctgatggtgaccgcaggacccattcaactttaggccctcggggtcctgtactggggaacccccatgctcccctcttcctgcaccacggtctggagccagaggctgggggcaccttaccctctcgcctgcaacccattctcctgctggacccctcagtctctcatgccccactgtggactgtgcctggccttgggcccttgcccttccactttgcccagcccttactgaccaccgagcggctctctgggtcaggcctccatcgaccacttaaccggacccgctcagagcccctgccccccagcgccacagcctcccctctgctggcccccctgcagccccgccaggatcggctcaaacctcacgtccagctgatcaagccagccatctcccctccccagaggcctgccaagcccagtgagaagccccgactgcgacagataccctcggctgaggacctagagacagatggtgggggagtgggacctatggcgaatgatggcctggaacatagggagtcaggccgtgggcctcctgagggcagaggctccatttctctgcagcagcaccaacaggtgccaccctgggagcagcagcatctagccgggcggctctctcagggaagccccggggactccgtgctgatacctctggcccaggttggacaccggcccctgtccagaacccagtcttccccagcagcacctgtctccatgctgagcccagagcccacctgtcagacccaagtcctcaacagctcagagacacctgctacagggctggtctatgactcggtgatgctgaaacaccaatgttcctgtggagacaacagcaagcatcccgagcatgcaggccgcatccagagcatctggtcccggctgcaggaacggggtctccgcagccagtgtgagtgtctccgaggccgaaaggcttccctagaggagctgcagtcagtccactctgaacggcacgtgctcctctacggcacgaacccactcagccgcctcaaactggataacgggaagcttacaggactcctggcacagcggacgtttgtgatgctaccctgtggcggggttggggtcgatactgacaccatctggaacgagctgcattcctccaatgcagcccgctgggctgcgggcagcgtcaccgaccttgccttcaaagtagcttcccgagagctgaagaacggctttgctgtggtgcgacccccgggacaccatgcagatcattctacagccatgggcttctgcttcttcaactccgtggccatcgcctgccgacagctacagcaacacggcaaagccagcaagatcctcattgttgactgggatgttcaccatggcaacggcacacagcagactttctaccaggaccccagtgtgctctacatttcccttcatcgtcatgacgacggcaacttcttcccaggcagtggggccgtggatgaggtgggaactggcagtggcgagggcttcaatgtcaacgtggcttgggctgggggcttggatccacccatgggggatcctgagtacctggctgctttcaggatagtggtgatgcccattgcccgagagtttgctccagacctggtcctggtgtctgctgggtttgatgctgcggagggtcacccagccccgctgggtggctaccatgtttctgccaaatgttttgggtacatgacgcagcagttgatgaacttggcaggaggcgccgtggtgttggccttagagggtggacatgacctcacggccatctgtgatgcctcggaggcctgtgtagctgctcttctgggcaacaaggtggaccccctttcagaagaaagctggaaacagaaacccaacctcagtgccatccgctcgctggaagctgtggtcagggtgcacaggaaatactggggctgcatgcagcgcttggcctcctgtccagactcctggctacccagagtgccgggagctgatgcagaagtggaagccgtgaccgcgctggcatccctttctgtgggcatcctggctgaagacaggccctcggagcggctggtggaagaggaagaacccatgaacctctagggtttcagaacagatcgcgcttcaaatgtggctctcctcgtctctgatgtcagc

SEQ ID NO: 1893 - protein, 933 aa, Mus musculus
PGCPALQPDTPGSQPQPMDLRVGQRPTVEPPPEPALLTLQHPQRLHRHLFLAGLHQQQRSAEPMRLSMDPPMPELQGGQQEQELRQLLNKDKSKRSAVASSVVKQKLAEVILKKQQAALERTVHPSSPSIPYRTLEPLDTEGAARSVLSSFLPPVPSLPTEPPEHFPLRKTVSEPNLKLRYKPKKSLERRKNPLLRKESAPPSLRRRPAETLGDSSPSSSSTPASGCSSPNDSEHGPNPALGSEADGDRRTHSTLGPRGPVLGNPHAPLFLHHGLEPEAGGTLPSRLQPILLLDPSVSHAPLWTVPGLGPLPFHFAQPLLTTERLSGSGLHRPLNRTRSEPLPPSATASPLLAPLQPRQDRLKPHVQLIKPAISPPQRPAKPSEKPRLRQIPSAEDLETDGGGVGPMANDGLEHRESGRGPPEGRGSISLQQHQQVPPWEQQHLAGRLSQGSPGDSVLIPLAQVGHRPLSRTQSSPAAPVSMLSPEPTCQTQVLNSSETPATGLVYDSVMLKHQCSCGDNSKHPEHAGRIQSIWSRLQERGLRSQCECLRGRKASLEELQSVHSERHVLLYGTNPLSRLKLDNGKLTGLLAQRTFVMLPCGGVGVDTDTIWNELHSSNAARWAAGSVTDLAFKVASRELKNGFAVVRPPGHHADHSTAMGFCFFNSVAIACRQLQQHGKASKILIVDWDVHHGNGTQQTFYQDPSVLYISLHRHDDGNFFPGSGAVDEVGTGSGEGFNVNVAWAGGLDPPMGDPEYLAAFRIVVMPIAREFAPDLVLVSAGFDAAEGHPAPLGGYHVSAKCFGYMTQQLMNLAGGAVVLALEGGHDLTAICDASEACVAALLGNKVDPLSEESWKQKPNLSAIRSLEAVVRVHRKYWGCMQRLASCPDSWLPRVPGADAEVEAVTALASLSVGILAEDRPSERLVEEEEPMNL

SEQ ID NO: 1894 - DNA, 35143 bp, Homo sapiens
cttatgataggaaagatggtagttagacatcatggtgaacttcctatctcagggactggagatactggagcagaggagtgaggatgaatgtggaacttatgtctttgagggctttttggaactgagaaatcttagggtagtgtggactaggggagcccactggctcaggaattccctaagtgggcagagcagtgcaggggcaggccaggctataagctgaaggccatgggtaataggaagtagatgcaggccctccaggcctgccaccgcaggaagtagctatgccctccccttcacaatggacttgcagggaaggctgagtggtggcccgagaggtcccgggagttggacagggctgggaggacccctgtttttctctgtcagaggacagcaagggtctccagagagtgccagacccagaaaccgacagccatacgcaactcagaatggcccagctccccggcctcaggttctgccaggtcttcatccttgaggagaggccacagggtggagctggggatctggggtgggggacaaagaaccagggaggatgctttcccacccccagggagctcaagccgctgctgccatggttacatctgcttcctgtttgattcatctcaaacagcagaagtggaggtggggtgggggggcgacactggctcccagctcaggccactgctgcgtggggctgtttacaacagccgcatgtgggattcccagaaagagactccaaaccggacatcctgcggctgcaaaatacccaggtgtcaagagctaaaaatagctgcctcagggccccagctgccctgaggtggcggagaaagaggcatgctcactgttgccacccttacatccagcctcctgtttggtgtgcaggagcttctctgtcctcttgcctcggactgatggaggccttcgtctgggtaggcagacatcccggctggctcacctggcagctgagcctctgccctgatgggcagctggctcctctgcctatacagagaaatggtgcagcttgctttgggacgctaatgagagagtcctagagggacttgggagcttctagagaagggatatggcagggcactgagagcaggggagttggagctgagggtcctctaagaccccaacccattgccagccccctgtttccagcacacagtcccaaatcattgcttggtttctacaaagtcaacagttgctccaaatgattctttgagattgtcttcatgggcacccaaagatgacatagcttctgccctctcacctgcgcagggctggggattgctgctggcacgggtctctgtggggctgtgtgattttttttttccatctttctgcatgcccatctaggtcctgcatgtgtcctttgctggctggcctgtggcgaatgggaatgctggggaggaggggtggagtgtattggttgagagcgtggattctgaagcccaattgcctgggctcaagtcccagctcaacctctgccacttgtctgtgacctcagacaagttatctaatactgctgggcctcagcgtactcatttatctaatggggataaaacagtaaatacctcataggtttgtcatgtggactagataagttagcaaatgtagggtacttagaacaactcctggcacataataaggtgttcgcttacaaaagttcaggtggaagagaaagggaagagagcatagttgggagaggctggggataagagatagggcagggggctgggcacggtggctcacgcctgtaatcctaacactttgggaagccgaggcaggcaaatcacctgaggacaggggttcgagaccagcctggccaacatggcaaaacaccgtctctactaaaaatacaaaaattagctgggcttggtggcttatgcctgtagtcccagctacttgggaggctgagggatgagaatcacttgaatccaggaggcagagtttgcagttagctgagattgtgccactgcactccagcctgggtgacagagcgagactccatctcaaaaaaaaaaaaagagagagagagagagatggggcaggggcatgcattcaggagaaaatggtctgtggtagaggagggaggagagttgggagcagacactgaaacgctaatgccaggaaggaggctgcagacaagtacaggaggcaaactaatactcgctaccacaagggagcacccaccatgtgctgggtgcatcacagacagcattgctaatctcaggtgacctctttgaagtaggtattctttttgtttgtttttgtttttgtttttgagacggagtcttgctctgtcgcccaggctggagtgcagtggtgcaatctcagctcactgcagcctccgcctcctgggttcaagcgattcttgtgcctcagcctcccaagtagctggactacatgctccccgccaccatgcctgactaatttttgtatttttgttagagatgggatttcaccatgtcggccaagctggtctcgaactcctgacctcaagtaatctgcccgccttggccagggcagaacttccccaaagttctgggattataggcgtgagccacctcgcccagcctgaagtaggtattcttatctcctgattacaggtggggcagcttaagcaggttaaattgtgtttctggcttgctttgccagtcaccgagggagtcggggcttaaacccaggcccatctgaccgcaaagccaatgtcctgtgtgctttagaccttcaattccctcacagtttgtggcctgccagacttcatgtggcaggggcttccagcccactctcagctccctgctgggttctggataaatctgagcaagaagcattcagtgccaatcaatgagcagtatagagaatttctggaagggagacacaagaagctgttagaaagggcggcttccagggaagttctagggagtctgggatgaatgagaaacttatcctaacaacttttgggctctctgaattttttttagtatctgcaagtattgtacttgttcaaatatgtttaaggctgcaggctgtattctaaactccttgaaagtgagaaccaggtttcactcatatttccatcttttcaacccctagatcagtgacttcccagggaagtagtacctgcatttggggttgacctttgggtttcccctgtactggtctggcctggcctggctggaccactggctggctgggtggctgtgacctagccccttctttctctttgctcctctgtcaaatgagagtgttggtctgaacgatctctaaagcctggaagaggagcagatcctctgtgctcagcccccactctgtgtcagggaggcctggcaaccacagtgttctttctcctgtttatttgttcttggatcttcctgaagccatttcaccaccagccttcatcttctctgccagccccatggagactcaagctttttccagcctatgtcagggaaggagaaccagagacagcaacctcgggtgtgaagggagtcagctctgaacccaggactatggccttctgccactgcctgctttcctcttgctgctggggcctaggtcttcttgctgctgcttccttttccgctaatcaagagtccagggaggtgggaacagcctcaacaaagactttgaagatgagcggggaggatcgcttgagcccaggagcccagcctgggcaacaggggaagacttcgtctctacaaaaaaaaacaaaacaaaacaaaacaaaaaaaatttagccaggcatcgtggtgcatactgtagtcccagctactctggaggctgaggcaggagaattgcctgagcccaggaggtcaacgctgcagtgagccatgttcacatcactgcactccagcctgggcatcagaacaagaccgtacctcaaaaaaaaaaaaaaattaagaaaagacactggaggcatcgggaggggggcgttctaggtggcagtgctcctggggaagccttttgtcccactgaagacatgaagctcctgggagagcaggtggtcggcaaggctcaggttttcatccaccttttgcagatctaggaggcaaagtcatacctgctggggagggaggaccaagactggggcctgaggcaataaggtaggagcagtagggaggtcagtttgttccaggtgcttagaattgtgtttgtgtttactctggaggttgctgagggctggggtgcacctattggaacaggggctccataggtttctgggtaaaatcaggtgttctggtttaagaaggtgacttggtaggcccacatgccccagtgccaagtaaactgttcttaagtctgactgcagttgcctccaaagaagatagaaaaggggagtagccaggattccaaaaagaagagctctccaacctggcaaagagccctgtgctagacagtattcctggtaccttgggtccatttacttctcttttttttttttttttcaggctgaccccaaattagtagtaacagccctcggagagaggcagtgatgggaaaagaggtcccacactcaagccagaactgggaggcaggatgttcatgctctggcttcagttcagctactgacggggtgccagtagatacctttcctctctctaggacacaaagagagctgttcctgggtcttaatctctgtcgctctgcgctcttctgaacttgatggccctcagcacggggccagggagcgggggaaaagcagaactttttccaggaattgctattggaagcagccccgttgccaacacgcatgcacacatgcacacagcttttctggacagaccttatattatggattatcaccacaaaacatccctttggggcctggtagcccacaccacagaattcagggtcattaatttttctcctatccagagagtgcatggtgtccggaatctgtggttaccaggggagcaaggcacagagaacctggctctgctcccaagcatgaatgctgctgaccagcccctgggtagggactggggaggtgggacagaattcccaggaggcaggggactcagcctgacacagtctctgggagtgcaccctggagcccagtccagaaacctctgggaggaccaggtcctgcagaagaaagaagaggtactaagaaggcctgggattgggggttaccatgtcgtggggaggggagtttgcctctgaggcccaccaccttgagaaatatgcatgctgtgtctcaggcaggttgtcaggagagagtcattgtatttgatttgtcagctactaacagagcctgccacgtgccctgcgaggtgtttggtgcagatgggcatggcttccacagggcaccacagagatcatgatgaatgaagtgtcaaggtggtagacacagagcgagtgctgtggaaaaggaagaggggagaggtcagggagagcctcccaaggagatggacttgggctggacctcagaggatgggcagaatttaaataggtagagcagcattttcggaccgaactttgttacccaaagcatgggctggtttgaggggcagtcggtgggagtctccctgtgcccaggctgccccctcccccagcagcgcctgcctgcaggaagttctcatttctcggctctgaagaggaactgtggctgcctctgagacacagacccaaaggagcaccccggcagtttctcaaaaaatatcccttctgccccaagtctggccagcagagcgcttctgtgtccacccagtaccccgtccaggcagcctctgggtctcctggcctcctgtccccttgaccctgaactggacagcaagagggaaaggtgtctgtcctggacaggtggcctcaggactcatctctgtcttctccaaccccagctggcctccatgtcccctgggggctttctgctgctgaccagcttgggccctactataggttttcttgctgggcttaggagcctgagagaggtagccatttccaaaagaaaagatttctatctcagattatctgggaaagaggctgagtaggtcccttctctgaggaaacaggcagcaggacataggatggggcagtgggaggaaaagggtctgcactatggggtccttgggctgtgcactcctgaccttatcacttcacagttcccaccagatctgacttgacctccgggccatgacccagtccctcccccactctggaaacctctgtgtcccctcctgctcctttcactcccacctgggaggctctgagcaggccagggtccctctctccaggcctgctcctccctttctcctcctgtccccccagccatccccccagccaggctctcccacctctggccccacctcacctcttggccttcttctttccctcgggcgatgggagcctggtttggctgcccagggaagattgtatctgaccacaggagggagggctgagggcactgctgggtgagctgaggcctccttaggttcttgctgtagtctgagttcaagtcatttagaatgagtgacttgaggaagagggagctgggagcccttttcaccagcagggggactggaggagtcgaatggggtggggtcttctcgttttgattagcttctggtggaggtcccaggctttggcgtgctcaagcttggagtggcagggagcaggcctggcttgaccttctttccttcctgctccctctcctcacccctccctgcagctctttcactccgtctctctctctacagatgggacccaggtgagcccgggtgcccactactgcagccccactggcgcaggtaagagtcaaacccgggggagtccatggtagggagtggaagatgaggggtggaaaggctgtaagaacgcgagaagctgaggggttagagaagcagggtcgctggctgatctgccagagagccaggaggtggcggctccagggaggggcgaggagccggggtaagagaggcagctctggatgctggctgggcacagtgctaggaaacacaacaggaaaaggaaacacaggatgcccgtcttgtccttgctgggagcagtgaaacaggaaggaaagtaagaagctaatatttatactgagacccctaccccatgtcaggcaccaggcaaggtgtgttcttgtgtgtggactcggtcctcacaccggctctgcaaggtgggcatggcagcccttgcaggactgctctgctggaggggaagtgttctctcactgtctgcgcctcctccctctgctggcccgagcctcctctgctgctaggctgccctggggaaggactggacttcctgctgctgctttggtttaggacatgcccatggggccaggtctggactagacgcggtctgcccttcctttagtgtagccagtatcaaccaagggcctactgagtgcaagatatacagcctgatgcctaataattccatatagcagggagaaatggaacccaggtatcctccttgcttcagtcctggctgttgaaaagctaacaggcaggttagggaggaagcacacacaaatacaaagcgaaaaaaaatagaatgcaataatgtgaccagtgcccaatgagaggacactgattcatgagtttatccatttgttcaagaatcattaatgagttctgtctctgtgccagggtactttcctggacattttaggagagacactgatttattcattgattctatgtttgtggagtgcctgtcatgtgctaggtactattccaggtgctaggaataataaacaaagcatgaaaccaactccctgccctatggagcttaactcagacatggtacctgcccacagagcactaatcctggtgtggaacagccatgtgattggagtccaaaagagggagggatgctaggcgctggctgggtccagggatgagggaggactccagctgagctttgagcaaagagtaggatttggaaaagtagaatgtagggatgaggacagcacaggcagggggacattgtgagcaaaaggtcagagaacagaagagatgtggatttgtgacaggtggaagctgatggccaaggtggagggttcatgttcaaatgcagaccaagttgagagaagccaagttaggaccagattgtggagcctcacaaatgctaaagcacctcgaaaagtatttccagggctccaggcagagcccatcctgtattcccttctgctgtggaggcagtggccatgcagagtgtgaggggaagggcccctgctgggggtctgctcacagtccgtatgtggctgaagccactggtcttgggtccaggtcgctggccttggttcccccaagcccctcttgcataatcaggggagtcaccccgggaagccaggacacagaacatggaaggactgaaacctttcctggggcaggagtgttttggtattcgaaacccagactcaacccgaatgagaatccggatttcttgggaggcaatgtgaacaaggggtggggcatcaaagccatacattttctactgcgggcggcatctgggtgcacagccatcactgtccctccaggcctcttgatattcgggggacatggcgggcacctccttgctgggctcctgtcttgtgtccatgtcacagtcagggaatgttagagtgaatgccctttaatgacagcctactgcaaacccctctttgcttagtgagaaagccccttgaggggaggtgaattcctgaaagttggtgggaaactggagtacctgccttggtaggaccagaacccatgctagctctgcccctagcagggtgactttggacagggcccttcacctccgagcctcggtttccttatttaggataacaagatagtaatgactaccccccggggccagtggcttgatgtagctgctcatgcacaagtgctgtagatgtaaagattgtggttaggagtggccagcttgggcctggaggctatgatttctgactcctggactggtactttgccacaggcctttccagccctcctcagccccaatccctgaggacagtctgtggctgccccactgggagatgcccagcgttggaattgctgaaggaggcctctccaggaaggcttctccacttgtgtgccctcccatggggccggcctgctcctaccccacccacttccccttctccaggataagcccgctgcaacagctccgtctcccagtgtctcagcctctctggctgctcagcccagcctggtccagctggctatgctggcatggaccctagtctggtggccagttataaatagcccctgcacccacagccttggcagggtgctcctagtgtgggtgcagaggacacttgagaagaggcagccgtgcctgccatcctgaccatgccaggcccagagctgccatggaggcacccaggagcaggcccaaggacacatgggccctatgagctgaggaacctgccctgggcacagggttctgcaggcccaacgtggccggtcagggctggctgtaggcttgaggcatcactttatctcatgactggggatagagcatgggagggtggcgacccagagggcctgtgaggcttggggctggaggcagaacaaagtgggcctgtttgcctgcctgattgcttcctttgagcccaactcattagagggcagctgggcaaatcctctgattccagggagggatgaagggagggagaaggcagggccaagaatgtcctaccataggatctgcagcccatcggagatcactgtagccctcagcccccggcccagggaggagcatgtttagtggaggagcactgtggtggagtcggaagactccgttcaaacaccaccagtgatacagtgttactgtgcacagttcatgtgacttttttctcacgagtaaaatggaattgataatacctaccttgcaggaccacgacaggattaagtgaggaaaaacccccatgagagtgttttgccattgtcaagtgagcctgagggaggctgaggggggatcaggctgtatcatgcccccgaggacaaactttccagtttaccctgctccctctctctgtccctaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgagggtaaagatggagctccctgcatgtggggccaccttgagcttggtccccagcctccccgccttcagcatccctagacaccagtctcagtcctcaactccttgtccctttctgggctgccggccctgcccacagctctccatggacacgccgatgcccgagttgcaggtgggaccccaggaacaagagctgcggcagcttctccacaaggacaagagcaagcgaagtaaggaggtggccaccccagcccagcccagccccaccagccaggtgcctgcggctgcctgtgtggcttgtgaggggtgaggtgggagggccgcagccagctgggcctgagccgaggctttccctctgcttgcctgggctctgcctgtgaatgtgtgggggatgtgggggtggggggtggtgtctggaggctctagggaggggtagggcctcgggcttggctcttgcctagggagtccctgggacgcctcctactgaggatggggacagggcagtggccaggtagtgccacgaggccgcctgtccacccacctccagccccctcctgactctgcccctacaggtgctgtagccagcagcgtggtcaagcagaagctagcggaggtgattctgaaaaaacagcaggcggccctagaaagaacagtccatcccaacagccccggcattccctacaggtaacaccctcctcacctgccctcctgtccccacatgcaccctccacccccgcccccgtgttagccatgagcacacacacttgcctccttcctccccagttgccacaaccagtccttacccttcctctaaacataatgcccccgagcccctctctcaactgatacctgccctcctctctttaaattctccccaccccacctgagcccttctctcacacacacacacacacacacacacacacacacacacacacacacaccctactggcttttttcttgcacatgagccccttctctctttatattttccctgagcgcaaaaatgtcctggttcccagagcaggttcctagtgcaggtgacagagcccccagtgggctcttcacccacgcaccaagcacctggcttctatgcctaggtcagagctctgcactatagctgctggagcggacaggcggcccactgctgccacctggagatggtccccattcctaccagccccacattgcccagccctgcccgctgcagcctccccctcaggtcccagggcccgtgctcagggcagtgcccgtgcagtgtccccacacctctgaagcagccttggcactcgttctgtagaaccctggagcccctggagacggaaggagccacccgctccatgctcagcagctttttgcctcctgttcccagcctgcccagtgaccccccagagcacttccctctgcgcaagacaggtgagctgaacaaacaggcggacctttcaggcaaaggaagggggaagggcctcggacatgggggaggagtgtgcaggggtgggcgggctgggctgggccaggagatcatcggtaggctaggatcttctttctagttctgccttctctttccttgaccgatagagatgactgggactgaggggttaaagggtggaaaaaagaagggtggtgggggcctgagtgacgctggtgctccctgcagtctctgagcccaacctgaagctgcgctataagcccaagaagtccctggagcggaggaagaatccactgctccgaaaggagagtgcgccccccagcctccggcggcggcccgcagagaccctcggaggtgagggccggctgagccagtgcggttgccatcctcaaacctggctggtcttgtccctttgggtcaggccccacctagacaggggtcccctccttaggactgccatgcgtggttgcatgggggtgtcccacacacttgccgaagcgggggagttggggctgaaacccagtccctgctctgttagctaaggtgacatctcccagaaaagggggcacccttcaaaaaattatgcaaaggtgctgtaggccaaaggtggcctgtcttcttcctgctctgatgggaagaaagcaggaggccgggcgcggtggttcacgcctataatctcagcactttgggaggctgaggcaggtcaatcacctgaggttaggagtttgagaccagcctggacaatatggtgaaaccctgtctctactaaaaatacaaaaattagccaggcacggtggtgcatgcctgtagtcccagctacttgggaggctgagccaggagaatcgcttgaacccaggaggtggaggttgcagtgagccgggatcgtgccattgcactccagcctgggcaacagagcaagactctgtctcaaaaaaaaaaaaaaagaaagcaggaagcaaaggtgctcgttaaggaagggggtgctcccgggtctcctgcaccaggcggcctggctgtaccctcctgcccaccctggcctctgactgcacttccctctctccccaaccctcagactcctccccaagtagtagcagcacgcccgcatcagggtgcagctcccccaatgacagcgagcacggccccaatcccatcctgggctcggaggtaaggccttgccgagactgggctctcctggggcagttctgaggctcagccttcttccagcaggcggccctacctgggctggggctgcagggtctgggcagcccctgccagagcctcctgggtgttctggggaaggtgcgccggggtagaggtctgggaccggtgaccctcgccctgctccctatggcaggcgctcttgggccagcggctgcggctgcaggagacttctgtggccccgttcgccttgccgacagtgtccttgctgcccgcaatcactctggggctgcccgcccctgccagggtgagtggctggggtgcccacccccactccaagcccccccagcttctttcactcccttttcttgctgcctcaccccatcatcttcattgttctctgctggaatcttcttccccgtgacttctcccgcctctcccccaggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactggtgagtctgctgcttcttcagggaaggggctgggtccctgcaccctgctaagagccaagcttgggatggacccatccttcctccccatctctgtccccctgtcctgcgcattgccctgctgcaccctggccccccaccctataccctcgcttccttccattgctccctgtggttccctccttattccaccccccgattctttccagtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaaggtgagaggaattgggcagtggaggtattgagggagtgtttaactggggacttaggggccaaaagaagaggggtacttagaaagggcagggaactggagggcaaaagagggggatgtggcttcttggggcccagagctgcatggcagctggagtcctagcaagatgactggctgcctggcccagcccaccacctcccaccccatgcccctcgctccaccatggcttctcagccaggttctcccctccccagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtatggcagtccccacctgcccctcagaaagtgtcctcagaagactctggggcctggcataagatggggaagggagggagatacgacatcagtgcaacaggcagctctaggacccatggttgccctataagatcctgggtgctggatccacactaaggtgtaggcacacacacacatgcacactcacacacccatacacacacatacacacaacagcttgccagtctcaggtgaagcatgtcccttttccaggaaggagtctgtcctttcctggagccacacatagtcctgccctggtatgtctcccctctatccagaaaggtggctagggccagaggtgggatggagccaggctccagcgtgtccagcagaatgctctcactgtgggaatcaagacccagtgcattagcttgccggagctgttgggatacaggctgggcgccttaaacagcaggcatttaccatctcacagttctggaggctggaagtcaaaatcgaggtgttggtggagttggttccttctgggggctgtgagtgtgagggcaggggctgttcccggtctctctccttggcttgtggatggtcatcttcttcctgtggcttcatgtggtttccctctgtgaatgcctgttcagatttcctcttcctataaggacaatagtcatactgggttaaggcccaccctaacgacctcattttaatttgattacttctgtttgtaaagaccctatctctgaataaggtcatgtttagaggtactgggggttgggacttcaacatataaatttgagggtggggaacataatttactccataacacatgatgacaggccacacacatgttcttgaacagttacatagtccaggacaggaggacatcctggtcagcacaagatccagcgcccctcccctggttcctggctttggagccccaagggcccggggagctggtggaatgggtggtcagtctggggtgcaaacctgtcagggggctgcaggggacagggggcttagagagtcaaaggccagagccccactggacagcaggtctaggtttatcctggaatctctctaggaaaggggcctgcttggcagttcccaagacctcaggcagaagtagagggagcaggaccctgaaacactggagaccaaggccccatctttcccctaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacaggtgagaccgggaggagggtggcgggtggagggaggggctcggctgcacgagtccatgtgggtgtcttggtgtcacttgggacatttttagaggccacagagtgcttagccttgttaggcccacgtagtacccatggagcacatggaacagctggttattgcatttggccgatgaggaccaaggctcacgaaatctaaggtgacaagcctgtggtcaaatagcaagtggtagtcaagccaggataagaattccagtctcctgccaatgcactcagcccttttaaaaaatgatatttattactgttgctctgcttgtaaaaagagctcagaagtattttagacattttgaagagtacagaaaaacctaagaagaaaagaaaaatcaccaaccagtatcccaccacccagaagtaaaccctctgaaattctgctgtatttcagtccaggctttgttctggccatatgtacatgtacagatgccatgaacacatgaactacgttttgtatcctgctttacttagttaacatattatgaatccttcttggcataattagtctttaaaactgagagtctcatagtatttcattaatgtatttcatttttactgagggatcccttatcagttagacatttagattatagcttatttgaatttccttatgcataaatctttcctcatgcttgggattatttcccaaggttcactctaaagaagtagcattcctgggtcacatggtgtgagcattttgagagtcgttggtgtcctagacgcacagaaattgaccctcccacccgcaatgagcaggaccctcctctgaagacttcccacgggtcagactgaaatagtcacttctccaaagctggatttgtctatcacatggtccagtgtcatcgtgggcttcttagctcccggtttgggggtttcctaggaattcttttccctcctgctgccccttggtagcctctctgggttcatgacacgtgtgtgagatgctgtacgttaggcctcatgctttgctctgagcacttgagggcctggtgctgggccctcgagtcctgggccacccagcagtcgtgtccgcatgtgggaaggccgtggctctgtggcagccatgttggctggagctgtgttgatgtgttggctgctgccacctggggaagtgtctgggcgtgtgtggacaggtgtgaggggctggggctggggtaggggcaggatgaaatgcaggcctgtgtgggtgtgaggggtgtgtacccgcccggctccatgtgggtgcctgctgtggcggtgctggcgtgttctctgcagccaaggccatggggcgtgaggactccctgggtccccgctctgacccttgctcctgcagggctgatctatgactcggtcatgctgaagcaccagtgctcctgcggtgacaacagcaggcacccggagcacgccggccgcatccagagcatctggtcccggctgcaggagcgggggctccggagccagtgtgaggtgaggaggcgcgggtggggcccgaggaatgggtggagggaggagtcatgggaggggaggggtggggggccctggggcccatgagagatgaggggcacatggggtggtggtgatgggagggaaggggcgagcatgagctcagagctctgtggtccccttttcagtgtctccgaggccggaaggcctccctggaagagctgcagtcggtccactctgagcggcacgtgctcctctacggcaccaacccgctcagccgcctcaaactggacaacgggaagctggcaggtaatggcctagtggccctgtctccccatgccagcttacctcacccagctcccatgcactcctgtctcggctctgcccgcccagccagcctcctcctgcaccctggacgtccctactccagcttgctgccaagcccctcctcagcccacctccacctctcccttccatatttctctcccccaatactcacccggccctgctctctgggctccctgctccctgttgggccaaaggctgagagtattcacgctgacgtgggctgggcctctccccgcagggctcctggcacagcggatgtttgtgatgctgccctgtggtggggttggggtaagtgtgcccaggggtctcaggggggcgttgccagggctctcagctctcctccctgtggttctcccaggcccagcccctgcagaacctctgcttgttgtggttctgccagacagggtgagccagggacttcctgaggtgccccctgcagcaggaagctccttttggacaggcgtgtctcggacccacagtctcccccgaatgcggagtccagcctaagccttcccctagaaggtgtctggtagatgctgagtgaggtttcaggagcagggccaaggctggggcttaggatcatctctcccttcaaagacccccatgactgggcattggccgccaggctgctctgtctgctcttaagtggcaagttggggtacctcagcctggtccccagaccttgggctgcctggtgtgacatcacggtggtgcttccggtgtccttggcgatcccagcactccccactccgggacatagccccaaactccgctcgcgagctttgcttcctaagtcctcacccctttgtgaagggagcttcccgctccctccggctcagctctcctcgcctaacactatccctgcagtagtttctcaagcaaggtgtgtagaggcaggggatggaggcctcattccggagggaaagtgggagctgtagctggtgggggactttgggagccagtcagtgccctattcacaacttcccatttcttgccactttctggtttttccaactgttgttgcttctgttttctcctccctcctctccctctctgtctttctctctctctctctttctccagcctcttgcgactctctctgccttcctcgcctctcttggtctgcctcgccctccccatctccccatcatgccccccggcccctccctagccttgaggcccagggactgggtttggggggcctcccagcctgggctaggggccctgagtggaagacagtggtgcagacggcccctccagctccgaccgtcccgcagggcctgagcagagtcagctggggcttaaaaccccctcccggcccaaaccccaagtcccgcccaggtaacgccatgccccctcccctgaccggggaggcaggcgtgatgctgccagcagagtgctggccagataatgggctggtgctgggacttaagctgggaaaaagtcatgctgggattgggggacacaggaggccttgcctttgggcggtggggcactggggaggcagcactgtctgcccagctccctgcccctggggtcctggccgtggggtggggaccacccccttgggccctggctcctgtgtgaagccttggatgatgcgggccctgactctggctcccgcaggtggacactgacaccatctggaatgagcttcattcctccaatgcagcccgctgggccgctggcagtgtcactgacctcgccttcaaagtggcttctcgtgagctaaaggtaggaggtttgggttgaaggtggacacaccacaaaggaggaagcagagtggggtagtggggaatccaggcccagaaccccaggcatcgcattcctcttagagattgctacagggttttggaggggaaattgagggctctgggaaccaggttgagattggaactcttggggtacgttcatgcagctgtgggtcagagctgtctgttgattgacaagcattctttctttttccagaatggtttcgctgtggtgcggcccccaggacaccatgcagatcattcaacagccatgtaaggctaagggaagacctgggtgggatgaggtggggggcaagcccccaggaacttccttcagggacattctctcttcttccctgagctttctcaggctgggccaacccaggggcctggggaggtgagggcatgtggagagaatgggctggcaggacctgtctctccttccaggggcttctgcttcttcaactcagtggccatcgcctgccggcagctgcaacagcagagcaaggccagcaagatcctcattgtagactgggtaggtgcctgtccgtagcaccctccaattcgagagccctgggggaaaagccctgagcctgatgttagagatgcggcttcatgtcttagttctgcagtagcctctctgagcctcagtttccccttgtgtaaaatttgggtgaagataacacccacatcacagttgggaggcctagaggggatggcgtgtgggaacgcattcagccatcgcaaacccctgcaacgagtaggagctgtcatttgagtgttgtcttttgacctctattggcttcttttggcagatctagtaatttctgcatttcctgtacaggtagtgatgataagaataatagcagataacatcagtacaccactaatcacatccagacactgatggttttacacatgatggatttaatcctgactataacccactttacagatgaaagtgagcacagagagattaagtaactcacacacagtcattcgtaagtcatgagatggatttgaacccaggcgggttagctctagagtgcttgcgtttaactgctaagctatgtcccttctgcactgacagctgtgtaagagacatttctaagcagaagttgagagcggtggaggacctttgcacacttgagttcccgcatggtcctgtgagtcgagtgtagggcccagctctccctacgagggatggggctgggcctcgtgtacctgcccctctgtaaccgagcttggtttctgatctcctcataacttcatgactttatgcaagacagagtggttcctgatatgtgtaaccctgaacccttccctctccttgccactaaccccatgtccacacagttactctctcaggtgggctggcctgagattgggacacctcctctccttcaggatctcatattacagccagccctgtccagcacagagaggccgaggttcagagccgggcagtggattacgtggggccactcgaccatgtggctttaggaaccccaggttcctgatcccagtctagggtcctgacctcagaatggccactgaccttgaaacccttctaacctgtcctggcccccatctctctgccttccctaatcgctgcccgtctccctacacaggacgtgcaccatggcaacggcacccagcaaaccttctaccaagaccccagtgtgctctacatctccctgcatcgccatgacgacggcaacttcttcccggggagtggggctgtggatgaggtaaccgcatgtcagggccacatcttccagcctcattgacctcctcctgacacttactctgcctctgtcatgacgagctgtgtgatcctgggcagactgctgagcctctctgatcctaaacttccccacctggaaatggggaggctggatgagctgggctggcagctctaacaaactggtgttccccttctgggactctgctgtcctcatgtctctcttgcctcctgttttccaggtaggggctggcagcggtgagggcttcaatgtcaatgtggcctgggctggaggtctggacccccccatgggggatcctgagtacctggctgctttcaggtacgtgctctgggggcccagaggggcaagtccaccctctcctgtccccttctcccaagagcaccaggggggaaggtgatcagttggattgtcagcctgtccccaccagttcctagacattgtaggtgaacgccagtgagaataggacaaacagagagaagaatgcaaaagtcaaagggtgctttgcaaaggcatacattaccgagagccaatgtcaaactgattgctggcaggtgggtggtggagtgagcagagctggcacatttagtcagagaaggctgccactctatttgggaaaagagaattctggaaatggatcttcaaacacttttctggagttatctccatgacagctaattctacgagagccctgggctggagttcctggagtcttctcagagcccagggctatgaagaacacccaagcaggccccagagttggatcaggggtagaggaaggcagctgggggggggcctggaagagggagaggatgagagaatgtagccaggtggcgcagaacctcagaggacctagttgtcccctactcagctctcaagtagtgagtagctgggtgtggtcaactcagtccaaaggactgagcacttgtagtccctgaagctttgtgaccagagtccatctccgcaaggctgtgagattaccctttccctgtggctccggccactgcaccccacagatgcttgcatgcacacacacacatgcacacacacatggtcacacacactcctctttcattccctctggtgctccatccttggctcctttctgcctcttgctagttaagtcccctagggggctgagtccttaggctgtgtgtgccagggacatgggtggccagccaaggtcaaggaggtcagagaaatctgccagttgtgctggggcactgggagccttggagtcctaagaacagggtgccccaccgcaaagttggcaggaccgcccctggcaaccctgcacagtacgatgatcgccacttcttgtgacctcacaggatagtcgtgatgcccatcgcccgagagttctctccagacctagtcctggtgtctgctggatttgatgctgctgagggtcacccggccccactgggtggctaccatgtttctgccaaatgtaagggagcctcagctgagggggacgttagggacagagagccaggcggtgcggggagttgggaggcactcccaagtcagaaagggaaggtggcagtggccagcccagggctttcagcctgaggactggagtatggcagctggtcctgaaattccccgggatctcctagccgagcacagcccaagccctttctcaggaccaggccggttcaccacggagggcttgaccaggtcatacccatggggacttaagtccagtaggcaggaagctcagccgtgggactccccaccacagctgggttgattccaggtgggctggcagctcctccagaggaaggggagagaggagcagcactctcagaatagagggtggccacagggcccagagtacagaaagaagagagggtgtagctcagtgaaaaagacacaggctagagtcaatgacccaagttcaggtcctaccttgctgccacttactagctgtggggcctttcccaaggcccttaacctccctgagccttgagtgaagcatactagtaggttttgtacgacattcaatgtgaaagcactttggaaatagtgattgatacatgtgagtcattctttattagggaggaagcaagcagggaagccacaggggtagagaacagggtcacctctccactcccgcccctcccatttctcccctcccaacctctaggttttggatacatgacgcagcaactgatgaacctggcaggaggcgcagtggtgctggccttggagggtggccatgacctcacagccatctgtgacgcctctgaggcctgtgtggctgctcttctgggtaacagggtgagccgtctccctcccccatccatgcttctgtcaggcaggtaagcccggctctcaggactacccaaggagcaggcagatgggatgggacagggtgggagtggccaagcctgaaacaaggtaggcgaagcggaagcctctgttccaagttaggtccaggcagcatctcctggcctaggtagagtgtgcttgtggctagaaggctggggcccctggggtgggagtgagctgggcctgtgggtccctgagagactggtggctgatgtactgttttctataggtggatcccctttcagaagaaggctggaaacagaaacccaacctcaatgccatccgctctctggaggccgtgatccgggtgcacagtaagtgtggagatgggacactcgctgagctcagactgaaggatcttggtggtaccctgccccaccgtggccagatcctagggcttccggtgccagccaggtgacctgctgttggtctggagtaagattcctgtgagtgacccaggcagcaatggtgagcaccccccagtgaggggttatcctctgagcccccccgatggagccagcagggcctaccagacagtggcccctcaaggtagggactggcctccatctctagcgacagccctagaccagggccaggtcaagagcaacactcaggccttgtttgccaaaaggcctggttcccatccctcccctcagtcctggccacaggcgtctcaggagctctgctggcttgggggctgcgtcttgggataacccccacatttgtaaagtactttaaattttcaacttcaactcaacatctattgagcatcttatgtcaagacccataatctatactagggataaaaatgagtaaaatagattcccatatcaagggctgggtaggggagccgtgatgtctttacataatggtaaagacatggctgattcctcttacggtgggtgccctcacactgagccagattccaggacatggttcctcacagcagcaggcaggaggagcattctcctggcctgggcacccatgcagagcggccgtggtgatggtcagttctcccatgttgtgttcgtcccacctcccaggccctcctttcctgagtgctgggctgagcactggtgggggctgtgtttaagtgggaggcccgagcttggggctctgggaggtcactgtgacacagacccctgtctgcaggcaagcaggctctcctgatgctctcaggagccccgcacctgtggggaatgagtcaaaggtggccttgcagccacaggggatgagagaaaggctgggcacctgctaggactccctcacagccatgttgaacccactctgtgtaccctgtcaggctgtgcgggagtgggagcgaagtgaggagaggggcaggtgggagagccgaccctaagtggaggacaggcccgctcctccggggccctgggcctgagacaccaacctcaatatccggtctaggacgcagtgtggaggggcttgctttctccaaccctttctgacctggcatcttaccccaggtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggtaatgccagacccctggccctgggcccacagcctctccaccgcttcattcctccctgcttgaagaccccgggtccgctatgcagccaccccaaccctcccaggcttcctgaccagggttgagaggaagcttagctaaggcccttgctgcagccctggtgctccagcatcccacccttgtccctccccacaggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagcctcaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccactgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctccccaagaagcgcagcatacccctgggacccctcggccactgcccactcggggagccttctctgtttctggggcctcccccaccatagctctgattcccaccccacataggagtagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgctttaaaagtgcctctgaaagggccccccagaagtgagcagtgcgccgtcaagcgggtgtgcagggcacacagctgcacggcacagtgtgggtctgagtcactgccggaggagggaccagggtggtctgggccgcagcccctttaacaatctgcccttcctgccctgcaggaagaacccattctgaacacaccctggctgtccctggctgccccactttggggtgacaaagaggaggcagccctgggctgagtccacagagaccagccctgatatggcaggagtgggggtggggtgggggagtgggaatacaggagctcagccccagctcaccacggcatccccgaagagttgtgactcagacacacctgggtttaagtcccagctgggagctcaggtaagtcaaatcgtcttctggggcctctgtttatcagtagaaggctccagaagtatacactgttgatggctccttcccgctctgatgcaccatgcctgattaagcatacactgagcctagaagagagaaggggtgaggcacaggcctggacaagctcacccagcctaagcagagaggaaggcgccaggctggcagcacctgcctttgtggttctgagtctgtccggtttttccagcaggaagaggagcacctcattaccttagacctggcccaagctcccggcagcctggcagagtgtgagggaagaggcgctaatccctttcccatctggcctggcctctcgggtgtggacaccaaatcccgcaggggttgctgtagctatgcccgtgggcatccttgccctggctggggtgtgctagagagaggaaagctggaggaggagagctgagctggtggttaccccatgccaggagggccaaggcaagagggcctgcagccccagagatactgaccctgtcccctgccctccagggcacaactgaactagcggaatggcttaatcagatagctcgagaactgccactaccactccctccctgcccactcctcccaaagtccacctgttcccgcaagagtcccacctcacaagcaaccaccagaggctgatacaaatggccgctgtatttttgctaaagtgacagtgacacagataaggcaaagagctgaggggcaggacacatcagatgggaagggggagaccgtgcaaaatggcagtctaacagaaaatcatccttgtaccaacagccccttccctcccaagttaggtgagcccttgggccagtgtatgggcagaaaagcagatttgtgtccttcagaagggaaatgtaaaaaggtgaaagctctagttgaagggcagtgagaggggctggagtgggagagaaggtctctcctggccggtggtctgggtgcagcaagggcactctgagaaggcagaatggaaacgcagggctggaggggcatgggtacaggtttgggggctctttccagcctctactatgttgcccccttccccaaagcccttacaggggcagaagcacattccccgtgaccctgagtctggcctcatttgggaagtcttctggggtgtatggatgcctgtgtgtgtgagtgagatgggtggggggccacggctatctggctctagcacactcatgggagaccagctctgggaacaacaggatggggtgctgggatgggggtttaagaggtctctgctagatatttctgaactgacctccccaggtgcccaacctggccttgggaagagagtgcctagggcagcggggatggaaacccttgcctgcagcataggtccaggcctcatggccctacaccttgacctcttgactttgttgccctggccttaagtacaaagattcctcactgcgtgctaagaaaacagatccaggccgggcacggtggctcacacctataatcccagcactttggaaggctgaggcgggtgaatcacctgagatcaggagttcgagaccagcctggccaacatggcaaaaccctgtctctactaaaaacacaaaaatttgccgggcatggtggcagatgcctgtaatcccagctacttgagaggccaaggcaggagaattgcttgaacctgggaggcggaggttgcagtgagctgagatcgcactactgcactccagcctgggtgacagagtaagactccatctcaaaaaaaaaaaaaaaagaaaaaaaaaagaaagaaaagaaaacagattcatttgaaaaggtctaaagctgccctctggccaggctgatgaggagcaacatggcaggatcccctctctaccacactcaggtttcctcgaaaggggacgggcaggacagcttcctgggagaccacactcgtcctgctgtgtattttctgccacagttctggggtcaccagggggtgggagtagcctctcccaacatctcagaggctgagtccaggtcctaaggcccccccagggtgcagagacctcaccccctgggtcagaaatcgctgaggatgctgatgtcagcaaagtcagcccggtagcggtgggcatagaggctgagcaggaaggcccacttgaaggaaatgaagctccagacgctggagaggtagtagctggtggggtctgtgaggcctgcagggagagaagtaccgacagtgactttggcaggccctgccctcggcctctgcaccggccacaaggccagggccaccctccccactcaacatccctgcaacgtcctggcagctgaaccaacccttcagaaagacactgtgatggaggttttagagccatggtccccaacctttttggcaccagggactggttttgtggaagacaatttttccacaaaaaccttgggatggtttggggatgaaactgttccacctcagatcgtcaaacattagatcatcaggggcacgcaaccctcgcatgcgcctcacaacagggtttgcgcttctaatgcccgccgctgacctgacaggaggcagagctcaggcggtaaggctcgcttgcccctcacctgctgtgtggcctggttcctaacaggccacggaccactactgttccacagcctggaacagtagaacggagctggggaccgttttagagtattccagggttttcaggcaggaggccgtggggattagggaagggcagggctggccaatcacaggtctgtatcatccactccgcttttgtgacaaataccctaggccacctccaacctgctttagttagcatcagactcccggaagaaggacctctggttatttccagccacagccaccagagggcgctcccatcccagagctgagcacagactaatgggtcccaatatcaggagtgcttgtatgggctatgcactgctcaagacttcacatcagtttcatagaatccacccaacttgcgaggtggggacttgttttctccacatgaaccataacaaaacccgtgtccggggaggttaagtaattcacccagtctctttggaggtaacctgtggaaccaggatgggaatgctgctaaaatccccgctgctgtccctcccatgccctctttccctgggacccgccctcactctgatgccgggtgatggccagcacgaggaaggtgcagaaggcagcgatggagacggccgagaagaggacgcccacgaagaagaagccgcgcagccccttgagccaggtcctccaataatcttgcatgtacatcacgtgcgtcaccaggacccacagtgccagcacccctgcaggagagacacatcagggcccatccccagggtgctccagagccctgcagatccactagaccaggcctatttgcataagaataccaagaatatggtcttgtctctcattccctcatagaatggagttttccttttcggaggctgtgatatcagaagcaggtaagagactgagctgcctgctagtaagcccaacattagagaaacctgcagaaatacaaaaccctaccattctctctgattttattttgttttggaaaacatgaatatctctcacaaaaatgttatgttaattcatgttatttttagtattactttaaaatgctaaaaaatgttctaacttctaatatagtatatatcaatagctaaaactcacatacataaaatttgcatggagtttcactacttttcaagaggataaaaggatcctgaaaaccagaaagtctgtgcctcagcagcccagcctgctttctggggacttgccactgtctaccctgagggccacagagcagggaagccatgctcctgccccatgctcctcctccacccagccctcagaggccacagtctcaaagtcacaaggcctgcagggctcttcccaaactgcctgagttggttttgcaggatgaggaggtccagccatgaagactccagggccacccaacccctgagtggccttattgttcttggccagacctcatgccactccctccattttgcggcaaagggcaggccatcaccacctgcaccgctccccacccccactgcccccagcttttcctgggcctggcctctgcgcctgggtggacacttcctctaggatgccagctgccacccagccaatacaatacaaaacaaccctctgtgccaggcagtgcctgctggtgcagcccaaagagtggaacaaatatcaactccattggcaagggtccgggcagggcggtggatcccggcaagggacaaatgaggaaggaggcagagccagctgcaggctctcagctggttgggttgcaaggtgtgggccactcaggccgctgcatcctaggagtcaggaggcctttccaaaaggcagctgcacacatgccactcagagtagttaccaaatgtgcacaggaaggataagcatctggttggggaaagtggttatctctggcaatggagacaaggaagggaagttgatggggcggtgggggtggggaagtgctttgaatctatgggaatctatgctattttgtttcttaggctgggtgggaaatctatgctattttatctacgctgttttctcaggctgggttataagggtgtttgttaaatcatctatccttttttgtgtgcctaaaatatttcataatttgtttaagggggaaaaaggcaggaggaagcttgtcactgtggagctatgctctggttaccagctcagaggctgtcccagtttggctgtccccagacagtccagtgaggaacaaaaacccatgagactccaagccaagaaaccaggagcctggcactgctgtgtcccaaagccttggtgtttccacatctaaaaatgggtgggcccaggggtcctgccagtttaggtaactgggcccagggttctaccctagtgagggtgaaggcctaccaagcctacagcttccctcagcccctgccaccgtttgaccccctgaacactctcccagctttgcccctgcccacctccactcttcctcagggggtgggggcctggaatgtgggtccccctcctactgagatcagggtgggccaggacaagcatctgttcctccccacctagtctggatgctggagtgggccagaggtggacaggacaatcatcctgcagcttcctcttacctcctacaagatctggatttttataccagccacctttcacagaagtccctcccactcctcacatgtgtcccatgttttcatttgagggagctgtttggtttataaagggccctgggaacaaggggtgttgtcactgagcacactcaaggagcagtctgatgggcacctgtctggaacaggtcccctcgccctctgtctcctcgtgccacagaggggttggggaagttgagctctaagatcctttcccactcaaagattctagaagccagcttgggagaaaaataaggtcagaacaattcctctgtgactcagcagtttctgggttaggaaatgctgaaataggggcctgtgaagatgccatctcttagtccactggccacgatccagtggttccccaaaactcccacccccatgtacatgcacataccaaagagggctgagggcaggagggagaggaagacagccatttgggggcgttttgggccctgttctttgttaacaacaggcatggtttacccacctctcaccttccctcaaccttgctccaggccctgcacagaggcctcccctccagataaacacacatcaagtgtggaggcaggcctgctgcccacgccctggctcccaccaccctcctgggaagggagctctccaccagccctacccaagggggtcactgaaggagatggagcccctcactggtcccctcccacacatcaggcaggaggcaatgtatctccctaatacccttccctggcacacttggggactctaggaagcctggtttataaaactcggggtggaatggacaggtccccaatcccacctggctgcaagcccacaccagaccacaccgttgctccatcctacctgtttcaaggagcagagcccctgcttagccatgtgagcttattggctcacagccgataagctaagggtaaggaaggcatagggtagggcggtgaaagcatccccagtggctgggctggaggtgaggagacaggagacacccgggggatcccacagggtaaatgcagacaagaaggacactgggcctaggtcaggcccctctattccttcctaggaggaagacagtcctggagccccagggctcttgctcacagctcacctgggaaaaacatagagctgtttagacttcaggagcaacttttctttttctctttccttggtctactaaacccagagcaagagtttgtgttttcccccaggactcccacagcaaagccagaccaggtagatccaacccacacctgcccgcctccccaggaaagccagtcttgcttctgccactgcctttctccaaagccacttcttcgaaggtacccatcaggatgggagagggtatccccacccgtgaacactctgcccaccagacccaggggctccatgactctgctccagaaactggcacatccaatcagtccttgcctggtccaacacaggagaaggagcatgctggggctacccttgggtgactcagcagattctgagctataaaacgctgagtcagaagtagggtgctcacacgttagttaatctgctgacactttacccccaaaagaggaagaaggttgactggccacagaccctctgagaactcactcatggtggggaaggtcggaggcccaggcttggcaacccctctccctgccaccatccaccaccaccactaccaagcagttttggctcttccacagccactgtcaaagatcagaccatcagggagataccaggaccctactccagctggctgctgccctagcgagctgctgccctagcgagctgctgccctagcgcctctctctgaaggcagctccacagctggcctgcctcataggccaagggaagcctgtggggagggagagagggcagagttgggtcggaagaaaaccccaggcaactccctagagtataagaaagaaggccttttccacagccctctaggaggcagctggagactcagggagtgggcagcactgcaagatttcagatctggagggaagtcagatgtcttttggggacatctcctcccactcctaatagatgaggaaactgtggcccaggatagggtcaaacggccaggtagggttcacctccacttgtaccaggccagactcaacacaaccagctgagatcccaggctggccctccctgctcatccttctcttgccttcggtcttcgcaatgcaatcatagggctctgacgccgccttccagaggggaaagcaacagggccaataggaaacaaaaaagtggcagggagaagtgaaccttgacaaacatggagggtggcggggtgcagtggggaaaggaactagggctctgtagataacgcgcagagatgggccagttgtcctcaggatcccacaggtggtgaggcagctgggcaggcagagaacaccctagccagggtgcccatccccccttcttggtgacccagtgctttgttggcattgtgtagggtggggccctgtatgcccctcttctaaggcattaaccccacctcatgctgcgactctacccagggatggcactcagcactccctgtggcagtgagtaaattagttatttttagttattccatttagggttcttttggccgaggattttagtaatggaatataatcatcatatgtaaaagtattatacgtattttcttcccaaagtcctttcccacacatattatttcatgtagctgtgtaatcccgggtaagcaatttatttaacttcaggcctcagtttccttatctgtaaaatggacataatcgtaaggcctacttcatgagactaatgtaaggattaaatgaaataagggaagcaggttgcttaacatagtgcctgacacatagaaagcattttttaaaatgttagaaagtagagataatatttttcatcttcataccaattctatggcgcagagaggttaaactgcgagcccaaatgtgcacaacaaggagcactggtcagcccagagcccccatcagcgcaccgatgcttccccttccctcccagaagcacagaaagggcggctggcctgcaggatttggcagagcttggctgaggagccacagcagacgggtagcaaaaaggcaccaacatgggtggaaagagaatgtccagtttctatgagatccctaacgccgtcctccctgtgggtctcagcagagggctctgcgggggagccctctggaaggagggagatgggcttccccagccacccctagccctcttcctttcccacttcttccctctctgccctcacccagcacccagggaaggggcgcctggggggcaggggatccctcagaacaaccg

SEQ ID NO: 1895 - DNA, 2864 bp, Homo sapiens
gctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtaaggaggtggccaccccagcccagcccagccccaccagccaggtgcctgcggctgcctgtgtggcttgtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaa

SEQ ID NO: 1896 - protein, 953 aa, Homo sapiens
CPRPCADTPGPQPQPMDLRVGQRPPVEPPPEPTLLALQRPQRLHHHLFLAGLQQQRSVEPMRLSMDTPMPELQVGPQEQELRQLLHKDKSKRSKEVATPAQPSPTSQVPAAACVACAVASSVVKQKLAEVILKKQQAALERTVHPNSPGIPYRTLEPLETEGATRSMLSSFLPPVPSLPSDPPEHFPLRKTVSEPNLKLRYKPKKSLERRKNPLLRKESAPPSLRRRPAETLGDSSPSSSSTPASGCSSPNDSEHGPNPILGSEADSDRRTHPTLGPRGPILGSPHTPLFLPHGLEPEAGGTLPSRLQPILLLDPSGSHAPLLTVPGLGPLPFHFAQSLMTTERLSGSGLHWPLSRTRSEPLPPSATAPPPPGPMQPRLEQLKTHVQVIKRSAKPSEKPRLRQIPSAEDLETDGGGPGQVVDDGLEHRELGHGQPEARGPAPLQQHPQVLLWEQQRLAGRLPRGSTGDTVLLPLAQGGHRPLSRAQSSPAAPASLSAPEPASQARVLSSSETPARTLPFTTGLIYDSVMLKHQCSCGDNSRHPEHAGRIQSIWSRLQERGLRSQCECLRGRKASLEELQSVHSERHVLLYGTNPLSRLKLDNGKLAGLLAQRMFVMLPCGGVGVDTDTIWNELHSSNAARWAAGSVTDLAFKVASRELKNGFAVVRPPGHHADHSTAMGFCFFNSVAIACRQLQQQSKASKILIVDWDVHHGNGTQQTFYQDPSVLYISLHRHDDGNFFPGSGAVDEVGAGSGEGFNVNVAWAGGLDPPMGDPEYLAAFRIVVMPIAREFSPDLVLVSAGFDAAEGHPAPLGGYHVSAKCFGYMTQQLMNLAGGAVVLALEGGHDLTAICDASEACVAALLGNRVDPLSEEGWKQKPNLNAIRSLEAVIRVHSKYWGCMQRLASCPDSWVPRVPGADKEEVEAVTALASLSVGILAEDRPSEQLVEEEEPMNL

SEQ ID NO: 1897 - DNA, 56793 bp, Mus musculus
  misc_feature (1)...(56793): n = A,T,C or G
tgcggtgctaggttcagtccccagtaccatacatacttctgagattgcactgcagccagctggttggtacaaagctgaaagatcgggctggagagatggcttagctgctccgagcacttgctgttcttctagaggatctcagctttgttcccagcatgcatgtgactccagttgctgagagctaatgtcctcttctggcctctgcatgctgcatgtactcacaaacaagtgatatatactcacatagactcataccacactcacctaatatttaaaaaaaaaatacagaaaatggaagaaagtaaaggaacaaaacaacatcttacaataaagctttaacaaagcagaaaggtctaaagctgtaggtttgagccataagctagttggttctgagcaatgaaagtgcttcttctattggtaacctgcaactcatgtcagccagttgattctcatctaagaacagttagtcacagaggaactttgtgtaaacacgtggaatgactcagggggacccatttctagtccccatttctgggaaagctttccacaaataaaaagattcatatcctaaaaatggaagaaggcaaagtctttttttctgtttctgattaattaattaattgatatttactaagacagggtttctctgtgtagtcctggctgtcttgaaactctgtacataaaccaggctagcctccaagtcacagagatctgcctgcctctgcctcccaagtgctgagattaaaggccttttgtttgtttgtttgtttgtttttcatgacagggtttctctgtatagccctgactgtcctggaactcactctgtagaccaggctgcctcaaactcagaaatccgcctgcctctgcctcccgagtgctgggattaaaggtgtgcaccaccactgcccagctaaggcctttttttttttttcccaatctccttgaggttaactgggctcagctaatgcgtcttcttctattttttattttaaaggctctttcaggttaccaagaaaatgttgtcaacagaaacatctcatggttctcacagtggataagaagggtatagctttttttttccccagtcctggagatagcaacgcacacatgccaggcaaacacttcatcactgagataagtcccagctgtgactacaagcatttaaggtgaacctccaatcttgttgggggaggtggcggtggtgagatagaaccgcctccctgcgtccgtgcactttacatagactttctgctcagtttcactcttcgtctacatcatgtacactcggcagttcaccaggggtgcgagtgggaagctacagagaaacagagagcagacagtactagagaaataatcatgaagcaaatagtccatcctcttactaacaatgcctctgtaaatgaacatggcttagccaccccacctggaatctctattcttcattcaaactcaaaaatcaaaagtccagctgggcggtggtggcgcatgcctttaatatatccttggagatttattaaagactctggagtcagtgctcttaatgactccattctggaggtcctgagttcaaatcccagcaaccacatggtggctcacaaccatctgtaatgagatctgacgccctcttctggtgtgtctgaagacagctacagtgtacttacatataataataaataaatctttaggccggagtaaggagggactgagtgagtgggggcctaccagagaaagcagggttgaccagagcatgcagaggtcctaaaaattcaacccccaacaaccacatgaaggctcacaaccacgtacagctacagtactcacatacatagaataagtaaatgaatcttaaaaaaaaaaaaaaaaaaaaaggatggagccataggagcaagcagctgctgccatgctctgacataaaggacccttagtactagggaaatgtaaacacactatgtagcagtcccatagagcaatggaacatggaagctgcagcttcaactatgaagaccagagacacatagaagaggatcagttctctcattgttgctgtgacaaactccagtaccaaacacagtttggggaaggaaagatttatctggaaaggtcacagctcatcatctagggaagccaaggcaggagctggagcgggggccacagcagagtgtggcttaccggtttgctcctccagccacctggcccacacagcctatgactacctgcccataggtgacactgctcattgtgggcttggtcctgctacatcaaccatgccccttaagagagccggaaagatggctcagtaagagcattcactggcagctctcccagaggacctgggttcagtcccttgcatacacatggtggctcacaaccatctgtaatcccagtttcagaggatctgaccttggagaggaccaggcatgaacatggtgcacatacatgcacataagcaaagtattcttatacataaaatcttttaaatcatagtgtccttttaagtgtgtgtgtgtgtgtgtgtagctttacaacaacagtaaatttgtaaattttaggaaacatctcttccctcaccatcttgtcttgggttatactgggtaaataatttctgaaaggcagagggggctgcaggcaggtcaaggtgacctccacaggcccctcctgcagacacttgtcccaagttgatggtttatgagccatgttcactcagcttccagcccaatgcctgccgtatcccagctgctcaggaaatatctggtgactcaatggaaacacccaccacctgaaagtctccatttgtgtttactatgtgtactctgtcttgaagtatgaaggggaatttagttttcctggaatccaaacataataataagaagaatgataataacgaagggccatccctaatggcagttctccggtcttcttgataagtgaattagggcatggaggacccaaggagagacagtctgctagagaaaacccaattacgctgaggaacatatgttgccctgaggcctctgctgccgtaacaacatcatgtaactataactacagccctggagggccctgagcccgtcaaatatggaaaaggatgtcttcatcataggacagctttgtgctcacatagacttccctggagggcttggatcagggaagggagataaattaagtagaagaaaagagggggatgaaggacggaagagaagaatcgctaccagagcagcataatgacttttttttaaagcaattttcaaaatgtggttatttgactgtttagctttgggtggtggttatttataaccccagctgcagaaggtgggaagctgcattgccgcctgctgggatctagccaataatttcccccagggtaggctgagggtggggcctaaggaagacacaggaaccaacttaaccattggccagatcattaagagaagctccaggccatacacagcaggggaaagaaagaaaggcccaccagagactcttatttttgtgtttttgttgttgttgagacagtctttgtagctctctctgacctggaactctgtgcagacaaggctagccttcaatttacagagagacctgctttcttctgcttctccaatgctggtattaaggtgtgagctacacctatcccttcccaaccctagcccaattccagcaaaactggaactatgtagatcaggttgtccttgaatttgcagtgttctgagctttctgtgctttgagattgctagcattaaaggtatgctctaccatgccagcctgactattgttttgtttgtttgttttgcttttatttttttgagacagggtttttctttcctggaattcactctatagaccaggcagccctcgaactcacagtgattcacctgcctctgccttccaagagctgggattaaaggcatgtgctactaccacccagcctctgactctattcttaaggcagacgtaaagaaaaggatcttaatatgaatttgtaggacatcagcaactgctgaagttctcccaaaggagtagaggatacatcaatacttttagctggaagttacaggatgagatgggtctagttaccatagcattgtcttgaaaaggtccaggccagcttctctcactttacaagacagtatctgcacacacagagaatgtcttatcgctaatcctccaggttatgtacctggtcagagaaaagaggtctggtcctctggaagtctttcctagctgagtcatcaccgggccctggggtcaggaacatttaatttggtactaccccatttactgagttcttcagatgccattcagcaagaatgaaagaagctgcagacagtgtgacaagccacacagagctcccagcttttagtagcttaaggcctttgaaacaggcaatttgaaatatagtacctatcattttactggcaaaggaacctttctttttgaatctttggatttcttctccttctcctccttctcctcctcctcctcctccccctccccctcccgctcctcttcttttggagacagggctgtatagccctggctatcctggaactcattctgtagaccaggctggcctcgaactcagaaatctgcctgcctctgcctcccaagggctaggattaaaggcactattgcccggctggatttcttcgaataaactcactttattgtaatgaactcacaaataaaacatcatgcaactagattacagtagctactcaaacacttgctgagtcccaagcttgctccagagctcagtgagctcccttacggttagaattgctattcggaagcgagggaacgtggcttagagtttatcatgctcattatcagctacagtttcttacttgcttatccactgaaaaaagaaaactatggcagagttaaaactaggaaaaaaattagccttataccctctttcagactctgcctgcatgctgtccttcctctttgcctaatatgacctagttaccccccccccttttttttttgtgtattttaaaggaaactgaggaactttttttttttttttaatgtgcattgctgttttgcctgaatgtgtctgtgtgtcagatcccctagaaccagagttaccggcagttgtgagctgccatgtgggtgctgggaattgaaccctcgtcttctggaggagcaaccagtgctcttaagcaatgagccatccagtcctggaaaactgaggaactttttatttggggagaactcagaaacgtaatggaggagatgagacacagatacaagtaaaaaccatctacaaaggcacatgcgactgtccccgccatcccagtctgctttagttagccctcgtcttgggcgcagattgcagcagcatttgaactaaactactttgggcttccctgcttctctgatccctcctctaaaagctgccagaagtaaatctctaaactgcaagtctgatcacggaatgtctctgcttaaagtacttcagtaccagcctagcccctccagtccagtctcccaacccaggtacagaaggctctgcaggaactggttcccagcaccattttggcaaccatttcactcccccttgccaagtcagttaccccagacaggacgcttgctccacacctcagcttctcaacatgctgtactctttgcatggaaagcccctggtttctgtcatcctattaaatttttcattcacctttcatctttttcctacttttcagacgaaatgctccgcctgcctctctgtcccggtggatccttctgtccttctatttttttttttttttttagtagtccatagcatttgagaacaactcaaactcatagctccactgagggaagatgctgttttctccatcttggtataacatgatgtctgtgtaattgctaggtttctaaagctgaagtgagctaaatagatagaagtgaccactgacaccacaggaaaataccaaacagtaggatgctatagtcatgattagagagactgcaaacaaacaaagagccatacatcaagcacttactctatctcaggaacttgctgagtctttcaaaacactcatttcttttattctttccaaccacttagtcagctggtcattagcacaaacactttaagatgagaaacttaggtcaatttaaaaacccatccaagggggctggtgnnnnnnnnnnnnnnnnnnnnctgctgaaatactcagtcttcaaagtggtttctgtcagatgtccttttataggcagtggcttatataaatgtgagatgcaggtgtcttgaagactgtatggcgttcgttataggtcatcgtaaaacgataaaatgggaatgttatctcatcactataaaatggcctaagagttaaattgcttattgagtgtgtcagtgagatttaatgcttctaaaggtacttttaattctagaatatagagtcacatttgatagaataactttgaataaatattcagaatgttgctttggtagtgaaataaacaaaaggcttgtggttagaagtacttggaaggctctctaatgtatttagtcacttgggcttatgtagaagtaggcttttcccctcctagttttattcagcatggaagaaaggtttttcagctaatatacaaaggtggttatcagtctgcaacaatagagtaaattggaaattatgatatggcgtcaggtgtggtgttgcacacctttagtcccagcactttggaagcagaggcccgcagatctctgaattcaaggccagcccagtctatatagagtgttcgaggctagccagagatactgaggctctggctttcaacaaaaaataaccaaaaacgtaactgtgtgtgcgtgttttatgtatgtatgtatgtatatatatatatatatatatgtatgtatgtatgtatgtatgtatgtatgtatacatgtctgtacacatacaaataaataaaagtgatttgttaacaaatcctttggtcagccgggcatggttgcacacgcctttaatcctagaggcaggcggatttttgagttcaaggccagcctggtctacaaagtgagttccaggacagccagggctacacagagaaaccctcttgaaaaaacaaaaaaacaaaaacaaagcctttggaagcccaggggtggagcaaccacattctgtgagaaggtctcctagaacagtctggaggagtccagtaggactttgcatattgaagatgagcaaaatattttggggcagaaggaatcatatatacaaagagtcataatggttcttagacactgcagttagctatgccctaaaggtgatggatattcaaaacagagcttggggcgggggggaaatctctgtagttattttatttcatggccacagatctacacgatcttttgggagcatcagtcacagggtaaggccgtcttcctagtgtgaagtatagacagacttgtgaaaagatataaagataccctgaaactatatagtctttggaccctggctgcataccaacttacctctcctgacagtttgacaatttcaacttagacattgtcataggttgtcatttaaaatactcttcagttttagcttttattttatttcctttaagaggcatcagactagagatgtgaaaggtctctgaaggctttagaagagggttctctatgggaagaacttaaggggctggagagatggctcagtagttaagagcacttagttgtttttgcagagaacctgggtttgactcccagcacccacatggtggctcaccccaccgtcggtaactccgtatgagcacaagggtagtcaaagaacaagcagcctcctcccaaataagttttaggacatnnnnnnnnnnnnnnnnnnnnatctgcatctgacatcaaagccttgtactcaattctagtgaagctgataatgaggagtagggactgtgttcctattggctgggaaatggaggggggacatatctaccaacgtttgaaaatatgcagtagtttctgaaaaataatgtcaccatgttttattaccttacaaacagtaaatcaggaaagtctttctgaagacagaaaagaaattacagggggttggaagatgaatccggtctaggctgacctagaaccatgtagctgaaaaccttaaactgaatcaagcttttgattcaaggactgggagtacagatgtgtgtcaccacaagccaacttaaaaggatattattcaaatataagaggctgttagcactagttagggagttagaacattccagagtagccccaggaacatatccttacgtgaaaagaacagtgatagaatggattaaacacgtgagagctaaaataatacaaaggaaaatatctgagcccttttcaagcaagtttttatgtgcaaatcaactcataaagattgttaaaaggtatttatactaagtactaaaagcaaaataccgaatgctaatggtgtcaacaatggcttaagctattccccacccccagccccagggaatgtgggctaagggtctggaattttttttaactccgaagagtcctctgtttagcatgtcaatcaggtttgtattctgttcttaaagcctctctccaggttagccagcctcaaatggaaattctgataggggcctgtgggggttcaggggataaaagcacttgctctttcagcaagctggatgacccgagtttgatcccagagacaccacaaaggtggaagttaggaatctattccccaaagttgtcctctgagcactcacctggtcatgagtgcgtgctcagctcacacacacacacacacacacacacaaatctggaaccagaattctatcttggtaattactgaggttgctttgattccagcaagtcactcttggttcaccttggttctttcaagtcctctgaggctaaaacttcaaggcctacaaaccactttccagacttttctttttcgagacaggatctagcctggaactggccatgtagaccaggctggccgtaagctcatgatttggatctgcctgcttcaaaaagcatgcacccccacccccccccccctggttccagacttttcgtatagctctttcttctagtcttaatttcttcttcttatggccttttttattattacttgaatacccactccctttctagtgtctttcaaaatactatttctctctccactcagttcttggctcttgcatttgtgctacagaggtcacacgggctgaatgaggctcaacacttctccgacttttggtacagcaccctcacattcaaaccacgtcctccgcccctctccgggccacccaaagatctcaaaccaaagcagagcactgataagccgggggcgtttcacaacagagataaactggaaattctttggcgctccggcatcctgagaatggctctgcatcatctcataacttacttcttgttctcttaacgcaaggacaaggcgtaaagagaacactctaccccacttcaagaccgacaacgaccctgtcaatcctttattcaagccccattcacaccactccggaacacggaatagctcttacagcagttccttgggcaaaatatctcttgccagttctgagtttacagaatgaacggaaacgtccttcggccgactaggaaatgaaagagttaaagatcgacaacctgatggattctggggttttcctccctccacgccacaaattaaaacgacgaggaaggaagagtttgcccaatgtaaagatgaaaacggttaccttcaactgccagacttctgccccaaacaatcatggctacctaatcccacacgaatgccgcctacctaactaaaaaggtctagccgaaggtttcaccactggtgccgtctcctgcccaattccaaaatggcgctgactggcctcactaagagtttcgagcttcccatgatcctcactggcctaaaggtcaggtgacgcaagcctcagccggaagttaaggaataggcgcttccagcccgcggcacttgcgcagaaggctctagacgctgagaggcaggaggcacttgggatcgtccgcagggtttgggacagctacagaggccgccacggagcccgccggagcccccgttcctgctggtgctgccgccgcccgaatcggaaccgtcgggctgcagccgccggcaatgccgcgaaggaaggtgagaaatggcagagaagggatggcgggtttctaaggggagtcgattgagtaacgtgacgcggttggccacgcctcgtcgtgcttgggttccaactttctggtcccccgaacctagcctagctactctgtctcctctcggtaccagacagaaaaatgtgggcccgaccctggcctcggcctatgcctgtaactattcccgccctctgcttgcccggatcggaggcgttcttgttaattggtcgcggaaatgtctagaagcgtattgattggatggtgacgccgcctgtttgggcccaacggtcacctccccgcgtgcgtgggcggtgtctcggtctggccccggtgctctccgactggctgtggcgaatgctctcccttctctttattggcccagctttgcagtctgttcttgtggcgggtgcggcttagcaaggcctggattggggcgaccaacgccccgcccttccggatagagatggcgataggtgttgtaaaggcgagttgggaagaccactttcctttcctggtggggggattacaacaaagccgaggatgggtggttagaaagccagcgcccacccccaagggatagctcgcaggcctgttgcgactcagtcaccgtcttccacctatttgttcagtttgacatttcctggtcagtaaatgtttgttgaactgtatgacatttgccccatatgttcagtcgtaaaatgcaaagagcagtgttacgtgctagttgctaggaattcgaaaagtatgcgtgatcactggcttaaagggttatcgctgttgagagaagaacacaaagaaccatagttcatacagtctctgcttgaaattgtatacactgtaagaaagctgttaacgtgggaaataagtaaagagctgattttcagggttaagccaggcagaattgataggtcatggacgggtgtctgggtctttggctgagatgaccctaaagtttgccttttagtgacattctgtgcctctatttacttgtggtcagatttttgaatgaaatatttggatggatagacggttggtattcatatttctgcagagatcactcttcatggaagctttccaagttaaatatttacattaatgtctcttgcaatgaccagagttgacaggtagtatttttttaaaagattaatttatgtattttatgtatgtgagtacactgtagctgtacagatggttgtgagccttcatgtggttgttgggaattgaatttttaggacctctgctcactccggtcaactctgctcactcaggcccaaagatttatttattattatacatgagtacattgtagctgagtttagacgcacccagaagagggcacaggtgtttgtgagccaccatgtggttgctgggatttgaactcagaaccctcggtagagcagtcagtgctcttaacctgctgagccatctcatcagctcgacaggtagtatttatatccaggcataccaaatataagagacagacctactggtttgttggaatgatctagtctccttttagcagtttccaaatgtaaaagtggagaatgtaaattcttcctggatgttatgatacaagcctttaattccagcacttgggaggtggatctctatagtttgaggtacacatggctgatatgctggggtgtcctgactcaaaaagaagaagaaaatgtaagttcttgctgggtatagtgatacacacctgtagttctggcatcctggaggctgaggcaggaggctcatcttgagcttaaggcaaacctgggttatataataaattccaggccagcctgagctaaatagcaagaacctatctcaaaaccaacaaaacccaaatgtaaatatgttggtaacttggttgatggccaatctgtcctaatctatccttaggttatttagtttttttatatgcctcatgtagtgtgatactaaatttctgtttgctagaaaatattaatgtttttagtgtgggttgttagtcacaggatatatgtgtcctctgtaagaatctagtaactccaaacatacttggcccgagggagcttattctttgaataaagcgttggggcctgggactaagctatagctcagtggggtgtggttagtgccgggaagccctgagttcagtccttcgtctgtcccactcccttttcctgccaaagatagtaggactgagtttgaggagttgtagtgatttcagcaagtactctttgtctagcttagaaaagagcacgtgtcagtgcttactaggtaaagtaatcttcatggctcatcacccttccagaggccgagagttatggctagggtgtggcatgcgtttttctgagaacctgacacgtggggctgcagggattgttcagctggtcagagtactcattgctcttgtagaggactgggttccaagcaccttgtttcaagcctcacaaccgcttatgactccagtcccaggtgactggacaacctcccttgacctccgagggcgtgtatgagatcaatatacaggcaaaactttcacacatacagtaaaataaatctaatttttaaaaagcccggtttgaatacctatttagtttttagtataaattcctttccagcagcacttataacatccatgtggagaaactttgaggactgatggttaagaaaataatttgtatcttttttttggttaatttctttcagtgggtaagagcacccgactgctcttccgaaggtccagagttcaaatcccagcaaccacatggtggcttacaaccatccgtaacaagatctgactccctcttctggtgtgtctgaagacagctacagtgtacttacatataataataaataaatcttaaaaaaaaaaaaaagagctcctagaactggagctccaggtagttgtaagctgccatggatgttgggaattgaacccaggtcctctggaagagcagcaaatgctcttaaccaccaaaccatctctccagccccaagaacatactttgaaatgaccccggtcagggtttctctgtagctctggctgtcctggaactctgttatgtagaccaggctgccctggactcacagagatcttcttactcctaggattaatggcatacaccaccatgcccagctaatataatttttattatattataatatataatataatttttgttgatggagaatttgaataaaatttaccccaaagttcagtgaggcctagcaataacattttatatgccatcttggactttttcttttccttttttttttttaaggtttagttgtactattttaattatctggatgtgtgtagggatgtgtgagaacaggtgcctgcggaggctggaggtatttggctccctctggagcgggagttacagacttcagttgtgaactaccaagtgggcaagtgctggcaaatgaactannnnnnnnnnnnnnnnnnnntgtatgtgtgtgtgtatgcatatatgtagactaccacatgtatagctaggtactgctagaggccagaagaacgagcatattaagagctcctagggctggtgagatggctcagtgggtaagagcacccgactgctcttccgaaggtccagagttcaaatcccagcaaccacatggtggcttacaaccatccgtaacaagatctgactccctcttctggtgtgtctgaagacagctacagtgtacttatatataataataaataaatctttaaaaaaaaaaaaaagagctcctagaactggagctccaggtagttgtaagctgccatgaatgttgggaattgaacccaggtcctctggaagagcagcaaatactcttaaccaccaaaccatctctccagccccaagaacatactttgaaatgacttttttttttttttttttttttccccgagtcagggtttctctgtagctctggttgtcctggaactctgttatgtagaccaggctgccctggactcacagagatctcctaggattaatggcatacaccaccatgcccagctaatataatttttgttgatggagaatttgaataaaatttaccccaaagttcagtggggcctagcaataacattttatatgccatcttggactttttcttttccttttttttttttaaggtttagttgtactattttaattatctggatgtgtgtagggatgtgtgagaacaggtgcctgcggaggctggaggtatttggctccctctggagcgggagttacagacttcagttgtgaactaccaagtgggcaagtgctgacaaatgaactagggtcctttgctggagcagcctgtgctgtcagccactggactgtgctttttcttttgtttgtcctttttatttttttcttgactagccagaccattttgatttgggtgttttgttgttgggttgggtgcttttatttccaatttctagtgattcagtccagattgtttcagaattagtgataatacacgaagaattacttctcttctctgtctgctgagtacaggtggtttggttgtaggtcattccactagcatgtctgaaaggaagggcagcgcctctgcacagcagggaggggaaaggctggctggtggtggagtccttccttatgttggaacttggtacttcagcatcatggttcattttacttccagtgctaatagaaaactgtagtaaatgcttttgtgctaatgtctggatctatggtattgcagagaaatgcaggcagtagttcagatggaaccgaagattccgatttttctacagatctcgagcatacagacagttcagagagtgatggcacctcgcgccgatctgcccgagtcacccgctcctcagccaggctaagccagagttcccaaggtaaacatgttttcctttcccctgacttcttcacagtggacagtggtgtcattctgttgtgctggttcatagggatactgctcctgagcttgatggagagcagtggttctcagccctcctaacactgcgaccctttagtacaattcttcatgttttcgtgacccccctcctttaaattattattttttaaagatttattgtgcgtacagcacctgtctgtgtgtgtgcctgcaggccagaagagggcgctagatctcattatcgatggttatgagccaccatgtgggtgctgagacctctggaagagcagctgtctctccagccccccattaaataatcgttgttacttcataaccatagctttactaaggttatgcatcatactgtaaatatctgatacgcaggatacctgacatttggcccctgtgaaaggatcatttaataccctacctacaaaggggttgagacccacaggttgaaaaccattggtatagatggtagaatggtcaaagtgtaaggcagctgctgaaatactcagtcttcaaagtggtttctgtcagatgtccttttataggcagtggcttatataaatgtgagatgcaggtgtcttgaagactgtatggcgttcgttataggtcatcgtaaaacgataaaatgggaatgttatctcatcactataaaatggcttaagagttaaattgcttattgagtgtgtcagtgagatttaatgcttctaaaggtacttttaattctagaatatagagtcacatttgatagaataactttgaataaatattcagaatgttgctttggtagtgaaataaacaaaaggcttgtggttagaagtacttggaaggctctctaatgtatttagtcacttgggcttatgtagaagtaggcttttcccctcctagttttattcagcatggaagaaaggtttttcagctaatatacaaaggtggttatcagtctgcaacaatagagtaaatgggaaattataatatggcgtcgggtgtggtgttgcacacctttagtcccagcactttggaagcagaggcccgcagatctctgaattcaaggccagccccgtctatatagagtgttcgaggctagccagagatactgagactctggctttcaacaaaaaataaccaaaaaagtaactgtgtgtgcgtgttttatgtatgtatgtatgtatgtatatatatatatgtatgtatgtatatgtatgtatacatgtctgtacacatacaaataaataaaatgatttgttaacaaatcctttggtcagccgggcatggtggcgcacgcctttaattccagaggcaggcggatttttgagttcaaggacagccagggctacacagagaaaccctcttgaaaaaacaaaaaaacaaaaacaaaacctttggaagcccaggggtggagcaaccacattctgtgagaaggtctcctagaacagtctggaggagtccagtaggactttgcatattgaagatgagcaaaatattttggggcagaaggaatcatatatacaaagagtcataatggttcttagacactgcagttagctatgccctaaaggtgatggatattcaaaacagagctggggggggggtctctgtagttattttatttcatggccacaaagctacacgatctttgggagcatcagtcacagggtttcctagtgtgaagtatagacagacttgtgaaaagatataaagataccctaaaactatatagtctttggaccctgcctgcataccaacttacctctcctgacagtttgacaatttcaacttagacattgtcataggttgtcatttaaaatactcttcagttttagcttttattttatttcctttaagaggcatcagactagagatgtgaaaggtctctgaaagctttagaagagggttctctatgggaagaacttaaggggctggagagatggctcagtagttaagagcacttagttgtttttgcagagaacctgggtttgactcccagcacccacatggcggctcaccccaccgtcggtaactccgtatgagtacaagggtagtcaaagaacaagcaacctcctcccaaatatagttttaggacatctgtattatgatgggctatatatagcaagggaagaaacaggcatgtcgctaatattggtaaagaactcttttcccactgggggtaaggcacacacgcctttagtcctagcagctcagcagacaggtgggtggatcactgagtttgaggccaacctggtctacaaggcgagttccagggctacactcagattctgttttggaaaacaaaaaaaccaagaccttactcacagtaagtaagcgtgaggaatatactactactgtctatcatttatttatttattttattttccatgctaaagtgagtatttttctctctcatgggcaaagaagcaagcttagagacattagcttgcataagatgccacagattgttgctatggtgaagtgaaatcaagtggagctcagtctttactccagatcctgaaggatcatcctgtaccaccgttaggatattgatgtagtccacctgccccttggcatgcattatttagtaagatgcatataatctaaggctgtgttgggtttgtgaaatagaagagaagaaatagtatgctgattattgtgtgaatggatataaaatggtctttctttttttttttattttatgatcttttaaaaccggtgttagattccagccctgttcgaaatttgccgtctttcggcactgaggagcctgcctattctaccagaagggtgacccgtagtcagcagcagcccacgccagtgactccaaaaaagtaccctcttcgacagactcgctcatctggctctgaaacggagcaggtggtggacttttcagatagaggtaagtgggtctgtgggactggctctgtgcagagggcttggtcagttttcttttttgtttttttgagacagggtttctctgtatagccctggctgtcctggagctcactttgtagaccaggctggcctcgaactcagaaatccgccagcctctgcctcccaagtgctgggattaaaggcgtgcgccaccacgcccggctttggtcagttttcttaaggaacattttggcactgcagagagattgtcagagtttaggtcggcagacactgttgacttgattccttttggtttgtttgctttgtttgtttatagttttgaatcagagtttgaaaaatatagcctcaaatttggaatcctcttgccgtgacctagagttctgggactacagatgtgtgccaccgtgctcaatttatcgaatttcttactgtatattttgcttgctagagtattaggtgtattcggttggatgtataatagggagaaggagacagagccttccgaacctccacataaaacctagactttattagggccatgactactggcccatcttacctccagactgctgactaggagtgaccattagtgatagacagcattaggttattgaggctatgatcccatactttaagagccttagagcaagagacattaaagcagatcttgcaagctactgagattctccaaccaggcaacatgattaatttgttggtttgcagagtttcattatttttaactttggtggtagtgcttagaagcacagcaattttcatattgtttggactgtatgtaagtctgtgaactacatttgtgcctggtacccatggaggccaggagagggcatgagataccctgggacaggggttacagttgtgagctgctgtgtgggtgctgggaagcaaacccgggtcctctggaagaatcgcctgagctcttaaccagtgagtcgactctcagctggtgggttgattggggctttttgagatagtgcctctttgttcccaggtgtcctgaagctccttatccagatcaggctggctttgaactcaggggtcaacagttaacttttgagacaggacagactggatggccatttacttggtaattattaactggagctgaatagtagttgtcacctctggatagacaatgacgtcctttgagcttgtccaagccctataggtatctggtttgtagaccttggtttatgagtgtgtagtttctgtagaactctcggactccagctatcagaccctaagtctgctgcagagatggctcagtgtttaagagcacgtactgctctttttctgcaggggtaagggagcagagtctcactatagccctgactgtcccagaactcactctgtagaccaggctggcctcaaactcagagatctgaatccctctgcctcccgagtgctgggattaaaggcgtgtgccattacatatagcacatgtgttgcttgctcttctagagaacctgagttagggtcctagcacacatgtctggtggctcccagctccccgtaactccagttctaggagatctgacctttgccagcccccacattatatccacatacacataatttaaaatacatcttaaaaaggaaaaaaaaagagagcatggtgctaaatgtctttaatccaagcgtttgtaaggtagagtcattggatccctttgtgtttagggccgtcctgccctacatagaaagttccaggccagcaagggatacatagtaaagactgtctgtctgtctctcttttaattaaaaagaaaagaaaaaagtgaatttcaagattatgagaccctagtaacttcaggcaccaggcgtgttgattatacacatacatgcagataaaacgttcatactcattaagtattaaaataattttttaaaattatgtttggcctacatatatgtcttcgtatcacttgcatgctgataccattgactcccctaaaactggaatccctggactggttatagacaattatgagccattgggggggggggggggcacgaggagttgaactcaggtcctctgggagaacaagagcagcctcttaactgctgagccatttcttagactcttaaaaggaaaaaattatatctgcttcttttttcctctttcttaattggggttggttttgaggcttggtctctaggtagccttgctctgtcatccaggctggcctagagaacacttgcctctgcctcttcagggctgggattaagagcacatgcacaccaccacacccagctcagtgattttttttctgtcctgtgagtctctaggaaaggaaaatgggctcattatttatttacttactttttcaataaagaagataatagatttttggtgaatttttgacattagttataaatttcactattaaacaacactcgtgatggtgagaacacagttttgtcatatttggcttcttttggttatttttcagactttatatttgattttgattactcaggattaagagcttaggagaaatatggagaggtaacatgtagtacctgaacttcagatttacattcagtcagaagttataccaaagtgtcttcaatgtcttgtagcagataagtagctaacaattactggttaggtcttgaaagactgtagacgtagcttgcttgtgggctgctggcatggcatgcacgagcccctgcttttgttccatagcactgcataaagctcggcatggtgtacatgcctgtaaactcagcactaggacaggagaggcaggatggtcatgtattcagggtcattcctagctatatagagagtttgggctcatgacactaggaagagaactgcaaagcccaccaactcttcttgcctagccagtctttaaatagagggacccactcaccagttctaccaattgctttttctttagaaactaaaaatacagctgatcatgatgagtcaccacctcgaactccaaccggaaatgcaccttcttctgagtctgacatagacatctccagccccaacgtgtctcatgatgagagcattgccaaggacatgtccctgaaggactcaggcagtgatctctctcaccgtcccaagcgacgtcgatttcacgaaagctacaatttcaacatgaagtgtcctacgccgggctgcaactctctaggtgagtgtgccccagcttcatgaccgttgtggcctggggatcctgttgtggggttgtgaactcagagcaatcgtgaacaagagctgttcttggcctattgtctgtaaatattaacagatctggttgcaggaaatgtaacagtgatgaaccactcacttttttcaacatgtttttcccagtgaaaaattccctcctttcctaagcaggaacaaaactggaaaacaagttctctctggaatgcctcgtcctatggcgggtggttggtgcttataggtactgatagagtataagataatgcctgataatggcttcgaggccactgctgttcaggagacaaggaaaacagagttgttttttttgtttgtttttggtttttcaagacagggtttctctgtgtagccctggctgtcctggcactcactttgtagaccaggctggcctcgaactcagaaatccacctgcctctgcctcccaagtgctgggattaaaggcgtgcgccaccacgcccagcaagaacagagttcttaagaggctgtaaatcaggagagtttgcatgagaccagacctaaagatgcctttgaatatgaatttttttgtttcctagtgcatataaaacttttctttatacttataaagtatgccagtagcattgtgtactttttaaaggtaaattcttttaaaaatgttttgttaaagatgctaatgtaggagcagttgggaaattggtgccagtagacttgttaaacagccatagccttgagtttgtaaggcatgcagtctctgagagcaggcttccacagcggtgacggcactctctactctgtgtgtggtcccacccaacagttttctctaagaaatggcctcctgttgcttaatagtaaggacatattttgagagcatgtactgggctggggagatggctcaatgggtaagagcactgacggtccagagttcaaatcccagcaaccacatggtggcttacaaccactcataatgagatctgacgccctcttctggtgtgtctgaagacagctacagtgtatttacatataataaataaataaatcttttttaaaaaaagagagagcgcatgtacatgacaaacagagatgatatagccttctatacacttgggctgttgggggtgtgtttgtatatgacagcctattgctcctacaccccggtgagcaaagcaaactgagataagtcaggaacaagagaacagggtgcttttagagatttggtaaactcaatgtatgtgacagttgcttgtgtaacttggatgctactttactctgaactttattgttaaatagaaggatttgaagtaattttgagcagggcgtggtggcaagtgccattaattttcacacttaggtctatgtagaaggagttggagttcaaggccagtctggactgtctagtgagcctgtctccatgtaaatagaaaaacaatgaaaaatagaacaaatgccctaaaccaattaacatggctgcttatattgtcagtcattattgctgtgtagaatggtatgtgctgcatttttatatagtcagcatagtaggtttgtttgtatcagtgtgaccacaaatacatgaattgtgcttgcacatagcaactgcaacaccacaaacctatcgctagggggagcttcagccccgcagacttctggggcccttacttgcctgctctcctagtttttatgtttaagagatccactgtttgctgggcattaggcaagatgtgactctaagtatgtgggtctcaaaagttaaaatgttttctttttatcttttttttttttgataggttcttgctatgtggctctgactggcctgatagtcactgtgtagcccaagctggcctcatattcatagaactaactaacttaattactttctttctctctctctctctctctctctctttctctttctctctttccgagacagggtttctctgtgtagccctggctgtcctggaactcactttgtagaccaggctggccttgaactcagaaattcgcctgcctttgcctcccaagtactgggattaaaggtgtgtgccaccactgcccggccagttttctgtatttgtaaggtttacatgtgtttattacgtatgtgggatgggtgcccttgttacagcatgcgtgtggaggacacgctttttgaattgattctttccttcaccttttatgtgggttgtagggatcaagctcatgttgccagacttgaggtccaggacagccagtgctacatacatagtaagaccagggcgatcaatcgattggtagatagatatagatagatagatcgatcaatagataaatagatagattgggtgagtggatagatagataggtggatactgcttaaggggctaagaagccagctctgtgggtaaaagtgctagccttacaagcaagcctgataatggaacccttataagtgtatctgtaaagttcccactaccctgaaataggcagagatagacttattgttggaagccagcagagccaggagcactgctacacagcacccgaaacgagagagatcctgtctcagcaaggtgggaggcaaaagaaaaacagaacagaacatgttccctccatctgcagatcttatacacacactgcacatgtagtcagatgtacatatgggcacaaaatgacgtgtagaaaggagagcaagaaagggtaaatactatgtgaagaacggaatgcaagtaatggacacttaagccatgaaagaagtacaaagctaattttccagttttaagtgtggggttttttgtttgtttgtctgaagatttgtgtatatatctgatagtgaaagtgtaaaactcattgtgaagtcccacagcttcaggttggttagttattctaactgttcagaaattcatttgacatgtctggttagtcccggtatgggttttgttttgttttgcgtgcagattctttataataaattttaataaattgcaaacaaacaaaaaggtagaaggcaagaatcagtttccaaatgtcctctttagcatacacatattagtaatgacaataaaaacaacagtaatactcagaaataatgacaatgatgataggacctgtagccgggcggtggtagaacatgcctttaattgcagcacttgggaggcagaggcagacagctgccagcatggtctacagagtgagttccaggacagccaagtctgtgtagtgaaaccctgtctcaggagggaagggagggagggannnnnnnnnnnnnnnnnnnnnnnnnnnnnnnnnnnnnnnnnnnnnnnnnnnnnnnnnnnnnnnnnnnnnnnnnnnnnnnnnnnnnnntgtgaaaattaatggcacttgccaccacgccctgctcaaaattacttcaaatccttctatttaacaataaagttcagagtaaagtagcatccaagttacacaagcaactgtcacatacactgagtttaccaagtctctaaaagcaccctgttctcttgttcctgacttatctcagtttgctttgctcaccgggtgtaggagcaataggctgtcatatacaaacacacccccaacagcccaagtgtatagaaggctatatcatctccgtttgtcatgtacatgcgctctctctttttttaaaaaagatttatttatttattatatgtaaatacgctgtagctgtcttcagacacaccagaagagggcgtcagatctcattacgggtggttgtgagccaccatgtgggttgctgggatttgaactccggacctttggaagagcagtcgggtactcttgcccactgagccatctcaccagccctgatgccctcttctgacatgtggatgtatatgcagccgaggattcttacattaaataaaattaaaaaaaaaaaaaagtgtgctgagccgggcagaattggcgcacacctttagttccagtgcttgaggcagagcagagtcacgtggactcttgagtttgaggatagcctggtctatagatcaagttccaggatgccaaagttacatagagaaaccctgggggggtggggcgcggggcggaaaataggggactttcgggatagcatttgaaatgtaaatgaagtaaatacctaataaaaaattggagggaagagccgggcgtggtggcgcacgcctttaatcccagcacttgggaggcagaggcaggtgaatttctgagttcgaggccagcctggtctacagagcgagttccaggacagccaggactacacagagaaaccctgtctcgaaaaaccaaaaaaaaaaaaaaaaaaaaaaaaaaaaaaaaaaaattggagggaagaaaaaaggtattatcactaggaaagttatatgggaaatctctgttaaaaaagtatagcttttccataagcctgaaattatttgaaattaaaattgtattagaaaaataagtacaaaataaacctttcccaaggaaaagaaaaaaagaaaaagaataaaaaagaaaccctgtcttcaaaacaaaacaatggggctggagagatggatcagtggtttagggaactgcctgctcttctagaggtcctgagttcaattcccagcagccacatggtggctcacaaccatctgtaatgggatctgatgccctcttttgtatagcgtctgaagacagctacagtatacttatataaataaaataaacctgaaaacatagcatgttgaatcttgttcaaaattatcaaaatgtgtttctatattatagaaatgtttttaatgaatttcttttgattattaaaaggagttaaatgtatgatagttttgcatagtgcgaaagagtagtatccttgttttcaaattcctaaagttggattaacttaacaaaggtttttgtttgttttttggtttttggagatagaatttctttgtgtagccctggctgtcctggaacttgctctgtagaccaggctggcctttatctcagaggatggtatcagtattaaactcctttgttagccaggcagaggtgtcacacacctttaatcccagcactcaggaggcagaggccagttttgtctgcatagtgagttccaagccagccagagcttctcagtaggccctgcctcaaaacgtaaacctgactacatctcagattgcctgctctggaggaaaatagtgcatgagggtacacatcgggatcttcactgcagctccatttggaagcatttgtttaataaaatgaaatggtaaagccagacttgtcaaaatctcacttcctaggtgtgcatgttcttcctggaaattaagttttccctcctttaacaggacatcttacaggaaagcacgagagacatttctccatctcaggatgcccgctgtatcataacctctcagctgacgaatgcaaggtaacgtgtgctccttcattcagggtgtattcaagtgcttgcgacgtgacccgcactttgctaagcactctgggtacagcgttgagcctggggaacaaggtctgttcttacatgtcagtggaggaagcaatggaaagaagggtttggtttggtttggtttttttaactccacgaacaaataaaaggattgtactatgtagtgagtgttggggaaggagttaatagggagatttatctttagagtatcgggattttctccactgccgcattcatttccttggtaactgaagtcatatcctgccagggcgcatcctttcagaatgtgcgtagatagttgagcctaccgctccacctcaggctttcttaacaaatccgtgaagttgttttgctttttcataattttctgatgtccctcttgtttgtttctgcatatcctgttcctcttgatttctgtcagtcacacctgttcttggctagttcttttaattttcctaaataaccttcgggacttggatgatgtgtttgagactagagcctcgggtcttcttttgtgcattcctgtgtaggttactgctcccaaggatggaaccacaggtaattatggggaagcaagaattgcaaatagtaattaagtagactcagggagtctttggacaagttttccaaactaaatgctttgactgcaccaaagtgttacttgctttttttgttgttcttttgctcacacacaaggcctgggtcacaggttttatgcttgtatgagcaagtctcatttggaaaagaattcaatttcctgttctccttgctacaggaacttgttctaatatacaaggtctctgggcggggctgggagactatttcttcacacgtttaaattttcaccaaataaaacgtgaaatgcttacatgtatttttctgccaaagaccctgctttttgtcttcattccaggtctttgtgtatgagacagcttgccttctgtgtcagctcttcctgttgtctttttactgtcttaggctggatgagtgcaagcatgactgtgttagcacctgattcagacgctgaccaaacacttggacttcttcccctgaaaaataactgtcacggttattgtgacagtggtttcagaatgctcctctaccgcttgtctctaaacatctgatagtgcttcgctttgcatcagtcttcttgaatcatggcctgaagtaatgtctataccttaagtaccttaagcagtttgagaaatttcagaccaggggaaaaaaattgcgaataaagaaggcatttctgttataaagttttacttctgccctgtatggggaagtgagactggtgtcagccgtgctttactactgggccatgtgcttgcaggaaagcactagagatgagagcctgagacaagctagctgcctccctagcctcaggaagttcttcagttctaaacttcctgcgtgtgaatgatcgctctcatatttcccagtaaacctttcaattgtctttcatttttttgtggatgcaggcaactttttgtggatagcaaaggattcagtgactaagataaaaatcaaaagataggggctggtgagatggctcagtgggtaagagcacccgattgctcttccgaaggtctggagttcaaatcccagcaaccacatggtggctcacaaccatctgtaacaagatctgatgccctcttctggagtgtctgaagacagctacagtgtacttacatataataaataaataaatctaaaaaaaaaaaaaaaaaaaaaaatcaaaagataaaagacacctgcaaccaaggagtttacattcccatgggaaacctgtacattaatatccatttatgttgtgatagacaccatgaaaaaccaatagagaaagagagggactgtgctcaaagggaggctaacatactgcttttgctagaggaggtcaagaaagccatatgagattgacataggatttagatgtttacggtgtcatagtagcaggggataaagaatcgagtggggagagctaaaggagacagaatagtaagtgccgtggccgtgagctggggatgacagggtttgaaggtaggctgtatgattggagcaccatgggaaatgaaggcggaggattgagatcataaaggatcaaaatgttcagcacaggactatgttttgttccgatggcagttggaagcatttagagggtgcaggcagaagaagaatgtgtctgaagcaacaactacttaacttgtagagaacaactgcaggagaaagagatgacacccgataggtgcattggaaacatgcttagaagttcttgctgtaaatgatagcttagaccagtgtgttattggtaaaatgtcgaagataagattaaattcgggatatgttctgaaggagaggaagctactaggagatgggagaaaaagaaatgaaagattccaagtttttgaatgctcacctgttgagatagtagtggagagatgttgagtgtagcagacgtgggagatctattggttattccacttgagcctgctcagtgatgcaacccaggaggctgataggtgcagggtgtcagttcccagaaggggaagtgacactgaggagagcagtgtgctttctctgtggtcttgtgtctgcagttatatttccatgtagacttggagtcaggtttccctcatcccccttccctttcccagccctctaggcagggtctcgtctccctgtgctgcgtgggctggtcttgaactcttcagctgccttagcctgtatactactaatgaggactgcaggcagatgtcactgtgcccatcctgagcccagcgttttcctgatgtcttcttcatacttcctttccttactctttgtgtttcttcagtttcctgtcagcatagtagaattccaggccagagtcaacattcttagcaaaagtctcagctttacaacattagctgtgatcatttcagttctttgatatttagtggccaagatagcactgtgtggggcttgcctcatctttttctaatagagataagatagcaatgaccaatagcaagaacacttttacattcaaagtatagtgcaactacaggggattatcaaaaattcttttgctttaagtaaatgtagtcttagaagcaggtggatttattgacattgttgatggttgcaggtgagagcacagagccgggataagcagatagaagaaaggatgctgtcccacaggcaagatgacaacaacaggcatgcaaccaggcaccaggtatgggccttgtgacagctctggccagccagtttgagatttgccttgtgaatctcctttgtcccataactgtcttcataggcaagtccatgcctttggtttccaggacaaatcaaaatcactggtcttccagacatcaacttgaaatcatgtttgggttttcaacttgtaatttttcatacagcagacatttccatctcataaatagaggaattaagctatttgtgataataatagcagtagtaagcaatagtataaaatattttggttattttgaaaggttccattgcgcttctgtttcctcatttggcatccttattctaacctgctgttgttggctttcaagcacctttgactttgctggcttatttttagtatcatcagttgcatttcctcagtatttgacacttgtcagctgggccagtttctacttctgtctttctgtgatttgcagaaagcatccttgctctgtcctaatcatcctttctgaactttcagcctgcatagattgcacttaactccttgcttctttctaaatggctttgatctttctgagaactctatatcattaccaagaagagattacatacatatccttcaaggccttgagcgagtcttaagctcttacaggtattcttccaagaccttctcccacagttagtaaatcttctgtatgtattcttctcatgtagttttccccagacgtcggcctttagtcatagctcatcatcaaggtatctgtttctacagttagattataggtgactagcagaggagacacagtggtaagcttgccttgagagctgaatctgaatctattagctgtgttgtcctggggcagccagctggtaaactacatttctttgttctatgaaggagtggagaatgcccacctgtccgggtagttatctaatgcatatgtaataaatgcatagcctcagtgcttgacaggcaaaagcattgtgtaattgatgcttttttgtttgtttgtttgtttgtttgttgtttgttttggagacagggtttctctgtgtagccctggctatcctggaactcaactctgtagaccagagatccacctgcctctgcctcccgagtattgggattaaagtcatatgccaccaccacccaccaatttttgttttttaatgggaatcttgttatacagcccttaaaggtctggcctgggatttatagccattcttctgcttctgttgggattataaacaagagtcacaatgctcctccctcctccattatgacttttgctctttcatattgataaaaataagttcacattcctgaaagggcagtaagaactgttttggatatgtggctgcactgtttctgtactgttacgctcagtatggtagccatgcttataattctatcattctagaaactgagaaaggaggattgtcagccagggctatatagagaagacccgttctctttctctgtatcttttaaaaaagacatggcagtttggattcgtaatctcaacacttgggaggtagaagcaaggtcagaagttccaggtttgaggccagcttgggttataggagagcatgtcttttttaaaaaaagtttaaacaattggtattttgaaaggtgatgagttttctagctagatgctcagttgtgtttttctttcaggcaccaacagagagacagctgcggtataaggaaaaggtggctgaactcaggaagaaaagaaattctggactgagcaaagagcagaaggagaaatacatggtaaggaaaaatccaagactgaactccccctgactgtgactcagatctgagcttctgctgtcagatcatagctgtttactcaggagagcatccagtgaactgtggggctctcttcagtcgcctagcaccctcccacagctgaagtagacttccgtccgctaggtctagggatgcagcgcagttggtaggatcccttcactatcattttaaataattactttaagggggcctgatggtgctgctctgtaatctctgctactctgaaggctaaggcgagaggatgatgagatccaggcctaccagactaccaagcgttgtccaggtcagcctcggcaacttagcaggaccctgtttccaaatgaaaactaaactcccagtcatatgcatcagtagtagcatgtgcaaaggggctagggtcaatctgcagtactggggcagggagacagatttgctcttagaacaaatacgatgacattagaaatggcttcttaagacattcaggggctcaggatatagatgaacatccgagaactaactttgaatataatatacatttcacaataataaggaaaagttaggaatagaatacagaagataaaattaatctgccttaaaatagccaaaattagaattttatcaagtttttagctgtttattttaactacgtaagttacctttttgggaaggtggagagatggctcagaagttaagaattctggctgcttttcttgaggacccaggttcaatacccagcatccacctggcagctcacaactgtctttaacgccagtttccaagggtctgacacacatagatatacattcagacaaaacaccagtgcacatctttttttttttttaagaatcatcatttgtcattttcttcactataccacatcacctatttgtctgtcttcccatttaaagatcttgaattactgtccttatattaaaatcctcaaaccttttatgcataaaatacagctttttatgtaaataattacttttactagaagtgtattagtacatgttttctactgaaatgtagccagacatggtggtctgtgcctggaggccaccctgggcagcattgcaaagccctgtttcaaaaacaaaacagaaaaagtaaagtcagaagtggtgactcacacctgcaggccaggagtttaaggccagcttgagccacaaagtaagaaacctaagccatctggactacagaattagaccctgtcatgaaaaaaaaaggacttttttttttttttttctgagacagggtttctctgtgtagccctggctgtcctggaactcactctgtagaccaggctggcctcgaacacagaaatccgcctgcctctgcctcccaagtgctgagattaaaggcgtgcaccaccactgcccggctatttgagtctttgctaatttaaaaagcgctagatagaaatttttcttgttgcttacattttgccttttttttttttaagatttatttattattatatgtaagtacactgtagttgtcctcagacacaccagaagagggcatcagatcccactacggatggttgtgagccaccatgtggttgctgggatttgaactcaggatcttcagaagagcagttagtgctcttaaccagtgagccagctctccagcccacattttgccttttgaaatagggtctcatatggcagcggctggccttgagcttgctaatatatggctagggctgtccttaagctgattctacacccctaagtgttggaatttcaggggtgtgacaccagccctggctagttgggtttggttttgggtctgaagaaatgattgcattggttgagtgtttgcctctgtgcaggatgtgtttgttgagtttgattgtccagcgccgcggtttcaggcctgcctctaatcccagcactggcaagtggaggcagagctacaggagatcctttctcaaagttggaggaaggggaaggtgcattgtgattttcaaacccagaagtagtcaagaatacctagaacctaaaccttaagtcacagagactaaatttcaaaaagagctacaacagattgaaccatgtcagccataagaaatgcttatagggccgggcgtggtggcgcacgcctttaatccctgcacttgggatgtagaggcagttggatttctgtgttcgaggccagcctggtctacaaagtgagttccaggacagccagggctacagagaaaccctgtttcgaaaaaccaaaaaaaaaaaaaaaaaaagtttatagggtgggtgttttctttagatgctgacgtgtgtgttagagtatagaatgttcttcctgagacaagtcttctatgcctaacaactccctcctcttcttcctcctccttgtcctcctcttcctcctccctccttctccttccctgggaaaggagacttagtaaccagcttggtaaggtttgaaagttaatttaaaactgaattccttttatgtccttaattatttttaattttccctgatgtttcacagttggtaaacatcccaggagctgctctccctgtgcacttgacttgactttacaagttgggcagtcagtgaagtaatgtcaggagcagtttccaggggcccacttccagagttttcttccaggcagcatcttcaagcactaatgcttcgagtacctgcttttttgtcagtgtcgtccgtgaagaagaccctcatgccacatccagagcaaccaggattaggcacaaacccacccagatacctgttttcacagagatatcttttattagtcggggaataaacgttaaagtgactgctttctaactcagcagaagtctaggcaggtgtaattttaagagaacaaggtggggctgtgttagaatgggctaggatgcagtatattttgactgggcgtcaaaattgggtaaatcaaaggggtcataattaggtgaaccaaagggggcttttgattgctggacttacagtacattgatagccagactttggtagtcagcctcaggaggaagaagtggccaaattagggaatagaccttggtagctagctttagaaatgtaatctaatggtttttagcaaggcggagggaatgggggagaaggacaaggcctgccagagccatgcttgccccactcgagctggccagctcgaggattctaggatctattgtgccacatgggggttaccagtttgcctgagctcagtcccccaaacccagtgatagatattttgtaagtagcaagcatctggttcagcttggcttccattggaatggaataaaccaagttccacacagacagtataacccctggttgttttttctaggaacacagacagacctatgggaacactcgggagcctctcttggaaaacctgacaagtgaatatgacttagatcttttccgaagagcacaagcccgggcttctgaggatttggtgagtatcaaaacccccgaggtgaggggagtacccttgtgaaaaacctttagaactgccaaggaaagtgattagcaaccagtctgatgacatctctggctgactttagaggtagtcttctcttttacacggagagcacaccactctcttctcgcccttcccctctctgtttccctcaactggaagatccagtttggcttgaggttggggtggaggtgcttaaattaaaacttagtttgtggtgccttttatttctgttgggtaaactgtacaatctgagaaccctaacttgtgggcttcagcactgccctctttgtagggtttcttttccatttcaatacattcaccctaaaagcatgtaaatgatagcaaagaaaaatggtgaagaccacaaccagatatgttgttgaatttattgatttttgacaagagactctcctcttattgcccaagcaagtttgagactgggatcatgggtgcatgagatctaggcagaaatgctcttctttgtttgatttttttttttgtgtgtttgttttgttttttgtttttttgagacagggtttctctgtgtagccctggctgtcctggaactcactctgtagaccaggctggcctcgaactcagaagtccgcctgcctctgcctcccaagtgttgggatcaaaggcgtgcaccaccacacctgtcttatttgattttgatacagttcctgtggcctagaaaaacagttctagcaactgatttcacctatgataagacaaatgtgctcagggaaatttagtttgtagtgttaatttcatttcctcctctcctttcttcttttttttttttaattgatttatttttacttactcactttacatcccactgctccctctcattatcctttcccctccttccttttattatatgggttgcaggaggcagggtttggctgctctgggctggaatatttattggttgccacctcctgcttttcttttccatcaagaagatgattgcctctgctggccccagtcctctcaccagctgggtactgcagtgattgcctgtcgtgcacgtgtaatcccagccctagtgagctcagggaggagggccaggagggcagccatcaacagcccagaagtgcaagcctgaagagccacaccacagaaatctactgtgttggctcatacctgtgaccacagtgtctggaaatgaaggcagagaattcaggagtgcaaggtcatcctcagtacatcctcatttgaggttcagttaagaaaagatacctgggcaggagctggagagatgactcagtggttaagagcactggttgttcttccagaggtcctgagttcaattcccagctaccacatggtagctcataaccatctgtaatgggatctgatgccctcttctggtgtgtctgaggacagctacagtgtgcttataaataaacatataaaatgaatagataaatctttaaaagatacctgggcagtacagctggcaaattttctgtgaacctgcctgattttccatgctcaagtaataccttagtagccatgtatggatagaggccaaatctagctaagtatttttatagcttagttgctggcctcatagtttttaagaataaaggtaataagggctgaagatagctcagcagttaaaagcatttgctgtttttgcaaagaaactacattcagttcccagaacccatgtggtacctataacttcagttttgggacatctgatgtcctcttctgacctctgcaggcactaggcatgcatgtgagctatagacacatgcatgcttgcacccatgcttatacacaaacaaaacatccatgtatatcatatagataaaaatctaattataaaaccaaagataaagtcttctaatccttatttgttttggtttctttttgccaacaggagaagttaaggcttcaaggccaaatcacagagggaagcaacatgattaaaacaattgcttttggccgctatgaactggacacttggtaccactctccctatcctgaggaatatgcgcggctgggacgtctctacatgtgtgaattctgcttaaagtacatgaagagccagacaatcctccgccgacacatggtatgtctacttgagttcagctcaccagggtgatgttacacagtttcccagttatgttctagaggcaacgtaaacgtccaaaagatctcccaagtgtccacagcagtcgggtggagacttaaggaactgaaagtcacatttctgggttaaccctctgccagaatcagggctccgtagcatcctaactacatcttgtccgagaacgtcttttttttttttcttcttcttcttgtttttttgtcttctgtttctttttcaacatatgaattacctctccctaaagtttgtgtttgtaccaaactcaatgagaagacattttattacataggtcagggagtggcttatatataagatggtgggtgtctgtcttgaatgaatgcatgttgtataggatatccacctttaatggatgatgaagataacagtttgcccctttttaacatcctgtatattaaaataggaaaggatgtgcatacccgagtctggtgacttctatgagtatagaattcaagtttggggaatgcaagcttctcctccccattgcttcaggggtaaccactgaaatggcttctttggcttggctaatgttttaaacaaatagctgttgcattagtttggttatcatggacagaaccagcaggaataatgggagaagataggaagggtaatgctaattgggctaagataaaggattaaaatggcttttccaaggacaatagctcctcccaggatagaactttgaagcaattccagttaattcatgcttttaattagaacatgacatcatgccttgcatgctgttccccgcctcccccaggtcccccccaactcccagctaagcagggaacactccctaatacttgcgtgggtaagaattaaaccactgagctataatcctaaacttgaaatagaattcttagagggtgggtatgtgatttttgtttgtttcaaataggtagttgttttcttacctctcttgagtggtcacgtgtccaatgtggaaccagccactatgtccagtgaaactttatgtttgagttgtcaacaagatgtagtaaatgatttaataagaaatttcctgggctggagagatgactcagtgattaagagcactgactgctcttccaaaggtcttgagttcagttcccagcaaccacatggtggctcacaaccatggcaatgtgatctgatgccctcttctggtgtgtctgaagacagctacagtgtactcatatacattaaataaataaataaataaatcttttttaaagacagaaattttctgtatatgtcaatgtaaactttgtgtatgtatgtgtgtgaatgtttgtgcatgtatgcacatgcacaacatagcacacgtgtgaagatgagagaacattctggaagtcaatcaattctcttctcctatggaggctcccagaattcaatttgagtcatcaggcttggcagcaaacacctgtacctgctgcgacttctcgatttcagggccagggcttaattcagtggcagagaacttggactgctgcctaagatgctgggcacatcttagcaccgtgaattaaacattttgagaataaagaaaagagtttggagccaggcctccttccttttaaaaggagccatagaaggattttctctgtatctgacatatggagggaggtgggcagacagtgagtggctcatggcgatcatggtgatcccatgatgacggtaggatggcaataggaagtgattggcgaaggtgagcacaacacacttagcaacactaagctgcttaagaacttcctgttggcatgtggtgttttattgtaagaaaggatattcttatttatctagcttttacgtagtatgtgatttaatatcttgggctgagataatgccaaaaataatccagaaaacttgagccaaacagccatatatatccttagatatatgcaaccgcttaagaaagctttaacttttctgaaaacaattgatttcactgtcctcaaatgtattcagctgtccattaactcagccacatttcccaatgaagaaacagggtggaaggaaaatcttactgcttcatgtgaactccattctcttgtaggccaagtgtgtgtggaaacacccccctggtgatgagatttatcgcaaaggctccatctctgtgtttgaagtagacggcaagaagaacaaggtaaagagtggtgactcgagagaaagagatgcatcgatggggtcccaaaggaatgattatcttcacaaacagttgtgagggagataggaattagttctatttcctggatagtattggtgtgatcattctctctagactttggtttgggtgagtttggaagtcactggcctccatacaaactctctttctgcttccagatctactgccaaaacctctgccttttggcaaagctttttctggaccataagacgctatactatgatgtagaacctttcctgttctacgttatgacagaagcggacaatactggctgtcatctgattggatatttttctaaggtgagcaggatctggtgatttagaagcttaacaaccacagcagcattgtgggtattggcgttagagggctcagatctctgatgaggaagccgaggacagtgatagccttcgcataagcaaagtaagaaaggcaaacttgtatcataggcagcttcctgacagtattcagttcaggatcttctctgttatctaggctgacctggagtcctctgcagcctagactggcaccaaacccagggcagtcttcctgccttaacctccaaagtcctgggattacagccatgagctgtactagctgatactgttactagaaggttctggcttctgtgcttgtgggttgaagctattacttactggcgtggacctttctatgaacttaaaatacatcttatagtcaagccagtacttgtggctttgccttcctccatgttagtttaaaaccatgaacatattctggttgcttgttctccagctgggttcattctgtcacagctagtccctttgttttaaaagacgcaagaccaaatctagcttaaggttttctttcattctgttgaggtagggtctcccagttagttctggctggcctaaaacttaaagagatccacttgcttttacctccttggtgttgggattaaaaggccaccacagctatagttatgagctttaaatgtaatgtgacaacttaattaaaacaaaatacaatgtaccatatagttcatcactttagctctccaggcaagggcttcttccagtgtattgacagagtgtgtgactagtgcattcctcactgttcttaaaaagaaacattggtagtcggttcctgtttcctcttgaccctgcctatgaattggcttattctggatattttataaatagtcagataatgtgatttggttgtattttgatcttccaggggaattcagtttggttttttttggttttttgtttgttttttttttttttttaataataggcaggccgtacctctttatctgctgttctgttcttgatttttaggagaagaattcatttctcaactataatgtctcgtgcatcctcaccatgcctcagtacatgcgacagggctacgggaagatgctgatcgatttcagtaagtggtgttgccgagcatcggctcctcgggccctggccctgagggttggggttgctcacttgtgtcctctgctcttaacagttcctaacatgtaatcacaggtagttagtgaatgaacaaagtggggaaatgagtcgctagggaattagtaggagatgcagggaacaatacagccgtgctggattatcccgcctgagactgaggtagagcagatgcatacctgtggcttaaataaagcctggctttgatgcttggggtcttatgtaagcacttgtggaggtaatccaggtacctggttaaggctttggtgttatagtcattcttcattactcatgggtatcgatttgaatttgtctaccctctgatgtgtaactctcaggttcattgggtgagggtggttcttagtacatttgtttgttagtttgatgggtacgcgtggaggtcagagggcaacatgcaggagttctctgtgtgggtcctgggcttgaactaaaatcttcagcttgatggcaagaaccttaaaccattggttttcaacctatgggtcgcaacctatggggggtcacatgtcagacagacatccagcatatccattatgattcataatagtggccaaaattactgttacaaagtagcaaaaaagaaaacataattttacggatggaggtcgccacaacttgaggattaaagggttacagcattaggaaggttgagaatcattgccttaaactgttgatttaaaatgattataagcattgtgctaataagttcgatgcagacacgaattacaatgctgtgggctgtcagacagtatctttgaatcaacagaaatacagaaaagcacattacacatagaagagttggtgacactctggacaggctgttaagaagcaagcctcactcctgtgagcagtggttcagtgttcaatgctaagtcagcatttccagtggctctagagcaaaaccactgtgacgaacaagaattagctgtgccctagtcagcagccactgtcattgaattttagtcaaagtaagaatggagaaatggttcagcagctaagagcactgattcttcttcctgaggtcctgagttcaattcccagcaaccacatggtggctcacagccatctgtaatggatctgatgccctcttctggtgggcctgaagacagctacagtgtactcatatacataaaaaaaataaataaagaagaatggaggtttggctggagagatggctcagtggttaagagcacttgctgatcttagcagaggacctaagttccgatttccaacatgtacatggcagctcacaaccagttttatcttcagtttcaggggatctgatgccctcttctgtctgggttctacacatagtgcacttacataaatccatacatacagacagacactcatacacataaaatgcaaatgtttttaagtcttttcttaagaatatgtatagtgtgcatgtatctgtatgcttgcatgtgatgggcagaagttaatgtcttcctccatttctgatttgtttattgacatcatctctcgataaactgagaactcgcctgctttggctgcatgtcccagagatccctctatgcttctgaaaggcagccaccatgcctgacctatttttatgagggtcctggggatccaaactggttctcatgcttacatggaaagtactttctctgctgagccatctccctagccccaaagtaagaatttttaaagccactcatggaggttcacacatagaattctagcacttctatccctatagaggattgccacaccttcatggcaagcctgggttaactttaggaaaagaaaaggttgtggtattgtatgataaaggacttccacttctgatcttaacaagcatgtccagagaaccaggactgttaaagctcctagtgacagcttccaggcttgtttctaggtgcctgttctaaggctcttagatacactgtagcaggcattcctccactcctgtttatacaaagccagtgtcttagggttttactgctgtgaacagacaccatggccaaggcaagtcttataaagaacaacatttcattagggctggcttacaggttcagaggttcactcattatcatcagagtgggaacctggcagcatctagtgagacatagtgcaggcagtgctgagagttctacatcttcatctgaaggctgctagcactagggtattaaagcctgcacccacagtgacatatctactctaacaaggccacacctcctaatagtgccactccctgacctaaacatatagaaaccatcatagccagttgtcctcagcagccacacaaaacttgctcttttgaatggctggctctctggtactctaaagcgggtatccttcttaagtcttctgtgtttgcatactggtttttgctattatggtgaggcttagtgttgcttgaaaagtctagctggatttcccaacactagggaggcagaattggtggggacattttcactgcaggctctttatgctgctttagaggtcagctggcactacatagtgaccccctctcagcagagcacccttgcctaagcacggtggggaggtaggtcagtggataaatccaggataaggacctaattgcaatttccagaacccatgttgtagaaagaactgattcctccaagtggtgtttgcacacaaaataagtaaataggatttttaaggccccctccccaaatacaaacaacaaaatctagatctgtgttttttcttggtaggttatttactttccaaagtagaagagaaagtcggctctccagagcgcccactgtcagacctggggctcataagctaccgcagctactggaaggaggtactgctccgatacctgcacaacttccagggcaaggagatctccatcaaaggtaggttgtgctccacgacagtggcacccattctgtttaatgtgactgtgactggggagcattgtggagactgtccctgctgagctgaagatcccagaacattaggtcctgggaatggttctaaagtgttttctcctgtctggagttgttagcacttaattcatataaaatcgaaaaggaagacctggagagatggctcagtggttcttccagaggaactggattcaattcattgcacccctattgtggcccacaacatatagatctccagttccaggcacacataggttcatagacagacatccaggcaaaactgtgggcggtgctccccacagttaccttcccttagaggacctaactacaagctcctagccaccttccagctgatacaaggtccacataaaatacacacatgcatacatacacatgcatacatacacaagcatatatatcatttgtttgtttgttttttcaagtcagggttcctctttgtacccctggctgtcctggagttcactgtgtagaccaggctggcctcaaacccacagagctctgcccacctctgcctcctaagcactgggattaaagatgtgtgccactatgtccagctcctcatttcttttgaaaatcaggaagaaagagttcatttagtattttgaaacatgtgaattttaggaaagacatcttccctttagggcaaatttaggggtttcatatttgaccttttctaaggggtcaagagtagcttcttaccactaaattggatttttgtagttacttgaactggtgagacatgtgaacaggttggcccaagtaacacagatttgggctctggaaaactgtacattaagggggccttgggagacatggggtatgggagtctgctcccactgggatctcagtggctcctctgttacagaaattagccaggaaacagctgtgaatcccgtggacattgtcagcactctgcaagcccttcagatgctcaagtattggaaaggcaagcacctagttttaaagagacaggtgagattttcctcagctgcctgtggtgtccttaacgtataggagagctcagtgggcggcgctccccacagttaccttcccttagagggcctaactgcaagctcctagccaccttccagctggcacaaggtccacacggtctttgttcctaagcttatctccctgcttgtccatatcagagcttgtggtaagctctgtcagatcaggatgaaacaagctaagccgctttatgtggcattacacttccacccatctcggggagtcctcataagtcctaggactgctgttttgtgaaatggcacctcagcttaggtccattttgaattttttttttagttacctacacatcataagcataaatgaataatgatttcagttctcattgaagacagaataggaatataaagaggaaactttgcaaatctaaaaataataacatcttgtactttaagtatgttattaggacttaggtgaatctgttgctagtcattttggaatcttttttaaagcgtattggttgcatgtgtataatggttgcttccttattcttcacaggacctgatagatgagtggatagccaaagaggccaaaaggtccaactccaacaaaaccatggatccaagctgcttaaaatggacccctcccaagggcacttaaagtgacctatcattccgagccagcgagccccagcagtaggaatccgtaccctagggatctgtctgtcatttctgttgctcttgtgattggcaagtacagtatcctttgggaaggccaccccctcagcactgttctggctccagccttcgtgtacactgcagacactagttctgaggaactgttgtttcggcctcagtgaggttgcctggacggatctgtatgaggctcgagtacagatccctcatagcactgacccaaggagttgtgttatggtactgtacctgtccagtcactggttcccacctcatgctttttaactccgaggtttgttgtgtcctgacctttgtgctagtgctttttcctgcctggatagcagacctccaaacatggttgccaccaaagggccctttccagttacttctaacacattcttcatgaaggggtgggcaagaggcagcgcctgtgcgtgtctgctgggagggtccgctcaccatgggtttcatctcgcagtcactcatttttctccctttttgtcaaaagacttactacctttgatcaggatcaggctgcccagagctaggaacgcctggcatttcccaggggttcacaggcctggtccatctgcgtgagatggtgaagcctaagaggtggtcccatgctttcctttgtatttacttgtggacactggggcagcattgtgtagaaggaaatgaggaattctttgccacagcagaaaatgcccccacttttttttctgcccccttttatgttggtagttgccaaaatattttaacagtcttttttcatacattaaatgaccaccctgtggatctttccacacctgcctctgccagtatggtgtagggcagctctactttccacacaagttgcactgatcttgtccagagcttcctgggagaagtggaaactggttgaaatgcttgtgtttctcagcccatgactcagcaagacagggtggccactctgctacggtttgcttcgctctccaacagtgcctccctcccccagcagactgaagtgcttctgtctaagaactaagtccattccctttcgggacttgccaccatcatcctgttctctgggttcctatttttggtggtgttaagtgaaggaagaagtgttccctctaatttctccctgtcccagtatataacctgctatcttggggcagcttttgatgtctgacatgtcacccttcccaagttggtctcttccaacactgctgtcttcacgtggcaccctcttaccacaaccctaactctggtcatttgtgcctttctcttgtcatctctgtacactactaatattcactgtgggttggggagctgattttaagcatgttcagtggctcccctccagtttcagtgtaactgttaaaatgtatccaaaagccacttcactgggggttttcttaaggggtaaaggccttttacagatgctgagccctccccacatgtggcagaatgtgctcttctgtatctactcaataaagcatgttctctgctcatgtctgactgctctgaagcttgtttatatgggaatggtgtgattggctcagcacagtgttagccctggggtttggagctatggattgttttcccctgtgaagcaggttgttgacagagtgagtgttttctctgaactcacaagcggtaaaacaaattgagtctgcctccctttggctccaggaagtcgctgtgcgcaacagcagctagctagtgtaatttcattcatctgcctctggtttggggccttgtcaaggaaccactgggaagttagggtgggttgggggatgccatggaagcttgtaggaggcagaacaatgcattcctttcctctaagcgtgctcaccagtatcaagccaggccctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgcaaactgtgaaccaagaaagccagaatgctcattgtactctgttgtacttgagaatctgtaccacttctgccattgccttccccagccagcttcagttccctggtgtttctgctcattctttcccttcgaggcagatacacgctgttagaaaccgtcatgtttctagagcagcgcttctcggcgtgtagatgtcaatgagcctttcccagggttgcctaagaccacccggaatatagattattatatcatgatcctgaatgaaagccttgcttctcttgcctccaaaacacgtggtgcagcctggtctcttatttctcatgggaatagtgagccctgatgagtcatttctagtagtgtagtatgtatgtagtatgtacagtgtagtatgtatgtagtatgtatgcagtatgtgtagtgtagtatgtatgtagtatgtatgcactttgtagagcagagatgcttcctacttggtcttggctgtcatcaggccctgtacttcgttctggttgtatggctgggattagggactgctggaatggacctatctgtcaggctggttgctctagatcaaggttggggctgtggagcatcataaaatctgtagatgaaagtggagcacagtttgcttgtggcacacatatatcccttctggaacataaaaccaatggaatcagcattttgattgcccttgcaagggtagttagtgtgtctattcttatagcaggttcaagcagcagagctctgagccaccttctccctcccctgtttgcttctggcctttgtgaagctgaaaagactcattaggattaatttttgttgtacctatgcaaatatgcacacatttatttacagtccaggaaattgcctttggaatctccagggatgagcatcctagagcctggtttgagacgcctcagtagtaaagcaggaagcacattctggcttcgctgctcttactcgggactctgaactggtttctggaatgtgctgggatgcaaagaaccaaatccaatgagtgatgaagtatgaaggaggtctggctcaccggctgccggagcctcatagggtttgcatgggaagacctttgctaaataatggcatgtagtctatgctaggaattggctctaacctggttttgcttcaggtcttttggcctcaggcttgcaaatgactgcctctcccagactgatgggggcactgtacttgctcacttcctctgtggtatcttcagcaatgccagtgagtgtcactgaactatcgacaagactcagcggtgaggaaaatgtccggacaccccccccccccccctcccagcaaagtcactatttgtcccttccctctcgtgcagtgccttcagtacacgtttggactcctggctttgtttactcatgcatagaactagagaaaataacctggtctgttgatggctttggctccctggtgcctcccaagccttccccgtgagttgaacactttcttcttgacaagttacctgctaataaagggccatttctggaaatggcttaccttggacttcctctgtgtcacgagttgttggaaacttgtctcttatctcacagtctacaatgtgctagaatctgctgcatattgaatccgtatgtgaggctgtttgtgagtagcttactccccccccccctcgccccccaactgtgtgccagacttgggattttcagtggtagaaagttggagaagctggggctggagaggtggctcagtaagtcctggctgctcttccagaggacctagattcaattcgcaacaaccacatggcatctttacacagacatacatgcagacaaaacaccaatgcacataaaaatgataaagggtaagccgggcatggtgacacacgcctttaatcccagcactcgggaggctgaggcaggtggatttctgagttcaaggccagcctggtctacaaagtgagttccaggacagccagggctataccgagaaaccctgtctcgaaaaaccaaaaaacgagaaagaaaggttatagaaacaatagtttggtgcttgtagaccagaagcgggagctgacctgcagtgtggggagagaacattgtctcacctcatagctgtgtagagatgaaggagaggtgagattgctgggagtgcagctgggcagatgatgcctggctaggaacctttacagagaaactggcctggccatgcacaacaggcagtggagtggaggcagtggagtgcaggtatcaggagcttggggaacatggcaggtgcgcagaagtgagctttcagccctcttaaaggctgtcagggccttcaagtccccagtggcatctgagctcccatcaagtgctggatcactctgaattttatttctcctatacctccccagcttgaagcaaaagaataagagtcacctcccttgcagagtctcttggtgaattgactgcagggagcctccttgtcgccacatcctggatgggtctgtgggcagaacgggcacctagatgctttgtggattgggaggtgagcggatgaagtgttatcaactgagaattgtgctgaggacagactccaaggaagaagtccacagcgtctccaacctccagcttcatctccacccgggagaaggaggaaaggctgagggctgtcaccgcccaggcctctaaatgcttacctttcctccctgttcactacaccctaccctcaccccatcacacagacgggatcaagtgcccaggaaagataacccgtttcctctttgtaatgtaggacaaagaagatacacttttttttttggaggtctaatggatgcgtggatgagtttcctttgttgttcatcctaccccaagtaactccagctcactcatggtccaacctctgtcctttatgttcatgtgtatgcacgtgcatgtgtgtgcacagcatggggaggctggaggacagtcttgggtattgtttctcgggtgccaaacacttgggtctgattggcatagtgttcatctgtctcttctctggccctagcatgtaattacaaacatacactaccatgctctggttttttatgtaagttctagggatccaaccgagctaggtcttgatgcttgcatgccaagcaccgtgctagctgtttgtttatttttatatgtgcactgtagctgtcttcagacacatcagaagagggcatcagatcccattatagatggttgtgagccaccgtgttgttttgggaaattgaactcagggcctctggaagagcagtagtgcttaaccactgagccatctctcccccccaccttgtttccccttggatttcattctaagggactttttaaaaaaatatgtttacatgtagcatgtgtacacacgtgcataataagtcagaggatacatttgggagtcagttctccttccaccaagagcatcctagggattgttgtcaggtttggcaagcattctgcttggaaccggctcactggagtgggctttttattttattttatttttttgagatagtctcagcatgttgtccaggctcaagcctcagcctcctaagggctaagactacagataaatagcactgtacctagcttctggtgtctctaaacatcaggatcctatatcccaggcacaagggtttcccccaactagatggaaccctctgaggttggaattgtttctctggagctctgccctggtatatgaatgaggacaactaacttctaaaaacaaagcagttgaagggtcactgtcatagtttgaatatatttagccttgggaagtggcactattggacggtatcgccttgttggagtaggtgtgtcgctgtgagtgtggtcttaagaccctcactctagttacctggaagtcaatcttccactgatagccttcagatgaagatgttgagctctcagttcctcctgcaccatgcctgcctggatgctgccatgttcctgccttgatgataatggactggacctctgagcctgtaagccagcctcaattaaatgttgtccttataagacttgccttggtcatggtgtctgttcacagcactaaaacccccgccttatacaagaggattgaggagggacctgggacggaattatgcaacccaggagggctgggttagaaagggtgacctcttttccaaactgtctttttattttgtgtaacatatgccatgacacatgcagaggtaaaaggacaatttttttcttccactttgtgggtcctggggattgaactcaagttgtcaggcttggccacaatcgccttagcccactgagccatagcctcagcacagagggagatgtctgttggtagcaacatcaggaatctaaagggaagaaggctcctgaccccgcccccaaatacaatacatgcagcgtcttctccaccagggtctttttcttgtttctattgccgttttagccaggccccaagctctcttcccacccaaggattagacattagacctgggctgtgtaatgttggtctctgcttttctgacatcccaccctctaccctgcatggctgaggaagctacctattactgctaactcgtcgttgattgagccctactgtgtgctaggcctgggatacagagtgtgaagctttgctgtagggacaagggagagctgggtcagtccagcttgtgaggaggcagccgtgctttgtgtgtcgttgctaccagatgccaagagtgagtcctgggagaaaatgcagagtgtgacgagggcctggcaggaaatacccaagttgaggacaaaagacaggactgttggctgaggctcctcagctgtgatgttctggggagagatgggtggcagagtgctacacgttgctggtggttaggggagcctcatcttcctctcgactctggaggctttctctggtcactgctccgggtcgtgccctctgttgactcgccgcctgtctgcaggtccctaaagcagtgaaatcacaggttcacctgcctgtcacatctcctcaaagagggcactggtcatctaaagccccttcctggggacatggaactaccactgaccaggaaaacggcttctgtcactagctcactgtgtggcttaggacaaattactttccacccctggaaaatgatgtctctaagcaaccagttcaccccgtgcatgtagattattcatctcaagttagtaattggggtgagttccagaggacctcagatgcgttgaaaaagtctctcgagaacaattcattcctgtctttcttcccaatagccagtgttttatcaggagagacagggaggggccaggagtcagcacaacagggaaacagcatggcactcagggtgccctgcgtctgctcactattggcatccactgcccttgctctgattcactggctcggtgctccttcccaagcctgaatcatttcttttcatgcctggctttaggaaccacttaagggaataactcctgcttgtgtgtttgcatatgtgtgttggggtggaggatgttagtcgctcagggtatcacctctcccatggggctgcttacttaacgatagttgttgaagcctaagactctctttaagactaaattcccgacccagggatcaacgtcttattctgtctccactgaaccgagagggcataggcgaggaaaggtacaactttaagatcattggggttggcaggatggctcagcctgcaaaggcaccagccaacatgtctgaccacctgagttgggtctctggcacgtgggaaagaagaaaaccaacccttgacctccacacacatattgcagcatatataaacatacacaaataaataatcaaaaggtcatcaggagcctcttcccctccctgaacctcagctctcacctcccatggccccttctgctggatagaatactataggcccctcttctatctgacggcagtaggacatcccgttgttttcccatgatgcccttaccaccctttagatgcccatgcctaccttctatggacaaacctctcgtgccaaggagatcctgcactatacgtcccagctgataccctggtgggggggagaaagaagaggtgaagagaaactgtgaaagaaagggtagtgggggcggggaggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggggggcttgcaaatgcagcccttttcattgcgggacatgagagatgccctagagcccttcattcttccatgtctttacacattggctgccctcttgctaatcctttcaccagtatttccatgttcagaaactaggctaagtattaaggacacagagtgacccaagcctgcatcttcctgtggggagtttccaggctgggaacgacagtcacgtgacacagcaggactgcactatgcagtgtgccaaggacagcacccttcccagtccatggaggcaagctgtctgctagagtaggcaatctcactccagctgctagggagggggcagtgaaatcagcaacggccccaaagggcatggcctaattcccgtggcactcaggagtggtcggaagagactggcagcttctgtgttgtttcctttgagacaggtacttgctttgtagttcaggatagccacaggtaatccctctgcctcagcctcccaagagctgggattagaggtgtgggctaccacacccaaccttccctttgtgattctctttcttatgaagggtttaagcagaataaagcctacctgggtttgcagttcttacatcctcagggggccaagggctgaagctctgagttctcttatcttcctggttgattctttttcttagctctgctaattctacggctctggctctgactcctacccctgcaggcactctctaggcatgcgcatcccaccctccggggaacaacctgagagcccagtcttctggtcaagtcacagcagctctccagtgctacagcagcgctggccaggcatgtccccagcccgtgaccccagctggaggtcactgtttagtccagggttgtcaatggctagcacatggtatgtgtgtatgtctgtgtgagtagatgtgtgtgtatgtatgtatgtatgtatgcgtggtatagcatatgtgtgtatatgcctgtatgagtgtatttgtaggtgtgtgtgtgtgtgtgtgtgtgtgtgtgtgtgtcagccagaggtggacactgattgcctttctgaatcactgtccactttagtctttgaggcagggcctctcactgagcctgaagctcaccatttggtttgactggttaaccaccaagtcccaagtatcgtccggcctttcgttccccagtgccggagttacaggtgcacgacctagcttttcatgtgggtgttggctgctgagttcagctgcacatgtttgagttgagccatctccctgatcccttttgttttttaaaggcaggatctcatgtaggcctcaaactcactgtgtagctgacaatgagcttgaacttatcaccttgtgtctacctcccgagtgtcaggactactgtcatgtgccactgtgttgcacttatgttctacattttgacctttcccccactagtggtcttaggttttgctgctatgatcaacttagcaatgagcctcatggtgcaacatctcagggctcacgtgacatcctcccacgaacttgagatttcctgatgtgaaactattggtgaaaaggtgcatacatttccgcctctgatggatgcagccagtgtgctccaaatggacagagcaagtgctcgtactgagcgtggctctgcaggacaatggtgtcgaagaaaaaaaatcgcaacctaagagaaacagcttttgtccagttgactcgtctccgtctctgggacagcttccttgttttagaatgcttgatgatcgtgatctgcacagaactgactggaaagcctgtctcgttcacatctcagtgccgctgtccagcctcagagcactctcccgtctctctgatgtggaaccagggtgcaaaccatcagcccctcatctactgaatagcccttatattcctgttgccattggcactccctagagcatcctgcttgattgacaactgatagacagtgtacctcactatcccatgagcaccctctcctgggtattgcagaagccactctgagccacgctcacagcctttgtcactcacctcccacccgcttccccatcagaccatagaactggcgagtcctgcttctcttcaactcctgaagcttaagttcaatgctggggacggggattccctggagaagcagagagctagcgttagagtgtggtgctgatgaggaaagggggaggggtggataaccatctcaacagcctggcgccaggctcttcttcacggtttaccccaaatagcacattgtactaatgatgatggaaatcttcacatactgtgttcctggcactgccctaaggacctttaatttaggtaacatcaattctcagccaaacctcatgaaaatagtgcctaatactattactgtcaccatctaacagatgaagacatacaggtgtgtagagatgaaatatgtccagaagtagtgtagctgagaactggggtcagaacttgaatctgagccatctagatcaaagggcaggctctcaagcacactccggtcaaaatttcaatattaactattattagactttggagctggacatggcggcatgtggttgtaaccccagcacctaggtggctgaggcaggaacacacacacacacacacacacacacacacagtggaggcgggaggattggcacaaaccagatgttagactagtctatatagagctccaaccagctagggatattgagtaagactgtctcaacaagagaacatgtgatcccctgtctgttttacatacatggaaactaaggttgcccttaactagggtagcacaggagaagctgaagctgggtctaaaatggtcttttccatcttgagaaatatcaacaaggacagaatctggctgccccttagttgtcggaagtaccagagctaagggctgttctattctcttcccccagcctcccagatttagcctccccggagctgggcatcctgggaggagctattgtccttggaaaagccattttaatcctctagtttagcccaattagcattacccttccccaacagctgtagatcccgtctccctcccc

SEQ ID NO: 1898 - DNA, 3499 bp, Mus musculus
caggaggcacttgggatcgtccgcagggtttgggacagctacagaggccgccacggagcccgccggagcccccgttcctgctggtgctgccgccgcccgaatcggaaccgtcgggctgcagccgccggcaatgccgcgaaggaagagaaatgcaggcagtagttcagatggaaccgaagattccgatttttctacagatctcgagcatacagacagttcagagagtgatggcacctcgcgccgatctgcccgagtcacccgctcctcagccaggctaagccagagttcccaagattccagccctgttcgaaatttgccgtctttcggcactgaggagcctgcctattctaccagaagggtgacccgtagtcagcagcagcccacgccagtgactccaaaaaagtaccctcttcgacagactcgctcatctggctctgaaacggagcaggtggtggacttttcagatagagaaactaaaaatacagctgatcatgatgagtcaccacctcgaactccaaccggaaatgcaccttcttctgagtctgacatagacatctccagccccaacgtgtctcatgatgagagcattgccaaggacatgtccctgaaggactcaggcagtgatctctctcaccgtcccaagcgacgtcgatttcacgaaagctacaatttcaacatgaagtgtcctacgccgggctgcaactctctaggacatcttacaggaaagcacgagagacatttctccatctcaggatgcccgctgtatcataacctctcagctgacgaatgcaaggtgagagcacagagccgggataagcagatagaagaaaggatgctgtcccacaggcaagatgacaacaacaggcatgcaaccaggcaccaggcaccaacagagagacagctgcggtataaggaaaaggtggctgaactcaggaagaaaagaaattctggactgagcaaagagcagaaggagaaatacatggaacacagacagacctatgggaacactcgggagcctctcttggaaaacctgacaagtgaatatgacttagatcttttccgaagagcacaagcccgggcttctgaggatttggagaagttaaggcttcaaggccaaatcacagagggaagcaacatgattaaaacaattgcttttggccgctatgaactggacacttggtaccactctccctatcctgaggaatatgcgcggctgggacgtctctacatgtgtgaattctgcttaaagtacatgaagagccagacaatcctccgccgacacatggccaagtgtgtgtggaaacacccccctggtgatgagatttatcgcaaaggctccatctctgtgtttgaagtagacggcaagaagaacaagatctactgccaaaacctctgccttttggcaaagctttttctggaccataagacgctatactatgatgtagaacctttcctgttctacgttatgacagaagcggacaatactggctgtcatctgattggatatttttctaaggagaagaattcatttctcaactataatgtctcgtgcatcctcaccatgcctcagtacatgcgacagggctacgggaagatgctgatcgatttcagttatttactttccaaagtagaagagaaagtcggctctccagagcgcccactgtcagacctggggctcataagctaccgcagctactggaaggaggtactgctccgatacctgcacaacttccagggcaaggagatctccatcaaagaaattagccaggaaacagctgtgaatcccgtggacattgtcagcactctgcaagcccttcagatgctcaagtattggaaaggcaagcacctagttttaaagagacaggacctgatagatgagtggatagccaaagaggccaaaaggtccaactccaacaaaaccatggatccaagctgcttaaaatggacccctcccaagggcacttaaagtgacctatcattccgagccagcgagccccagcagtaggaatccgtaccctagggatctgtctgtcatttctgttgctcttgtgattggcaagtacagtatcctttgggaaggccaccccctcagcactgttctggctccagccttcgtgtacactgcagacactagttctgaggaactgttgtttcggcctcagtgaggttgcctggacggatctgtatgaggctcgagtacagatccctcatagcactgacccaaggagttgtgttatggtactgtacctgtccagtcactggttcccacctcatgctttttaactccgaggtttgttgtgtcctgacctttgtgctagtgctttttcctgcctggatagcagacctccaaacatggttgccaccaaagggccctttccagttacttctaacacattcttcatgaaggggtgggcaagaggcagcgcctgtgcgtgtctgctgggagggtccgctcaccatgggtttcatctcgcagtcactcatttttctccctttttgtcaaaagacttactacctttgatcaggatcaggctgcccagagctaggaacgcctggcatttcccaggggttcacaggcctggtccatctgcgtgagatggtgaagcctaagaggtggtcccatgctttcctttgtatttacttgtggacactggggcagcattgtgtagaaggaaatgaggaattctttgccacagcagaaaatgcccccacttttttttctgcccccttttatgttggtagttgccaaaatattttaacagtcttttttcatacattaaatgaccaccctgtggatctttccacacctgcctctgccagtatggtgtagggcagctctactttccacacaagttgcactgatcttgtccagagcttcctgggagaagtggaaactggttgaaatgcttgtgtttctcagcccatgactcagcaagacagggtggccactctgctacggtttgcttcgctctccaacagtgcctccctcccccagcagactgaagtgcttctgtctaagaactaagtccattccctttcgggacttgccaccatcatcctgttctctgggttcctatttttggtggtgttaagtgaaggaagaagtgttccctctaatttctccctgtcccagtatataacctgctatcttggggcagcttttgatgtctgacatgtcacccttcccaagttggtctcttccaacactgctgtcttcacgtggcaccctcttaccacaaccctaactctggtcatttgtgcctttctcttgtcatctctgtacactactaatattcactgtgggttggggagctgattttaagcatgttcagtggctcccctccagtttcagtgtaactgttaaaatgtatccaaaagccacttcactgggggttttcttaaggggtaaaggccttttacagatgctgagccctccccacatgtggcagaatgtgctcttctgtatctactcaataaagcatgttctctgctcatgtct

SEQ ID NO: 1899 - protein, 654 aa, Mus musculus
RRHLGSSAGFGTATEAATEPAGAPVPAGAAAARIGTVGLQPPAMPRRKRNAGSSSDGTEDSDFSTDLEHTDSSESDGTSRRSARVTRSSARLSQSSQDSSPVRNLPSFGTEEPAYSTRRVTRSQQQPTPVTPKKYPLRQTRSSGSETEQVVDFSDRETKNTADHDESPPRTPTGNAPSSESDIDISSPNVSHDESIAKDMSLKDSGSDLSHRPKRRRFHESYNFNMKCPTPGCNSLGHLTGKHERHFSISGCPLYHNLSADECKVRAQSRDKQIEERMLSHRQDDNNRHATRHQAPTERQLRYKEKVAELRKKRNSGLSKEQKEKYMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 1900 - DNA, 60452 bp, Homo sapiens
  misc_feature (1)...(60452): n = A,T,C or G
tggggtgtgtgttggggagacagaaagtaaagaatccaaataacacacacataaatgtataattacaaactgagacaagtgctatgaagaaaagcacagtgtgcaataagagcatggcagtgggggccttgatctagcctggagggttcaggaaaaggtttcctgagaaaatggtatttgagctgagatctgaaggattagtgaaaataggcaaagaagaatatgggggaagaacattccaggcagagtaaagagcatgtgcaaaggtcctgagaaggaagaaacctgcacactcctaaggaattgcaggaaggccagtgaagctgcggcactgagaaggaagcaggtttgtgtgagatgggcctgaagagttagccagaagacagaccaggcaggacactgaaggccagggaaggatttctgtctttacccctccatggataggcacatggaatgaaggtctttaaagaagagctgccaatggttctttctcccagattactaatgctacttacagttgtctggaaggagaacagtcatgacggtctaagctgctaggaacttcccagcatcctgacatggtgtggctatgcctggctgtcactggggagcccccagaacccatggatcagccctagcctacagccctcaggcaagggatagcccccacccatgtggacaaaggggcagggtggagggtgggtggagtgctttgcctgagatctcagctctgcatgacatttggaacagccccaagactatggctctttttcctagataactctatcatgtgtaccccccatttaaatggcctgccgcccttcctacagcagctgtgctccccacccaatctggagaaggtccctggataagaactctgactctgcccagagacttgggtcttgacctgctaagtttaggcctcaggactgttgggaaccatggatatatacatatccttgatagttttccaggggtattaatggaagccattggagaagagggtcacaattgttggactcagcctttctaaagccagtcctttccttccagtcatatctttggaaaatgtggtttggtgtagtgacatctgctggcaaggctaggcacataatacaatgactggatgtccactcatcctcatgtaatttccagactagcaagaaaatcgttcttaacttctgagattggattgggctcagtaacctcagttggcaagagcaagactaagatgtccaaggatgtgggtctgaactatgtatgggctagtttgccttaaatagagaaaatgtgtttcctagttgtggcttatacccctcccattggtcagttgattcatatttgggtacagttaatcacaagggagattgggcaaacatgtataaatgactcagaggaacccgttcctagcccctatgcctgggaaagcatctcccaacaaataaaaagacccacattttacaaatggcaaaatgcagtgtcatttttttatcctcctgaggttgactagtttgggaaactttttagtttctcccaggtcaccaggaaagtagtgtctacagaatcatcttcatggttcttatagtgggcaagactgactagggcttttataatggcccctccacacatgctggggtaagggcagtggcgtgatcttggctaactgaaaccgccgcctcctgggctcaagcaatcctcccaccttagcctcccaagtaactgggactacaggtccaccagtaattttttgtatttttagtacagatggggttttcccatgttgggcaggctggtcttgaactcctggcctcaagtgatctgcctgtctcagcctccgaaaagtgctgggactacaggcgtgagctaccgcgcccagcctctcctcaccactttcatccatgccatgtacacattctgtttacaatctcaccctttttcagtagtatgtgatcttgacagcattcaccactagatgtaattgggatgccagggggaaagggtgaggagaaaatactaaagacatgattctgaagcaaacgttctgccttttctttttgagatggagtttcgctctgtcacccaggctggagtggaatggcacaatctcggctcgctgcaacctccgcctcccgggttcaagcgattctcctgtctcagactcccaggtagctgagattataggtgcccaccaccatgcccggctaatttttgtgcttttagtagagacgggtctttaccatattggccatgctggtctcgaactctacccaaccttggcctcccaaagtgctgggataacaggcgtgagccaccatgcctggccatgttttgccttcttagtaacagtaacactgacccataactgaatgtagctcagacaaagcatctctttctctcactcaaacttaagaaaatcatcaagataaattagtaatgaatagggtttcccagaagaggaaacagacctagtaaataaacacatgaaagactgaagtatatcctcagtagaaataaaatcgaaagcacatttggggtgccattttcatttttattaaaatgacaagatttttaaaaagtggtaacacttagttctggaaacaatgacttaaattggcacccttgcactgatgatgacactgtaaattgtgaaagtctttaaggaaaggaaagaagcaatatataagtggcagaaataaaaacaggagagagctatggatgcatgcagacactcactgcagcattatctgacataaaagagctttaataactccacaacaggagaatgagagcacattacatcatagcaccacagtgcaatgtcacacagtgagtatagttacaattatgaggactctagggaaacacagaagatgctgagaagatgtacaaaatataaaatttcagccaggcacagtggctcaggcttgtaatcctagcattttgggaggctggggcaggaggatcccttgagctcaagagtttgagaccagcctaggtaacatagtgagaccccgatctctacagaaaataaaaaattagcggggtatggtggcatgtgcctgtagtcacagctacttggaaggctgagcaggaggatcgcttgaaaccaggaggttaagtttgcagtgagaggtgattgtgccactgcactccagcctgggtaacagagcaagatcctgtctcaaaaaaataaaataaaatttcatgtaaataatgagtgtatctatgttaaaatatgcacataaaatgtatgcatgaggagaaaaaatggaaggcaatatacaaaaaataaaaatagttgggtcaggcgtggtggctcacgcctgtaatcccagcactttgggaggccgaggtgggcggatcacgaggtcaggagatcgagaccatcctggctaacacaatgaaaccccgtctctactaaaaatacaaaaaaaaattagccagtgtggtggtgggcgcctgtagtcccagctactcgggaggctgaggcaggaaaatggcatgaacctgggaggcggagcttgcagtgagccaagactgcgccactgcactccagcctgggtgacagagagagactccgtctcaaaaaaaaaaaaaaaaaaaaaaaaagctttgtgccaggcatggtggcttatgcctgtaatccgagcattttgggaggccaaagcgggtagatcacttgagaccacgagtttgagaccagcccgggcaacatggtgaaatgctgtctctactaaagatagaaaaataagccgggcatggtggcacgcacctgtagtcccagctacttgggaggctgaggcaggagaatcgcttgaacccgggaggcacaggttgcagtgagctgagatcatgccactgcactccagtctgggtgacagagctagactttgtctcaaaaaaaaaaaaaaaaaaaaaaccctttgtggcggcaatgagattaaggatgtcttttattttcctcaaattttcatttagtgttattacactgtgttaatcattttgaaatggtggaagggggttgagggcaggtgaaagtgctcctctagccccttcctgtacatacttgtcctaaattgacagagaggaaagaccatgtctgcttattcagcttctggccaatgcctagcacctatcaggtgttaaataaacatttgttgaatgtataaatgaaaatgcctgcagtctaaatgtctcagcccatggtgaccgggtactttccaccccggcaaatagagcaatttggttttgctggaataaaaaaatgaaggtttatccataatggcaattccctggtcttcttggtaagtgaatgtgggcatggagaacccaggagagacagtctgttaaagaaaacccaattaccattgtggaacatatgttgccctgaggcctctgctgccataacaacatcttgtaactataactacagccctggagggctttggccccatagaatatggaaaaggatgtcttcatcataagacagctttgtgctcagattgacttccctagggagcttggatcagggaagggaggtagataagtggaggaagggggggagatgaagggcagaggtgggagaagaactgctattgaatcaagatcagagtgatttttttttttagcgattttcaaaatgtggttatttgactgtttagctttggtggttatttatatccccagctgcagaggcagggagctgtgcctgagcctgctgggatctgtccaataacttctcccagggtggggctgcgggtgggggctaagggtgctacaagatccaaattaggtggccagaatgtaagagaagctccaggccatctccagcaagagtaaagaagaagggcctattagtgactgtgctgaccatttttaaggcagctgcaaatgaaaatattttaataggaattacggtcacatcagcaacctctgagattctcccaaaaggatagagactaagccaatactttgcctcagaagttatgagattgacctggctacactagcattgtctttaaaaggccaaggcatgcttcccccaccttacaagactgcacacagaggaaatggctatccctaacccctactagccacctcactggtcagaaagaggcttagaggagagagcatggctggttctgtgcaagcctttcctagctgagtcaacaactggcagtggggtgagaaacattcaatttggtgccaccccaattactaagcccttttgggtgccagtcagcaagggagaagctggagatgctgtggccatccaggcaaggctcctaacctctggaagaagcaaacaatgaacaactacattttgtatttgaaatatggtacctataattttactgtcaaggaaacactttaaaggacatcaagggatcttttaggcagcttacaaaactgaggaggcaagagactgatacaagtaaggaaataacacaagcacatacacacaaaagattgcccccactcccagtgcctatttcagtctctccttgtctctggctaaggctatttcagcagccttctaactggtctcctgccttgggtctccctcctactctgatcagtgcccttcacagctgccagaaagagattgctaaaatgcatgtctgactggcggcctcctctgcttaaggactttcagaaattgcctaccacttccagttcagtctccacagaagggtgctgaacactctgcatgaactggttcccaaaaccatgcctcttatgtaccctccccggcacccatagataatgctcctccacacctctctactattgcacattctgttttctttgcatggaaaacccttatattgtccttgtttactggcaaacattcatcctgtgaaattccactcttgcttcacgtcttttatgaatcctttcctaaactttccagatgaaacactctacctcctcctctgtagcacttctgaaccttgcttatctccctattttcccatgtaatactctacagtgttttgtaagtgtgtgctcactggcttgtcttccctactggattctaagctcctttaggggaaagttggtgttttgtccatggggtataactcagtgcctggtacctgggtgattaatgcctgggtaatcactctgtatgtcttcagttaaagtggttgaacagaggttgaacagagttaaagaggttgaacagataaaagcaaacaatcactgagaccatgtaaatatatagtcactaacattagaatgttatagccatgattagagtgactggaaatataaataacaatagccatttattgagcaattactccatgtcaggaactgtgcaaagagctttacaacactcatcttctttattccttacaaccttgtgaggtggctattaatgtccccacatcacaggtgagaaaactgagacacaaacaaatttaaaacttgtccaaggccgggcatggctcatgcctgtaatcccagtgctttgggaggctcagatgggaggatggcttgaggccaggagttcgagactagtctgggcaatgtagcaagacctcatctctacaaataatttaaaaattagccaggcatggtggtgtgtacctgtagtcctagctactcgggaggctgacgtgggaggatcgcttggcccaggagatcaaggttgcagtgagctatgattgtgccactgcactccagactgggtgacaagagtgagacactgtctcttaaaaaacaaaaaacaaaaacaaaaacttgtccaagagtaatgcaggtaggaagcagcagagcggagattaaaattcagatctgacatcaaagccctgtactggacactagtacagctgatgatacaataaacatgatttatctatgtttctattatctgtttgggaagggaaatgaacagaattatctaccaaattgtacaaggaaaataacaaatccagcagttaagtgcaaaataacatatcattacgccctactaccttacaaagaatgaattggaaaagattttctgaaaaaataaaattttattgagggttaggagatgcatccaggcaggaagaaaagcctgagaaaatagaaaggcaaggagaactgtcgagagtgtcaacgtgaagtctggtgattgaggatagccagggggcaaccagtcagaggcattgaaatcaacatcagttcctgcttggaaagctaattgtgttgtgatgaacatgactctcaaagtaaatattatatttggttttttaaaaaaagaagaagaaataagcttttaagatcctccccttccccattctaaatatacctggctggtctactttcaagtactatacacatttttttccttatgatcatgtttctatcctactggtgttagttttttcatctttctgccagagtgtacactttccaaggacaagaaccatatctaaatgaaactgtaaactctttagtgtcagctgcagtcttagggaatctagcataagaaattaactaacgtcgaacatctgtaatgctggtatttgtgtgacggatgcaagtcaggataagatcttattctaaaacactaatttccagggaggataacttcaccatctctgagcgctatacattcagagactgtaaaacagtaatgatattcttactgagtagcaagcatttactgtgggaagaacgaggtttgagcaccattggaaaggatggtatgagccaggcgcagtggctcacacctgtaatcccagcactttgggaggctgaggcgggtggatcacctgaggtcaggagttcaagaccaacctgaccaacatggagaaacactgtctctactaaaaatacaaaaagtagccacatgtggtggcgggcgcctgtaatctcagctactcgggaggttgaggcaggagaatcgcctgaacccgggaggcggaggctgcggtgagccgagctcgtgccattgccctccagcctggcaacaagagcaaaaccctgtctcagaaaaaaaaaaaaaaaaagaaaggctggtatggctgggagtggtggctcacaccttaatcccagcactctggaaggccgagacagtagttcagctcagtaggtcgagaccagcctgggcagcatggtgaaactctgtctctacaaaaaatacaaaaattagccaggtgtggtggcacacgcctgcagtcccagctactcgggaggctgaggcaagagaatcccttgagcccacgaggtggagcttgcagtgaactgacatccagccattgcactccagcctgggcaacacagcaagactctgtcttgaaagaaaaaaaaagaagagagagaaaaaaagtaggatggtatgaaataactgagatatgctcttaatgtaagagatccttaccaccagttggggagccagaacattcaaatgtaacctcaggaacatatccgtgagtgcaaaataacagagtaatgtatgaaattaaatgcttaagtggtgaggggctacatgaaattaaatgcttaagtggtgagaagtaatgtgaaccattttcaaataagttcttacgtgcagttcaacctaagtaggttatcaaaggtatttatactaagcactaaaagctaagtattaaatactaaaagctgcctgtgtcaacactggcccaggacatccccaaggagagtgctggctaaaggtctggaactttaaatctttagagttctttacttagcacatcaatcagatatttaccttctgcttctttgttctttagccctgctcctgggggaaatctccatcttaacggggcctcagtttgaaattggggttcgggatcctaacttaatgactgagcgtgcctgggttccacccagtcgcaattggtcaagacttggtcctctcaaggcctttcctccggagaggttaaatcctcaacgcctgctctccactttccagccttttcttaaggctcttctttcagcctagtatctgtgaccaacttctccttcctaggccctctcattattatttaaatgtccattcttttgggggcttcaacttcactaaaaacattccttcctcttcctccgcctcgtaactctctgctcaagcatctggatgccagaggtcatttgagctaaatggggttcaaagcttttctgactctggtactgcattccccactttcaaatcacatttttcaccccagggcccccagtggtctcaaacccaaacacagtgcggttaggaagtgggcactcgccacagagctaaattgggaattatttgacctgcagcttctggagaatggttttgcctcctccccgcgacatcaactaactcacttgctgttagctaagggcaaggacaatgtctcctctaccagacaggaaacttgatggcggacgctatccgttagttcctttttcaattccccattcccaccccttcgagaccacgatgtttcttaaaatacaaagtttcttttacaaaacatccctccgcaactttgagtttatataataaacggaaacgtcctttaaacaatcaggctacgaaggggttaaatctaatctcagcaacctgatggattctggggggtttccttcctcgactctagaaattaaaacgaaattttgcccaaggtaaagatgagaaccgtttacatcaactgtcaggcttctgccccaaacaagaatggctacccacgcccacaaacagagccactcacgtaactaaaaatggttggctccgggttccaccactggagtcactttctgcccaacttcaaaatggcgcccactagcttcaccaaaaggatcgaacttcccagcaccctctctggcccgtaacgtcaggtgacgcgagacccagccggaagtgaaggaaaaagcgcttcagcccgcggcgcctgcgcagaacgctccagacgctgagaggcaggaggcactagggatcgtccgcaggattgggactgatacagaggccgccacggagcccgccggagccaccgttcctgctgctgccgccgctgcccgaatcggaaccgtcgggccgcagccgccggcaatgccgcgaaggaaggtgagaaacgggagaggagggatggcgggtttctaaggacagtcgattgagcaccgtgacgcagttggccacgcctcacagtgcttgggtcccaactttccgctcccccgaaccttgttcagctaccctctcttctgtccatacccaacagaaaaatgtgggcccgaccctggcctcggcctatgcttgcaactattcccgccctctgcttgcctggatcggaggcgttcttattaattggtcgctgaaacgtctggaagcatattgattggctggtgacgccgcctgtttgggctcaacggtcacctccccgcgtgcgggggcggtgtctggccccggccccagcgctctcccactggctggagagaacgatccctcctctcctgattggtcgaggttggcagtctgtcctgtgggggcgcggcttaggcggacctcgattgggtggcccgaatccccgcctttccgagcggggacgctgataggtgcagaggcggggttttggaggcctcgttaccttccaggtgaggggcacaacaaagcagaagactgggtggtgggaagccagcgcccactcgcaggggatccctctcaggccagttgcctccaagcagttgcctctttccttatttgctagttcgacagcgcctagaaaatgcagttggtaaaaactaaaaacttctagaattagaaggcacttagaagatcacccaggaatggccccgtcgtttcttcttacagctgaactaacggaggcccatggagtgccgcaagccactcaggcagtggcagatccagaatatagaacaaatctaactcaattcaacaaatgtctattgactactttctgcgcggtggttgctgtggattcagaaattaattagatgtgatccctggcttaagggtgtcacagcccgataggagaaaacagacatgaataatcttagaaggatctagtaagttctcagcttggaggtgtatacaaggtgttgctggaaggaagtgaaggagcagttaagtctgccctggagtacaatgggagatatattggtaaaagccacagagaagagctgagttccaggatcaagccaggaaggaataagtctcacgtcaaggctttaaatatctcggtaattagactataatggtgacttttaagattcccccttcatttcagccgttttctgtgattcttgctcatttcctggcaggttacccttaagatacttggaaaactgggtggtattcttgctcatatcaatagaaatctttctcttcacagcggcttttcaggttgaaaatgtacactttttaatgtctcctaaaatgacctcagctggtgggtggtatgtatgtgtttttttgtttgtttgtttttgagacgaggttttgctcttgttgcccaggtcggagtgcgatggcgtgatgttggctcactgcaacctccgcctcccgggttcaagcgattctcctgcctcagtctctctagtagctgggattacaggcggattccatgacgcccagctaatttttgtatgtttaatagagacgggatttcaccatgttggtcagggtggtttcgaactcctgacctcaggtgatccacccgcctcggcctcccaaagtactgggattacaggcatgagccaccacgcccggccggtggtatgtatgtaaaggctcaccaaatgcaggaataatattggtgccttgaaatagggccacagtcctctttcttaatttcccaaataccgggagttacttgaaaatgtacatttttttagtaacctgtttggcggcaaacctgtcttaatctgtcctgaggctacttatggtttttgtgtgtctcatttagtgtgactgtttatattttttgctgcagaaatactattatgttttgttattgggtggtatttgcaggatacatgcaaagtactccccttctaaaaatccaaaacaattacaaattctaaacacaactggccctcagggttttgaataaataattgggacttacagtgtgaatctttgtattgttttcagtaaatattttttcctttctggttttgtaaagggtatagtgttagtgcttaattgataaaagttatctttatggctaagaaagaactcctcaggaggataataattgacaaatccttgctcattgaaaagatggttttgaaaacaactgtttttgaatacccatgagtcttcatgtgcaagctgcctttttggaagatagatggctttcatgtggagaaacgtcaaggatagatggcatacgcactaacaattttcatctttttctgcttaaattcttttgggattagagttgtggtccatgatattttgagatagtgtatggtttttaaaaaatgtgatagcttttcatggagacattgaacaaaagctactctaagttaaatgaggtccagcaccaacgattttctcactacagtggacctttttttgtgatattgatctccaaatggtcttggttaatacttagtactaatacagtaagaattaattctcttcatggccgggtgtggtggctcacgtctgtaatcccagcactttgggaggccaaggcgggtggatcacctgaggtcaggtgttcaagaccagcctggccaacatagtgaaaccccgtctctactaaaaatacaaaaattagctgggcatggtggcgggcgcctgtagtcccagctactcgggaggctgaggcaggagaatcacttgaacccgggaggcggaggttgcagtgagccacgattgcgcccttgcactccagcctgggcaatgagagcgaatgaaacggaagctcttcatttatttaacaaaattccctatttgtaggttgttccatttaagtgttctaaataaagtgaagttgcctgagggggtgggaggatgagaaatgcttgtggaatccttatttaggtttgaacttggggttttcagtgtcacagcttgttttattttcaatgttaatgcaaactctcagaccaaatgcttctgtgctaatatctggatctatggtattacagaggaatgcaggcagtagttcagatggaaccgaagattccgatttttctacagatctcgagcacacagacagttcagaaagtgatggcacatcccgacgatctgctcgagtcacccgctcctcagccaggctaagccagagttctcaaggtaaaaaaaccttcatttttccttaccactcctcacatctggctgactggcccatcacattattttcctagttaatgtggaaactggccccttggcttggtgtagatgacagtgcaccagatgattggtaaaatgtagagtgaatgcagagttgtcaggtctttaacaatgcctctgtggggggctactatccaatctgtagacccaaaggaactgcggatggtataatggatagagacacacgtatgtcttgagtcatttgtttgtttgtttgtttgtttttttagatcgcagtgtctccatcagtaaaattggaatgttatcccttcactttctgtttgaatgtttgaggcttagggacttgaagtccagatggtatctgatttatggtggcttgatttaatttttttttttaactttacagtggtgctaaaacaatatgcattcagtggaaacttttagaattttgaatttcggtcttttcctgggccagtgatatgtgggccaaatattttctcatgttgctgagtggtggcaatgagccataataactccagtcagtgagccgtaactcccagtcagccatttgatcatgagggtaaaccagtactcttcagtgtactgtctttaataaattatatgcaatattcaacactttattaaaaataggctttgtgttagatgattgtgcacaattgtaggctaatgtaagtggtttgagcctatttaaagtaggctaggctaagctatgatgctcggtaggttaggtgtatagcggttttttttattttctggagacagggtcttgtgctctgttgcacaggttggagtgcagtggtgtgatcttggctcactgcagccttgacctccttggctcaagtgatcctcccacctcagcctcctgagtagctgggactacaggtgcacgccaccatgcctagctagttttctttgttttttgtagagatgaggtcttattatgttgtctaggctggtctcaaactcctggactcaagcagtccttccaccttggcctcccaaagtactggggttatagatgtgagccaccatgttcagcctgtaaatgcatttttaacttataatactttcaacttatgatagttttattgagacttaaccccattacaagtcaaggagcatctgtagtctcttggacttactcttggcagaggcccacttctaaaaccatgtttaactctggaatgtaatccaataaacacttgatagatattaatagttgtaccaaaatatcagtgtggaaataatggaattttgctttggtaataaggaattgagaatcttggggttggaaggtagtttgaactatctctagtgcatttaggcatctggggttagatttggagggtacccttgaccctcctggctctgctctggtattccctgaggaggaaagaaggttgcagctaatacagaaagccgatgatcaacaggtgataatagatgaagggaaaaaaactttaacatgttttgagcacttcaacagtgttgctttggttaattttttttttttttttttttgagatggagtctagctctgttgccaggcggagtgcagtggcatgatcttggttcactgcaacttccgcctcctgggttcaagcaattctcctgcctcagcctgcaagtagctgggactacaggtgcacgccaccgtgcccagctaatttttgtatttttagtagagatggggtttcaccatgttggccaggatagtctcaatctcttgacctcatggtctgcctgccttggcctcccaaagtgcttggattataggcatgagccaccgcgccctgctgctttggtcacttttatatgagtatgttgcacaatgagagaaaaaccatcagtttttcaagcaagaaagtgggaatatcctctttaacaactgttcctaactttatttttgaatttaggatttcagctaaagtattgctattgtctcttgatttcttaagctttaaatttttaccacaatgagactatggataaatagctactataactcaagcagtatgttatgtactaggaaccatgatagaaaaatcatagttcctgtcctcaaagatcttacagttcagtgcaagatacagatatgaaaattgatcatgggaatacattatggcaagggctgtgagaggggtttgcatagagtactacataagcccagaggtgggacagccaacttagggcagcactcccacaatgatgaagtcttttttgttgttgttgagacagaatctcgctctgtcgcccaggctggagtgcagtggcatgatcttggttcactgcagcttccgcctcctgggttcaaggaattctcctgccccagcctcccaagtagctgggattacaggcgagcaccaccatacctggctattttttgtatttttagtagagacagggtttcaccgtgttgtccaggcttgtcttaaactcctgatctcaagtgatctgcccgcctcggcctcccaaagtgctgggattacaggcgtgagccgccgtgcccagctgcacactgagatgtcttaaaggctctgataggaatttacaagttgaaagatgggaatatgttattctcggcagatggaacagcatatgctaaggaaaagacataatgtttgtaggaagtataattgaccatgccctagacacctgaaaactaaatattcaaaacagctaggaaatgcgtaagcactgagtctctttctggttatcatacctcatgaccacagagttgcacaactccaggggtaccatttacaatgtcagcaatgtaaggtggtcctccctagagcacaaggtagatcatattgtgaaaggaggccccttggagatgtacaaatggataaccttgctctgtgctaacttttctcacccgaaagtttggaaattttcagttttcttctttagagaatctataagatttcttcagattttttttttttttaaatatacgttggggggtgcagccgtgagagagtgaggctgacaccgcgccctggcctgtgcatcccgccctctgaaaaaaaaattaattaattaaaataaaatatactttagagaggattttgactgttctcaccacaaagaaatgacaagtgtttgagatatggatatgctaattattttgatttcatcattacacaatgtatacgtctatcagaacatcacagtatactctataaatatgtacacttacatgtcaattaaaacaaaactaagactgctaggggcttacacggagggaattgagccagcatcaccacgatggtgttgttggagagtgagcagttcctgacggagctgaccagacttttccagaagtgctggacatcgggcagcatctatatcaccttgaagaagtatggtggtggaaccaaacccgttccaaagaaaggttctgtggagggctttgagccctcagacaagtgtctgttaagagctatcgatgggaaaaagaaggtcagcactgtggtgagctccaaccaagtgaataagtttcagatggcttattcaaacctaccgagtgctaacatggatgggctgaagaaaagggacaaaaagaacaaaagtaagaagaccaaagcagcagcacagtaaagggcacaaatttcctgctttcaccaattaaccactgaattgttattttttcctttggtttttacttttggccacatagctaggtttctggttcccctacactaggtgttttcacataagatgtagggtccttttgcaaagaatagttgcaatgtttatagggcagttgtggtaagaatctagtttattttacatttggctaattggtctgtactgcatggttatatactcctggattatagattaaaagtctctgtagtcatctctgtgaagagcaagctatgattaaacatgtctctttataaaaaaaaaagcacaaaaaaactaaaacatatctacatatattttttaaaaatgctttaatttcagctttgaatttccttcatttcctttgtcctcaggttggagatataaaagggctgctgagtgcctcagaataggtttttctatccaaaaaacttaaaatgctgcattcctgctttacctttatgaatctattatgacagtgccagagagggtaataagaaagaaaaaaaaatcggccccttaagaaaggaaatcgttttgtttgttgttatatctttggtaatagaatatctgttttatggtgggttagaaaaagggaagaatgagaggatgcagttaatatttataaagcactctgtaccacggatcatgttaagtgcttcacatgcattatctcacctattcctcaccacagtgttatgaggaatgtgctactagtattttccttttcaataggtcaggaaacaggcttggagaaaataacttgcccaagatgccacagctagttggtatggtggagtggagttgaatcaagttcagtcctaattccagaacctaaacttattaatgctgtactacattacatctgtatacctgagctaggctcttttgcttatattttatttaattaaatagatattttaaggatttgttggattttgtgaaatatgaagaggaggaggagcgatattctgataaattatatggataggaagtaaaacagatttccatcttttttctttattttcttttaaaattgggatcagattccagtcctgttcgaaatctgcagtcttttggcactgaggagcctgcttactctaccagaagagtgacccgtagtcagcagcagcctaccccagtgacaccgaaaaaataccctcttcggcagactcgttcatctggttcagaaactgagcaagtggttgatttttcagatagaggtgagtgggtatggtatgacttagacctattacagagcatctgggtgaaattctttttaaggagggcttggggccactgcaggtagatgcctaatacttcagctagatgaatgctgtttgcttgcttcctttcttatgtctttttttttttttttgagacggagtctcgctctattgcccaggctggagtgcagtggtgcaatcttggctcactgcaagctctgcctcccgggttcacgccattctcctgcctcagcctcctgagtagctgggactacaggcgcctgccaccacgccaggctaattttttgtatttttagtagagacggggtttcactgtgttagtcaggatggtctcgatctcctgacctcgtgatccacccgcctcagcctcccaaagtgctgggattacaggtataagccaccatgcccagcctcctttcttatacattgctgaggacagtttgatatcagaatattctcaaggtccagagtagctggagtatattaaatcgtacctgtaataggaaaaagagactgggcccttcttaaccacatttgaaaagggcttgaagcagacttttcttatagccatacttctcagtccatttatctccaaatttcttaatgcagaggtcacagactggtgaactacttctagctgtccgcatggttggttggtttgcttgcacagtgtttaaaattttttaaatttgttgctagtatttgaaaacacaatgatttcatataaaaacctggattaatagtttattttaaacaatgaaaagatctgggaacactgggcggccaatcacccatagtaataattggctggagttgaatagtagttgtcccctttagatggacaatgagctgtctctttggccttgctgagcccctgtaggcatttggtttgcaattcctgatttagagtctggaatttcaagattgaattgttagactacaaacaggctcactcaagactctaagtccattcacatcttacaccaagcctgttcagtgtcatccagaaagataatcactgtcacttatcttctgtcctgtgtatctcctggaagggaagtgggatagtaatgttttaaaaacgtatttccatctagttttgattatccatgattagcaactcaggagaaatacagataggtgtaatagatgaagtacaaatttaattttaatcagaatttaaagttgcacaaaatggatggtgtagaagtgcctcttcattttccatttagccatctagcagatgaatagctgaaagttactggttaaatcatagaaaaagaacctgggaagcccataaactctgaatagtaaacttctaaataaatgaactccactcataacttctaccaattgcttttgctttagaaactaaaaatacagctgatcatgatgagtcaccgcctcgaactccaactggaaatgcgccttcttctgagtctgacatagacatctccagccccaatgtatctcacgatgagagcattgccaaggacatgtccctgaaggactcaggcagtgatctctctcatcgccccaagcgccgtcgcttccatgaaagctacaacttcaatatgaagtgtcctacaccaggctgtaactctctaggtcagtgtgccctagcttcatgacatcctttgttctgtggttctctctcccaggatcatccagaaatgttttgtgttctgttgggatttagcttcttaggctcttcagtggtcatgtgctgagtgataatgagttgctcacttgaataaaagcatttatcttcttggccgatggtccataataatagatctggttgtaaggaaattaactatgatgagccattcagtttatcctagagcttttcccagtgaaaaattccctcattttcctagcaaaagcaaaaaagactatctgcagatatcttactgcatggcacatagctcgtactcagtgaggactagttaaggataaggtagtgcagaatagtggttgcacggccatagctgttaaggaaatgagaaaaacatttcctgtcaagaggctgtgaaattaggagtacacatgagaccctggccttctgtaactttagtagcttaggttccttgctttgtgtacttagtaagtatgaacaagataaaatatttcttctgtgataaataagtatcttattatattcttatgagttttaccccttagtgaattactttagagattcttgtggtttgaaccttatttgtgcaccttcagtgagctgaggtgcaaatattgggcttaaggttttgtctagagttggaagatgctgattgggaggtaaggggcctttcactactgggtctacttctcaaattcaccctttgcatgtggctatcaagtttgaaaaaccgtagaacagagtaaattgctgcttggcaggccaacagtacacttcctgtagtgtgttttgtttgtttgtttgtttttgagatggagtcttgctctattgcccaggctggagtgcagtggtgtgatctcggctcactgcaacctccgcctcccaggttcaagcgattctcctgcttcaacctcctgagtagttgggattacagatgcccacaaccacacctaacttttgtatttttagtagagatggggtttcgccatgttggtcaggctggtctcgaactcctgacctcatgatctgcacgccttggcctcccagagtgctgggattacaggcatgagccttttgtttgtttttatagagagacaggggtctcactttattgcccaggcagaggtgcagtggcatgatcatagctcactgcagccttaactcctaggcttaagtgatcctcccatctcagcctcccaagtagctgggactacaggcacgtggctttcaagcttggcttttttttttttttcttgttttttagtaatgaggtttttgctgtgttgttcaggttggtcttcaactcctgggctcaagcaatcctccccactcagcctgctgagtagctgggactacaagcgtgagccaccatgcccagtggttttctgtagtgtttaattaatttggattgtttcctggccttttttttttttttttttttgagactgagtctcgctctgtcccccaggctggagtgcagtggcgcgatctcggctcactgcaagctccgcctcccgggttcacaccattctcctgcctcagcctctcgagtagctgggactacaggcgcctgccaccatgcccggctaattttttatatttttagtagagatggggattcaccgtgttagccaggatggtctcgatctcctgacctcgtgatccgcccgccttggcctcccaaagtgctgggattacaggcatgagccaccacgcctggccatttcctggtcttacagcagtttctcagataatttcaaaccatcggaataaatacagcaaagttgtcttgaactccataccagttgtcactcgaagataattgtttcaggcctgcattgatttccttggaataaataatgagaaaaactaagaaagacaatatattacactagtagatgatatgatggctaatgtgctttaagagtttaaggggatctgcttgccatgcatcaagaaaaggaattttcctctgcttctgcttgttactaaccatgcattgctaaattgttaattttatgtactatatttggtcattcatgcagcaaatatttactgaatattggtcatgtgccagatactgttttaagttatgaggatgtagctatgaacaagtcaaagtctctgccctcatggagcttatagtctagctgagaaaggcaaatagatagacgtgtaatatatcaactggagataaatgctgtgaaggaaaatgaaactgggagtactgagggtaggatattgtgtgtgtatatacatacatatgtgtatgtatatgtgacatatatatgtagttggctaggaaaagctgctgtgatatggtcacatttgagcggagacttgctgttggaatatttgagaataagcattatgggtaaggagaacagcaagtgctctgggcaagagaatagttaaccagtttgaggaacacttagaggccaatatacctggggcagaatgaccagaacggagaggaggagataggtcagaatggggcctgattgtgttatttatgcccaggagttaacctcttaatggggtagaccatagggtaaataaaaaatatgttgtattagaggaaagtttacttgtatttgtttatttatttattttggagacagagtctcactctataattaccaggctggagtacagtggcgtggtcactcactgcaacttccgcctcccgggctcaagtgattctcatgcgtcagctgcctgagtagctggggattacaggcatgtgccaccacgcctggctaatttttgtattttttagtagagacagggctttgtcatgttggctaggctggtctcaaactcttgggctcaagtgaaaaagtttactttgactttggttttaatgtattggaactttgaaaaatatgaacccgagcttccaaagtatcctttttttttgaggcagagtctcactctgtcacctaggctggagtgcagtggtgtaatctcagctcactgcaacctccacctcccaggcttaattgatcctccaacctcagcctcccaagtagctgggactacaggcacatgccaccatgctcagctaatatttgtatttattgtagagacagggtttcaccatgttgcccaggctggtcttgaactcctgggctcaagtgaccctcccacctcagcctcccaaagtgttgggattacaggcgtgagccactgcaccgggccccaaaatattcttgaccctagtctattccttaagagttttatgtacttgtgaaaaattaaaactctataggaaagtttgaagtgcattaagtaaaaattgcccttaactcatacccgcagaactgtgccacagatacaaaacttctgtttgcagttttctatgaatgcttccaagaagtttttctacatatataagcacacgtatatgtacacatatttcctttttgtgattattcataaaacggaaaataggatacatttgttcgttgtacatcttggatatttgtatttagaggcttgtctttttaaaagatacagagaatttcattatattgatagtttataaattatttaaattgtctcattgacatttagattgtttctcatttttagcttttttgaacaatattgtaatgggtagccttgtatgtacatattttggtgtctttctagcaaatctgtaggataaattcagagcagtggaatttttaggtcaatagatcagctgttccttttttactgtagataatagattggttttatttaacatataaaagaaaacatgccctgaataaattactaagaagtatggatatgcctgggtgcggtggctcatgcatgtaatcccagtactttgggaggccgaggtgggcagatcacctgaggtcaggaattcgagaccaacctggccaagatggtgaaaccccatctctattaaaaatacaaaattagccaggcgtggtggcggcgcttgtaatcccagctactggggaggctgaggcaggagaattgcttgaaccttgggaggtggtggttgcagtgagctgagattggccattgcactccagcctgggcaacaaaaggagtgaaactccatctcaaaaaaaaaaaaaagacgtatggatacatagtatctgaaaagcaagtcttgcagtattaatgacattactttttttgagacagggtctctctgtcacctaggctggagtatggtggtgtgaccatgactcactgcagccttgacttcctgggcttaagtgatcctggcacctcagccttctgagtagccaggactacgggcatggactaccgtgcctggctaattatttttctttttgtagaaatggagtctcactatgtatgtcacccaggctggcctcaagctcttggaatcacatagtcctcctgtgttggcctcccaaagtgctgggattacaggtgtgagccactgagcccagctgatgctacattgtatgtatggtatttgatcagtgaggatggtttttcgtgttcaagataattttgcggacctctaaaattgcattttttttttttctgagacggaatcttgctctgttgcccaggctggagtgcaatgatgtgatcttggctcactatagcctctgcctcccaggttcaagcgatttgcctgcctcagcctcctgagtagctgggattacaggcatgcatcaccatgctggtctaatttttatatttttttaagtagagatggagtctcaccatgttggccaggctgacctcaggtgatctacctgcctcggcctcccaaagtgctaggattacaggtgtgagccaccgtgcctggccctaaaattgcatttttaaaatttatttattttattttatttttttgagatggagtctcgctttgtcacccaggcaggagtgcagtggtgcaatctcggctcaccgcaagctccgcctcccgggttcacaccattctcctgcctcagcctcccgagtagctgggactacaggcacccgccaccacacccggctaattttttgtatttttagtagagacggggtttcaccgtgttagccagaatggtctcgatctcctgacctcgtgatccgcctgcctcgccctcccaaagtgctgtgattacaagtgtgagccactgcgcccggcctaaaattgcatttttaataatacagtcccggagaaatgatggcctgaatgtcctaaaatcacccattcaccagtacttggactgttttttccttttaaagtttattctataaattatgttgtgtaagctttaaactccactttcttctttaccccaaattaaatgtcttttttttttttttttatgaaagatgaagatttttgtagacttgctattcaggttagctaactttttatctcattagcattgtcctatgacccctttcaatcttaggtgttttataaaccttttggttgaagagaaatatataaaaaggaaataatgttcaattccctgtgtgttttcaaaaaaaccaaatgaaaaatagatgaatgggccgggcgcggtggctcacgcctgtaatcccagcactttgggaggctgaggcgggcagatcacgaggtcaggagatcgagaccatcctggctaacatggtgaaaccccatctctactaaaaatacaaaaaattagccgggcgtggcggcaggcgcctgtagtcccagctactcaggaggctgaggcgggagaatggcgtgaacccaggaggcggaacttgcagtgagccgagatcgcatcactgcactccagtctgggcaacagagcgagactccgtctcaaaaaaaaaaaaaagaaaaatacatgaatgaagagatacccatttaaataaaacaagctttcgtgttttgttattcctaacatttttccgtcttcagaaggccttgtgttactgcctgtttcaggcgtggctcatgcctgtaatcctagcactttgggaggcggaggcaggaagattgcttgagtccaggagttcaagaccagcctgggcaacactgagacccgtttctacaaaaaattttaaaatgggcccagcgtgatgttgtgagcctgtagtcccagctacttgggaggctgaagtgggaggatcacttgagcccaggagttcaaggctgctttgagccatggttgcaccactgcattccagcctaggtgacataaaaaaattttttaaagtaaaaaaatctgattatagaagaatcctaaatctttaagcaaaactcagttctccctccaaaaaataagtatttaatctggtttaaagttatgtaagtatgtttacttatatgatagaaaaggccgcttctccatttttcataaatttgagtattgaaaggggttaaattcaggttggataacattgcacagtagaaagaaaagtacacttattctacatataacctgattaatttagtataggagagttacattccaccaaaagaaagtgttcctgttcatagtcttgggctttaattacaaatgttgacttcgtgacattttgagatttgagaagtctaagagcagaaagaattatagtttatattgatcatacataagcatgttcaaagactgccagatccatcctgtggaagaaaagaatgagtgtaagttatagccctaccagccttatgtttggtggattcagtctgatcagacatatatttgataaaaatgatgtagcaaaaaaacaggtttgtcttagagaaacatactactttctaagcttgtcttctttcttgagattaagttttccctcctttaacaggacaccttacaggaaaacatgagagacatttctccatctcaggatgcccactgtatcataacctctcagctgacgaatgcaaggtaattgtgctctcatttattcaacacatgcttattgagtgcttaccgtttgccaggcactttgctgaacactggggatacagtggccaacaagatgggtagggtccttgttcttacattgtagtggaggaaacataaaaaacaatgtgcttttttagaaaaaactagttaaacagacaaaagaattgtaatatgtaatgagtgctttgagagaagttaacaaggagattatgaaacgtttggaacatcagccactagtgcattgatattttctgttgaaaattggcttcgaagactgctagggacttattgcactaaggaataacttgcataaatatgtgatcttaatatttatgcattcggttctcttctcataaatctatgaagtcattttgcttttaaaaacctttcataattcttgttcctttttctgtccatttctgtgaaatactttttgttactctcagtcacacctacttttggctaattcatcttttaaattcttgaaacctagctcctaaataacctttgggattttgagataatgtatttaagtagaagctcagatcccatttgtgcgttcttgtgtgggttgctgttcccaaggatggaaccgaagatctaattatggggaagcaagagtggaaaatgttattaattaaatggattgcttgagtagtattggacaggttatctaagctggttagaccaaagtattattgttgtttttgttgttactttgctagtgacaccagggtcacaggtttattcctgtctgagccaatttcattgtgaggaaaattagattccctagctaacattaattttccttgattcagaatttgttctcttatttacaggtagaccgcaggggtgaaagtttcttttgtgtggttagtctttcagcaaagtagtgtactttccgtgcttatatggattttaaggtcaatgaccctactcttatttttcttcattccaaatcattttataagtggcaattccttctgctctgtgtaaaagtgagttgtagatcttcccattgtcctcccattattctgggactaaatcaaaacagaaaaagctgtgcccacatctatgtcagaagcaggaaaggcttcaggtacttctttctcagaaaataactgcgatccctgctttttgagagttgtcctctaccacttgtctctaaatacaatgatctgatactatggatggttttacataaaaatcttcctgagatgtcttttgcttttgaaattgttagtttgtagcaatatgaccatgtaacgttaagcagtttattttagaaaaagaaaaatttcagtttggtgaagaaaattctgaccaaaggaaaacatttctatcttgaatttatcctctttgttctctcttctttgcaaggggcattaggcgcagaataatccatctttactactggaacatgtgcatggaggatcaggagaatttctgagatgatatatttttattacatttagaaccctaagtggaaagattagacaaattccccacatttattaacagctctagtgtttttgaagaacctgcatatacatgattgctcttgagtttcccaggacacccttgcgatcagtgatgttacatttgtattcagtcatatatttctgtagctgcatgtgccaaatacaggtatctgaggattcagtgaataaaagactgcatttaaggagctcatgttctcacagggggaggcaacataaaccttcaaattaataagtaaataattttgtgtagtgataaatattgtgaggaaaaaaagacgaatgatatagagagagtctgtttcgggggtgagggtagggatagcactgcttttcccaggatggtcctggaagacattcctgaggagatggcatttgatctgggacgtgaatgatggcaaagaagcagttgtgtaaagatctagaagaaaagatatcttaagtagaagcaacagcaagtgcagaggccatgaggcgcggctaaactgatgggtttgagaggctgaatgaaagtaggccgtgtatggctggatccagatcataaaggaccttgtggaccttggcacaggagtatatttttgttctgatagaatgagaagcatttggggggctttaacaaaggcatgacaggatttcaggcacgcttttgaaaactgaagacttgttaacgtggagaatggagtgtgggggcaagagttgatgcagggtatagggtgcttgggaaactgcatggaagttcaggcagtagttggtggactggactagctttgtatcggcagcaattctaagactaggttggattcaggatacgttttagaggggagcaacccgttaggcttgctgattgatttgatgtgaggtgtgagaaaagagaagaatctaggataacattcaagttgttgactggatcagctatttagacagtattgccatttattaatactgggaagatttggggtagagcagatttgtggagaaatgccagtcgttctgttttgaccattctgagttttagtggtgaagtggaataagcagttggatatcagttcccaattcccagattatgaaacagaaactgttgagagctgatgtgatttgtctgaggtcatgtaactacagaattaagtttccctggagacttgaacccaggttttctttttttttttttttttttttgagacagtctcgctctgtcacccaggctggagtgcattggtgcaatctcagctcactgcagtctcagcctcctagattcaagcaattctcatgcctcagcctcaagtagctgggattacaggtgtgcgccaccacgcctggctagtttttgtatttttagtaaagacggggtttcaccatgttgcccaggctggtcttgaactcctggcctcaagtgatctgcccaccttggcttcccaaagtgctgggattacagatataaggcactgcatgtggccaagcccaggttttctttctttctttctttctttctttttttttttttttaagacagagtctcactctgttgtccaggctggagtgcagtggtgcgatctcggctcactgcaacttctacctcccgggttcaagcagttctcctgcctcagcctcccgagtagcggggatcacaggcgcctgccaccatgcctggctaattttttgtatttttaatagagacggggtttcaccatgttggccaggctggtctcaaactcctgaccttagctaatctgcccgcctcagcctcccaaagtgctgggattacaggcgtgaggcaccacacccagcccaaacccaggttttctaatgttttctttgtacttccatactctattcttgcacttcctcatgcttttttaatttatttattgtactttgagaagagtccaggctcagagtcatcagacatgattaaaaccttagtgatcccatcatttagctggatcatttcaacttctctgatcctgttattggctgagaaggcagaatgtgaatcttgcattatctctttcttgtagagattgtgacaataagtgtgaagaccctttgaaagtaaagtacaacataaatccaaggcattatcattgtattcttatgctttaagtaaacgtagtcttagaagcaggtggatttattgacgttgttgatggttgcaggtgagagcacagagccgggataagcagatagaagaaaggatgctgtctcacaggcaagatgacaacaacaggcatgcaaccaggcaccaggtatgggccttgttaaagcactggccattcatagtttgaggtccgtttcttggatctcctctataattgtcttcaggcatgtctgtgcctcatttcctgtggtatatcttccagatgtaaacttagaatcatgtttgtttttcaaacagtaaattttcataaaacaaacacttctacctcatgaatgaaggaatcatgctatctacagtagtagtaatagtagtagcagtagtagtagtagataattctgattatttgaaagattacacttgctgcttcatttcctcacttcgcatcctttaagactattgtagctttcaaacctctccactctgctagcacctttccaaggccaccagtgacttttccccagcatttgacacttgctgactgtgttatttgtcttctacttatctcttcccttggtttgtagggagcatcctggcttggtcctaaacctcctcctgcctctctgaacattcctgccacattggttcacttacttccttgttcttccctaaatgcctttggtcttcactcttcctgttttcctgcctggaacgctatacctgtaccaagaacagatggtattttctttcaaggcccgtgcagttctcagctgttggaggaatttttcccaaattctctcccaccgttaaggaatttcttccttatgtattcccattgtagtgctctcaaaatgttagcctttgtgacatattatattttgttcatcatttaggtgtctgtttttgcagttagattatagttggatagcagagatatatggtgatgaggaagaagtttgactttggagccaaacagatgtgaatttgaatactgattatttaactctagctatgttgtcccgggcaggtcaactaacctatttctttgttaataagaagaggtgaataatgcctacctggcaggggagtcagctaaattatgtatgtaaagtacctatacccagtgcttggcaggtaaaaagcactccataagtggtaactacacttttcttcgttgtctatcttaggtttaatttaatttaatttatttattttttagacagagtttcactctttttgccccggctggagtgcagtggtgtgatctcagctcactgcaacctccgtctcccaggttcaagtgattctcttgcctcagtctcccaagtagctgggattacaggggcacgccaccacgcccagctaatttttgtatttttagtagagacagggtttcaccatgttggccaggctggtcttaaactcctgacctccagtaatccacctgccttggcctcccaaagtgctgggattataagcatgagccacggtgcccaaccttgggttttattcttattcagtttttctatttaaattaatacatataaatgaatttttgtaccactgttgatcagatcaataagcattaattggaaaacagtaagcattctataaatgattagttgaaatgatcttaattttattcttgttgctttggtggagacgtctatccttagtttatgttagtagtaaaataagtttgtattcctgaacctatatttaactggcagtaaaggtggtgggtgatgagaacctgatttggaatttttaaattgccatattcatgaaaaatttagctgggcgtggtggtgtacacctgtagtcccagttacatggaagactgaggcaggaggatggcttgagcacaggaggtagaggttgcagtgagccgcgatcgtgccgctgcatttcagcctaggtgacagagcgagaccctgcctcaaaaataatacaaatgaattccaccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataaaataaaattgccatatgatttgcattgtggctagaaaatttctggcatttttttctctttaaaatttttttacatgttttggtaccttcttttttttttttgtttttgtgccagagtctcgctctgtctcccaggctggagtgcagtggcatgactggctcactgcaacctctgcctcccaggttcaggtgattctcccacctcagcctcccgagtagctgggattacaggcgtgcaccaccatgcctggctaatttttgtatttttaatagagatgaggattcaccatgttgtccaggctggtcttgaactcctgatctcaggtggtctgcctgccttggcctcccaaagtgctgagattacaggcgtgagctactgtgccgggccttggcactttcattttgaagcttagctttataaggagttttctctcagttttctcctttttccttttaggcaccaacggagaggcagcttcgatataaggaaaaagtggctgaactcaggaagaaaagaaattctggactgagcaaagaacagaaagagaaatatatggtgagggaaagttaaatatttaatgagcatgaactcctgctatcacatttgattccttttgctttctgagcttctgcctttcagatttgccatttagtattctccacatgtgaataccaattgactcttctatggcacttagagtttatttcatcccccaaaactgaattgttgagagtggaaacaggaggtcttgggaaaatgaaatacaattagaatttaaattttaaaaaatttgatcctctagttgttcataaattttactttcatcttaaagggttaaatttacccgctagaacacatgccatggcactggaaatgtctgtatgaagaaaaatattcaagcttaatagtagtctgcttattttaatggaaaaatagatttcctccatgattaaaaggtattaattgggtgaatattctgtaatagaccttcttgtagtattttaacatttttttctaactttagaagtaatgtacatttgtaagagaatttagagtgattaagcaaagtatatggaagaaaacaaatcctactacctaaaaatagccacagttagtgtttttggatatatcctagctttttcacaatctcttatttacataattaccttcttactgtatgtagcactttgaattctgtgttttcgcttaaaaatcttttttttttttttttttttgagacagtcggccaggctggagtgcagtggcacaatctcggctcactacaacctctgcctcctgggctcaagtaattctcccgcctcagcctcccgagtagctaggattacagacatgtgccaccacgcccagctaatttgtgtatttttagtagagacggggttttaccatgttggccaggctggtctcgaactcctgacctcaggtaatctgcccacctcggcctcccaaagtgttgggattacaggcgtgagccaccatgcccggccttaaacatctttttttaggaaaagattttattataaatgtattaatacatgcttactactgaaaataccaaaaatatagagaagaaacattccaataaaaaaaaattgtccttcaagatacaaaccactgcttaacattttgatgtgtgttctttcacagtctttttctttttctttctttttgagacagagtcttgctctgtcaccaaggctgaaggctggaggctggagtgcagtggtgcgatcttggctcactgtaacctctgcctcctgggttcaagcagttctctgcctcagcctcccaagtagctgggattacaggcgcccaccaccacacccggctaatttttgtatttttagtagagatggggtttcaccatgttggccaggctggtcttgaactcctgacctcgtgatccacccgcctcggcctcccgaagtgctgggattataggcatgagccactgcacccagccttttttttttttttttttttttttaaatttatttattttaaattttagataagggtgtacatgtgcaggtttgttacatagatctattgtgtgatgctcagatttaggcttctaatgatcttatcctgtcacccaagtagtgaacatagtgataggtagtttttcaacccttgtccgcctccccactcttggaatcctcagtgtttattgttcccttctttgtgtccctctgtacccagtggttagctcccacttataagtgagaacatgctgtgtttggttttctgtttttgtgttaatttgcttaagataatggcctccagttgcatccatgtcgctgcaaaggacatgatttcattcttttttatggctgctcttttagatttttttctgacattttagtttttttcatagaattggaatgttttcttattcagccattgggatagattcttaaacatagggcatgtgaatacttagtcagagcatggcttcactaagacaaaaatatgccagactatgcatagttgacccttcgtatccatggattttgttcctgtggattcaaccaaccacggatcggaaatattccgggaaaaaaatgtggtttgtactgaatgtgtacagactttttcttgtcattatttctgaaatagtagtgttaacagctatttacatggcattgacatcacattataagtaatctagagatgacttaaagtatactgctggatgtgcccaggttatatgcaaatatgacatcatttacatacgagacttgagcatccatggattttgttatatgcagggaggttgtgggggcgttcctggaactggtcccccagggatatcaagagatgactgtatttccttttttttttttttgaggcggagtttttgagacagagtctcactctgtcacccaggctggagtgcagcagtggtgcaatcacagctcactgcaacctctgcctcctgggttctgggttcaagcaattctcctgcctcagcctcctgagtagctggaataataggtgtgggccaccacacccagctgatttttgtaattttagtagagacagggttttaccatgttgcccaggctggtctcaaactcctgacctcaagtgatttgcccacttcggcctcccaaggtgctaggattacaggtgtgagccagcacacctggcctgtatttacttttttgacagtcatcactgtcttaaatgctaattttatgaatacatggacataggccaatgtaagatgggttgtggggtgaatttgtagttagacctttacaccagactgtgttggtttgtacagtgagggctttagtagtgggctatagggtaccagattgtttgcttgccccagtcttgttcactgtttccatctgcaaacttgttagaagggtaataagacaatgataccgtatattgagtgattagtgctaggcactgtgattgtgacgttcctttgatcttttaacagtccagtatgattggtgatatttcccatattttatatacaggaaaactgagactgagagaggtaacttacctaaaatcatacaggcagaaagagtgtctgaagtaaaagttcttgaaatttttaaccttaacaaacatctgctctgctttttagtaatttgggataggttattaggacccaacctccttgattaaaatgctggctaggacttttttcaagcttttttttttccagtgttcctcaaaatagaagaaataactaatgcgtagaacccaaatcttagatgatagagtccaaatttaaaaagattcacagcagatggaatcagattaaccggaagaaattttaatagggataaagatactgatgaatggtctcttcatatggtaatatgtgtgtgaaatctataatgttttcctgagataagccatccactccacttaactaccattatctcctattctctggatgggaggtggagcctacaacagagtgggaagggctgaaatcaaaggcttaaaagggaagtttcctttgtagaatctctttcctggaaaggattcttgtagtgactgccatggtaagattagggaattatttaagactggattattctcatgcttttaattttctatggctttcacctgtcttattcttgcttaatatttagtaagtcatttttagagagtccagcctatttttctgtgtatgtggactggagtttgagggtagcacgccttttgcagacagcataatggtggctggagcaattcaagtgaaagaagttacaaaggactgcttcatccagctgcccctgcccctcccttcctgcagattttcttttgagtctaaaatcttagacactaaggcttagaaaatctggtttttgtttgttttgtttttaaatcggggagtatctaccaaagctccttccaaatctcaggattctgggaatttgtagtgtctctgggtttgttgtactttatttatttgtactgtcatgtaaatttttacatgaaggaacagcgttctgatccacaaagtgtatcttttcagagatagaagaatgaagctcccttctggagctgtgggagcatttcctctccagaatcactggggtgggtagtgggagtcttgtggcattaacctgataagtagtatgtcttgtgctcaatccctagcacctagtatgtaggcactaaataaatagcttatggttgtgtggtttgcatggattgaaatgaaatagattaaaaagttcttagaagcagagagtatcagagtatcacgctctggttattttcctaggaacacagacagacctatgggaacacacgggaacctcttttagaaaacctgacaagcgagtatgacttggatcttttccgaagagcacaagcccgggcttcagaggatttggtgagtattaaaacctccaaactgaaggccgcttgtgaaaggtgcttagagttgccaggaaaaatgattgcaaatcagtttgatgggaattaaatgtaccttgcttctggaatctctttccctgtctcccagctgtccctttttggagactagccttccctttcagatttaaaatgaatcacccctcctcccttcctttttttattccctgctttccacctcggctcccggaagtaccagtttggctagagctgatgaggctggataaaaccataggcgcccctttgtctcagctgggcaatttgcaattctgagaacctgtagcctaggagagactcatctctgttgttttcttaatcccaacaggaactccccttttgctaggtttcctctgcactaagaatgaaaataacagtgaagaggaataatggaaaaggctgttgtcagatgttttagaattaatctttgacacagccaagtttgatacattggttttccattctgatatttagagctagtttatactgagttgctgtcctaggcagaatttttaacaactttgcttgaagaaaattctggtgattgagtttacctctgatataacagattaaatgtgttcagggaagctcagttttaaagtgaatctcgtcttcacccccttcccccttgtattaaaaaaaaattgtatcaaatactagacttgttgaaaacttggcagaggcagggtttgctggctacccttggctgggatgggctgttactgctgctggttttctctatcctattctggcatggagcatttcctgggctagccttttacaactttacacctggttatgcttacaaattatacttttgtagccaactcagagccactgaatggagatggatatccgaattttttttttttctgagacagggttttgccctgttgcccaaactggagtgcagtggtgccatcatggctcactgcagcctcgaccttcagtgctcaagcgattctcccacgtcagcctcctgagtagctgggactacaggcatgccactacacccatcccagaaatattttctgccttctagagtttagattctagaattatcatgcacatttcaaaaatattttttaaagggcctgtttttttttctaagtgaccattgtggatatatttcacggagattcatatagctttataaaagcttctgcagataagtaaggcagattctaaatcaagttttttgtttagttttagaatactttataagggtggggagtttgtatctgtgatgattttctttataattcagtttggtctaggctgataaaaatgaagtttccaaggtatcattctggtgaggcccagaatgtgggaggtagcagagaaacctctcttttgagacctgtgctctgggcagtatgggtagtaagttttctgtacacctgtgtgatttttcatgtagctctctttagtgtaaattctcatggatagaagccaaatctgtctgatttttttcatagcctagcgtggtggcatgcacacacacttttaaaaacaaagataatatttatttttttaaaaaggagtttcgctctgtctcccaggctggagtgcagtagtgcgatctcggttcaccgcagcctctgcctcttgggcgattcttctgccttagcctcccaagtagctgggattacaattgtttgccaccacaccttgctaattgttgtatttttagtagagatggggttttgccatttcggccaggctggtctcgaactcctggccttaagtgacctgcctgcctcagcctcccaaagtgttgggattacaggagccactgtgccctgtctaaaagcaaagataataaattctgatcctcctttgacttttgatttcttggcaataggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggtgagttgtcttgggttcctctgccttgaccatgatggcaataagctgtaggatctctagattttgccatagcgatggcatctgttcaggcaccttctcagtggtcctcagcagtgggatgaaggcataggaaatgacaggccacagcttaaggcggggtatagagcctgaggtatggcttgtgctgggtgccacccaaagcagctgagggcccttacccacatcctgtcatgtacatcttcttgtcttttgttcttgctgcctactgctcttcatttcctccttggaatatgaattacctctgcccacaggttttgtgtgtcccaaactagatgaaaatacagacttcattaggcacagcagagacagcatggctcaccttcatatccctagcaactagtgtggacaactgatgcccaagaagtatatgttgaatgggtacttattaatatttaatagtgatcagcctgtgacagattatgaaagtagcagagtgggtcctttggtgccttcccctctttttcctaataaaacaggtataaggagttgaatctgttattgttgacaaataggtttactagattttttgcagcttcaaaaaaaaagccatttttcccccgctctgttacagaataagctttgtcttaaggggaatttctgccatggagcaagggtgcggaacaggggaaggagtagagattagcctttcaggcagagaagactttttcttgtttttttttttttgagagggagtcttgctctgttgaccaggctggagtgcagtggcgcgatcttggctcactgcaacctccgcctcccagattcaaacgattctcctgcctcagcctcctgagtacctgggactacagtcgcacaccaccacacctggctgatttttgtatttttagtagagacagggtttcaccatattgaccaggatggtcttgatctcctgacctcatgatccacccacctcagcttcccaaagtgctgggattacaggcatgagccactgtgcccagcccttgttctcataatcacaatataatttggctctaaggcctctggggtgtctctttttccttccccttccttttttatttcccaggatttccatatgttgagcatctatgacccaggtttcctgtgatttctgtcattatactcttctccccagtttggttggtgataactgcttttttatgttcccagttcaggagcatgtggtctgtaagttcagggcccagaactgttgctttgactcaggttctccagaccctggcacacttgactgcatagggctagagtcatggaggggaggtgattggcggcgattggtagaaatatcagtgcacaggaaataatggggtcagaaggtggggcactgatacagatggcaggccgtggagataaagtaaaatggttttactgtgtgaaagcgggtatttttattgatgtgaactgcttaccatttatgccttttttccttttcgtttctggttgttgagtgacacaaaccaatgaaatagccaaaagggcaagaaatagtaatagaaggagaaaacaaagagtctgaataaatctgagaatcaaataaacattctgaatatttgaaaatcttccatattatatgatataaaaatcagatttcaggaaatacctaatttattccatgcctgttcttattcccgttgcttcaggtgtgatcactgaaatgaaatgatcttcctttggcttggcttctgtttctgaacaaataataattgttacatgagtttggttattgttgggaagagccagcatgagtaaaggggtagagataggaacaaactacagatggaattttcttggatggattccagttaataaatatttggatttacatatgacaaattggaacatgcttcttgagttgacaaaaagagttgcagtaaatttgcttaatagaaagtgtttcatgggccaggtgcggtggctcatacctgtaatcccagcactttgggaggctgaagtgggaggattgcttgaggccaggaatttgagaccagcctgggcaaaatagtgagactctgttgcttcaaaacccttttgaaaaattaactaaccaggcatggcgccatgcgcctataatcttagctacatgggaggatcttttgagcccaggagttcgaggctgcagtgagctatgatcgtgctatttcagcctgggtgacagagtgacaccctatctcaaaaaaaaaaacttttttttatacgtctatactttttaaacacttttttcttttttttttttgagacagagtctcgctctgtcacttaggctggagtgcagtggtgcaatgtcggctcactgcagcctccacctcccggattcttctgcctcagcctccagagtagctgggattacaggcccccgctgccacacctggctaatatttgtatttttagtagagacggggtttcaccatgttggccaggctgctgtcaaactcctgacctcaggtgatctgcccacctcagcctcccaaagtgctgggattacaggcgtgagccaccgcatcaggccttaaacattttaaaatgtaaaccttttgaagaattcacctaacagcagatggctggctggctggctgcattaaaacagtaagcacttgagggtgaggaaaagggggtactttgtgctcccttgtggccaagtgaccctagcttcctgctgctcagctaggctgcttgccttttttttttttttttttttttctttttttgccacaggactttctcttaatttccttatataacaaagggaatgcacttgcaggggagaagggcagacaggtagtggtacatggtttttatcattgtgagtgggttttctaatctgaacaaagaaggccatcatggttaggtggtaatgagaagttatgggtaaaggtgagagtaaagtacttagccaccctaagctgctggaaataagctgcttaagaatttcctgttggcttgaggcatttggtaataagcaagcgtattgttatttatttggcctttatgtagtgggtgattttaatctcctgggctaaagtagtgccagaatgtaatccagaatacttgttccagattgctataaaagtgtcataaatatattcaaatgactttggaagcctttgttttatggaaataaaatctctgttttgctgtatgttctcagcttgtccaactgtccggtagctcagttaaccacatttgacctgtcattccttttcccttttgaggagcagtcttgttgggaggctttggttccctgatgtgaatttcattgtcttgcaggccaaatgtgtgtggaaacacccacctggtgatgagatatatcgcaaaggttcaatctctgtgtttgaagtggatggcaagaaaaacaaggtaaaaagtggtgactttagaaaggagttgaaatgttgtatattcacaggtttcagaaggcatatgttttttctccatcacaccttgtgaaggacatagaactcttctcttgccaaaatacacaatgtgtttcattaataattatggtatgtttgtgaattttaggcctttatctgtttaggaatcagtggcccacacatgaactctgtttctctgcttccagatctactgccaaaacctgtgcctgttggccaaactttttctggaccacaagacattatattatgatgtggagcccttcctgttctatgttatgacagaggcggacaacactggctgtcacctgattggatatttttctaaggtaagcaggatctggagattaagaagccaatggccagagcagggtgatccatgttcgcagttgggggctcaaatcactgacaggaagaagctgtactctgggcaatgatgacaccccttccttaaattaaaaaaaaaaaaaaggcaaacccatgtatcaaagattgtttaatgaaaatgcagtttttattaaaagcttctggttcattcatttctagaattgtggactggagctgcctattaataactggccagagccctccctagtaactcacaagcccacatcttgtagtcaaaccagttctgctggctttgcctgcctctatgttattagcttaaaaccaggaatatactctttttgcctgattgtttagctgggctccttctagcacagtgccttcagtgataacactactgcgccttttaaagacccaaggccagattttttttttttttctgacagagtctcactctgttgcccaggctggagtacagaggtatgaccttgactcactgcaccctctgcctcccaggttcaagtgaccctcctgcctcagcctcctgagtagctgggataacaggcgcctgccaccacgcccagctaattttttgtgtgattttagtagagatggtgttttaccatgttggccaggctggtctcgaactcctgacctcaagtaatccactcgccttagcctcctaaagtgctaggattacaggtgtgagccattgcgcccggcctaagtcataaaagtttatgacttttagtataacaactttattgaaatataattcatataccataaattcacgcactgaaagggtacaatttagtggtttatagtgtattcacagagttgtgcaatcaacccagtttgcattatcctgaaaagaaattgatagcaatcactcctatttctactcaatccctctcagttcttctttctctataaatttccctattttggacgtttcctacaagtggaatcacacattttgatttgattcaatgtgattttttttttaatccctttgcagaatggggacttacagtggtgtttccttcccttctcttccagtaggcagctccttttcaaaaattgcgtttaaagtgggcttctatatactgagtcagcagtcttaaacttcttgccctactctgtggctgtcaggagcccagagtcagcctccttaaaatgacactggaggtctcaactagggaaatcctgggatgattaatggctttggccatgataaagggtgtggttataacagctgtgagcctggcagccactccttgggactggttagccagatgttttgcaagcagccttattttgcatctgtggaagtgctgaaacctttggtttcaaatcctcatgacgtgttcatctgtttgctcttgattttaggaaaagaattcattcctcaactacaacgtctcctgtatccttactatgcctcagtacatgagacagggctatggcaagatgcttattgatttcagtaagtgaaactgctaagtcattagttccacaaggcagggaccatgtgaatattgtttgtctttttgtcctgtggtctctgcaattcctggaatatagtgaaggtacatggatatttagtaaatgaatgaacaagtaggaaaaacctgaacattgtcattctgcctaatacacattgaacattgaaggagtacaggactcctccttaatgagtaggaggtacagaggatgataaagtaagctctttaggattatcccagtttgagacttttaaacagcacatacatgcatgaggcttaaaatctggtccttgatgctagggatttcacttttgtagggacttgtctagaggtaatccatgtacccaatggaccctgtgcataatatactctgccctcattaattgtggattctgtctttgtgaatttgcttactcactaaattttatttgtaaccccaaaatcaatcttaacatttttgtggtcattcgtgaacatgcacagagcagcaaaaagtaagagtcatggatgcacacattcccagctgacttcagagttttcagctcttacactgtaaacaagttcattttcagtctgggaatgccacatggttttcgccttctgttgattttaaatggcccctatgagtagtactgatgtgtctggtgttcctaatctcaggaatacctggggtaccttacaggggttaggtagctttcttcaggtgaattagagagttgctggcagtgagttcaatgttaatgatatcaacagtgtatattaaataaggcatttttaaacagaaacataaaataagtttatgtattgatggttgaccaatatgtgaccagaggcttgcaggaacctaaccctccctgtatttcccgtaggagtagtggttcaatattcactaattcaggttctcagtgactttataaaacataactgctgtgaataacaagactctactgtgtgttattctatatttgatgtccactgtcataggacagggtatattgtaatcaaaattggaattcctagaattagccttccaagccttctttctttctttctttcttttttgagacggaattttgctcttgttgcccaggctggagcacaatggcccaatgttggctcactgcaacctccgtctcccgggttcaggcaattctactgcctcagcctcacgagtagctgggattacaggcatgtgccaccacgcccagctaattttgtatttttttagtggagacggagtttctccatgttggtcaggctggtctcgaactcccgagctcaggtgatccgcccacctcagcctcccagagtgctggaattacaggcgtgagccaccttgcccggccaccttctttcatttttaagtcacctgagaagagatgaactgggaagtgacataagaggggaactatatatctttgaataggtaacactgttcttataaacttgattttatagaaatttttaagcattaacaaaagtataataaatgcttctatacccatcacccagcttcagtaattaccgttttttggggggctaatcttgttttacctacattttcacttgccattattttggtatctctaaaagataaggtctattacaccttaaaaaaaaaagtccttcatgtcataaattgtgatattcaaatttccctggtgtgattttgttcttttttttatttttatttttttaatactcagatccaggtagaattgatagtgggattgagaaatgtggctcataattcacttttagtctaaaactttccactcccatcatttttttcttgctgtgtttttgttgaagaaagcaggttagttgtctaaaagggttccccagattatgaactttgcacactgcatctccatagtgttgttttatatattttgtataaattgaatgttaggtgtttagactttacaactagaggcttcatcatttgggttttttacaccccgcactatctcataggtggtactgagctaatctgttcttaccattcaaagatttaaaaaatacttaaaaactaggtagtgaagtggcttcacatttttgtttctcatctcccttgtttccaacacacacctacagagattcattatcaaaataatggtgaaggcttccagagttcttttagtgcctattacagtagtgccctccttatctgccatttcactttctgcagtttcaattacctgtagtcaactgcggtccaaaaataggtgagtacagtacaataagatattttgagagacagacaaccttcacataacttttattacagtatattgttataattgttctgttttactattactctcttcctgttcttaatttataagttaaactgtagcatagatatgtgttgataggaaaatacatagtatatataggatttggtactacccacagttttgggcctccactgggagttttggaacacattccctgtgaataagaggggactcctgtgtcatgtaaatgcaaatacacattcttccccttttgtttatacaaaggcagtatactatagttaaccacacagtattccattgaatgactaaatcctaatggagtggactgtgcttcttaaaccttcttccatgttggcacacagttttttgctattaggataagatcgagtgttgctagaaaaagtctgtatttgttccctggcaggttatttgctttccaaagtcgaagaaaaagttggctccccagaacgtccactctcagatctggggcttataagctatcgcagttactggaaagaagtacttctccgctacctgcataattttcaaggcaaagagatttctatcaaaggttggtttttgactccttggaatggttgattgttacccaagaagttaactctactgggtattgtgtttcccctgaatgtgagaacggaaggcccactgaatatggaccactgcggagaccctcactaaagctgcctaggaatccaaagcatttggcccctgggaatggttattaattggcttctcaaatccagagttgccaacactttaattcttataaaagtcaagaagcaaaacttcagatcgtttggttcatctttctgagaaagacatccctgtgtatttatgcaagggtggaacaatttagtttgatctatatttgatcctgatttctaaggggccaagagtagcttcttgctgtaatatccttttgtggttatttggactggtcaaatgaatactttgtaaactccttctaaacagattgggttgagtacagaagattctgtccatttggatttcctttaagggaaagtagaccttggttgggggcaaaggggtgggaacctgcactttggccaggttgtcagtacttcttctgtttcagaaatcagtcaggagacggctgtgaatcctgtggacattgtcagcactctgcaagcccttcagatgctcaaatactggaagggaaaacacctagttttaaagagacaggtaaggttctcatcaggggcttgctcattgctggatgtccttcaagacttagcagagcaaagtatgggccttaagactggagaaccttcccttaaaggagttgggctacacgccccttttactgggtctcatttctgtagctggcagtgatgcctgtgttgccttatccttatcagaaggttttgataagctcctgtctcaaatttggatgacacaagttaagcagctccagttaagcagctttatgttgtacagcatttctgtcatttgatgtttttcttaggtgggaggaaattgcccatctgtagaggaatcttcacaaatgctgtctcaactcaaactcacatctaattttttaaattatttcatatatacaataaaggtcggtgagcgatgattttcatttctcactgagggtaaagtaggaagaatggattagataggaaagcagtttataagtcaaaatatagtattttttttgataccctaatatgttgttaaacctttggcaattccttcttggcggttagttattttggaatctatgtaaaggcacttgagttgaaagtatgtaatcctttttcccattgttctccctcaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaagtctgtttcatctgggggctctcatttatatatgaaaatgatgcacacgatctgctactaatagtaaatgcacttgggatttgctttccctagcagtaaactgttgagggatgtggtttgtggctatggaatgtttttccctgtgatacaggctgtctgtaaagatcaagggagtgctcactctgaacttctctagatggtggcacaaatttgatctgcctcactttggttccagctaatcagtatacgtagcaatgattagtcagtattacccattctttcactaagtgccattttccactgattttaggggcaaaggaaccaataggaaattaggatatatgggggtacagttgatgcctgtaggagatgggaacagacattccttctcatctccaagctcattcaccagtattgagcagtgtcacctctaattattgactctctcgcaggttgaaattattctttttgaaaatagctgcattttcatgtaagatatacccagcacaggaaaagggtggctgagcactaacctccgtatggtggaaaggaggaggctgggaattgtatgtgctggaatggtttcactcactgtgaccagtagtggtgagaacccatacagttgaagttttttgcacagtcctgatcccaggtctccactcgctttgccatcccactttactccctaaaaataaaaggatttattatctcatttaaacccccacaggtgtggaaacagagtttcacttgccttggcaactttgcatgagactatcccatttcattccgtttttttttttttgagtcagagtctggctctgttgcccaggttggagtgcagtggcgcagttttggctcacaacctctgcctcccgggttcaagtgattcttctgtctcagccttccgaatagctgggattacaggtgcctgtcaccatgcccagctaatttttgtatttttagtagagacagggtttcgtcatgttggtcaggctgatctcgaactcctgacctcaggtgatccgcccaccttggcctcccaaagtgctgggattacaggcgtgagccactgcacccgacctatttttttttttttttttttttttttttttaaaaaaagacagtctcactctatcatccagtccggaatgcagtggcatgatctcagctcactgcaatgtctgcctcctggattccagtgattctcctgcctcagcctctcaagtagctgggattacaggtgcaggccacctggctaatttttgtatgtttagtagagacagggttttgccatgttggccaggccagtctcaaactcttgacctcaagtgatcacccgcctcatcctcccaaagtgctgggattacagccgtgagcctctgcacccagcttttaactccctcttatctgcataacagaagcttagctgcttaagctcctttattagaagagcaaaagtctgaaattattcctgaaacctgctcaatggaagtacctactctattggttgcttcccatatggttgtcactgtaccttcatactgcctcatttgaccctcatattagccctgtacagtagatgggtacactggtttgccaaaggagacctggaatccaaggtggaagtaagcagcaaagccagaaacttcaattctggtctgtctaccttgatagcctgcaccctcccctctaccgttttcttccactatttttgattccttaatgatgaatcatcctctcccttctagttggatttgtttctaatggcttccattacaaggataataatgaaactggtgaaaactttcaggcaaaaggattttctttttatattttttcttattattttttaattattaaccaaattaactcattacagtaaaaaggactgatttttaagccagctgtgatagctctgtaatagtctgtaatctcagcactttgggaggccaaggcgggcagatcgcttgagtccaggaattcgagactagcctgggcagcatggtgaaaccccagctctacaaaaaatagaaaaatcagacgtgggcacatgcctgtagtctcagctacttgggaggctgaggcacgagaatcgcctgaacctgggaggcagaagttgcaatgagctgagatgatgccactgcactccagcctgggtgacagagtgagaccctgtctcaaaaacaaaaaacagaattgattgatgttagttggctttagaagcagcaagtttagggggctacagagctaaaccaggaagcaaaagatgtgcctcattctggcattgtttctgatttaggaataaactgttcagtaagcactgtccctttacttccatggttttcttcattcctcaccacagcacagtaaggtggatattatagtcttcttctagatgaaaaattgaggctcatagtggtcttgctgctgtgtcatagcaatagaatgagagagccttgcttccctgagtccaaatcccatacttttggcattgttatgaggtctggtcacctgatgcttccatgctattttcccatttcttatctggggataatgagtcatattaagtaatttttttttttgagacggagtttcgttctgtcacccaggctggagtgcagtggtgcgatcttggctcactgcaagctctgcctcccgggttcatgccattcttctgcttcagtctcccgagtagctgggactacaggtgcccaccaccacgcccagctaattttttgtatttttagtagaatgaggtttcaccgtgttagccaggatgatctcgatctcctgacctcgtgatccactcgcctcagcctcccaaagtgctgggattacaggcgtgagccattgcacccagccattttttttttttttaagacgacgtctcactctgtcacctatgctggagtgcagtggcgtgatctaggctcattgcaacctctgcctcccaggttcaagcgattttcctgcctcagcctcccaagtagctgggattacaggtgcccaccacctcgcctggctaatttttgtatttttagtagagatgaggttttgccctgttggctaggttggtcttgaactcctgacctcaggtgatccactcacctcagcctcccaaagtgctgggattacaggcaggagccactgcgcccagccaagtaacttttaacagtgtggtataacctttaaatgacaaggtgatgcttttgacttgtcctcaactttgatttgtactgatttgtccctatagttctgggtggggtgggtcaaaacaaagtctcgagctgtaccaggatcaagcagcacagctcagccatgatccttttaccacttttttcttctgtccttgagactctaattaaagcactggatttttaaaaatcacccttgtaaatatgcacacatttgtctatagttgaggaaattgtgccgttgaagtccattcttggacatggagttaagaaaccctggtttgagaaaaagccccagtgagacagcaggaatccttttaccatacaaccctcaactagtttagtgtgctcaagctcaaataaccaatcccatcaagtgaaaagaatggcagcagggagaaggcctggctcactgaggctctcagcattagtttcctctacctcttgtgtctcacaggtgcacatatgtacagcatatcaaagtgttgaatgtcatgagaataaaatatgaaaactactttgctgaatgatagtatgtgatgtgtgctaggacttctagaagccaccctttgctttgctgttcattgggatcatggaatcggacctcagctggttttgcctcagcactttctttcacaaaattatgtgtgactgcctcctccagactgtttcctgctgataggggcagtttaatagccttcttcctgtgtggtatctgcaacaaaatcccaatgaatgtcaccaagaaggaaacaaaggattgcccagcgatgagaaatgtccctggtgccaaaacatcagtttgcccctaacctcttgtgcaatacctttaagtccaggtcatgttgttaccatttgggggtttgcggatttgtttacttgtgcccaagaatggagaaaataacctgtactattgtacaactctggctccatggctcctcacaaatgttccatgtgagatataaacatctttatcctcgacaagtcatgttcattccaagaaaccagtctttgttcttaattggacatttgtttctgcaaacagcttaccatacattcaattccaaagttatcagaaacctacactcttatctcacaaatttagaggtgtggtagatcatctccaaagatggccaccaacagttgctctcatcctctgtgcacgtgctatttccaataaggtctatttttttctacagtgagggctgaacttgtgacttgttttgactaataggatatggaagtgatattttggcagcttccacttttgctcttgaaaataagctgacacgtttccaaacgagaagcttgggctaaattactgaatggtgagagacgatgcataggagaaccaaggtgctctagtcacagcactaaaagcccagacttgtgtctcttgaaggtttcaaccccgccagactcccagctgaacgcaccctcatgagtggcccttgctggtaccacatgacactaaagacatctagctgagtcctgttaacccagagaattatgagaatactgttttaaccacacgttttggaatggtttgatacatggcaatggagaagtgaaacaaggggacttcggaaactaaagggctggaattcagtttgccttgtaggttgattggaagccagatgtgcctagaggaaggctaccaccttgtgcaattccaggggacactgtttatgttccgtgtaaatggcagcctcagttcacctcatttggttatttatcgtgtcttcgctgtcagtcaaattgcttctgagataactggctggccttggaattcttagccacctccttaagcggatcaggaaaactgaagaatatccttctgtatgtatgtatgtatttattgattgatcgatttatgagacagggtctccttctgtcacccaggctggagtgcagtggtacgatcacggctcactgctgcgtcgccttcccaggctccagctatcctcccacctcaacctccagagtagttgagaccacaggcgtgcactaccacgcccggctacctttttgtattttcagtagagacgaggtttcgccgtgttgcccaggctggttcaagcggagctcaagcaatcagcctgcctcggcctcccaaagtgttgggattacaggcatgagccgctgcgcccaaccttcttctgctgtcgagatactgctcatcacctgcctgctccagaattcatgtggcttctcattgctcaatggattaagttcatgtttatcctggctttcaagtctttccgtaagctgactcaacctacatagctttcatcattcccttacacataacctcaacgtgcaacaggattagtctattattccctttcttgtgtttactgagaaagcctccacttcaacgttccatgaagtgtgttccattaaataccaaagtataggcaaaaagttctgtggtcaaataaatttggaaaacacagagtgtttccaaagttagtatcaggccaggcatggtgggaggatcacttgagcccaggagttcgagaccagcctgggcaacatagggagacccaatccctacaaaaaaattagttgggcatggtggtgtgcacccgtagtgccagctactcaggaggctgaggtaggaggatcacctgagcccaggaagtcaaggctgtggtcagctgagatcccaccagtgtgctccagcctgggtgacagagcaagaccctgtctcaaaaaataaaaaaataaagataataccagtatgtttcttgacttgaagatttcccaaaaccttcagtaggctaatgggtgttggagttttccaagaagacacaggatgtaacatttcctaaaatgatttgatctggaaggagcctcttggactggtgtcctgggtagggcttttggaaatgtttctttcccacccgaataggcccctaattctgcttgagacttgtctgaactatcatggcatagaccaagtgtggggcttgatgtatgtgaagtcaagccaccgtagcctaaatcctggctgtcatttcctttgtaacttcaagcaaatggcttatccacattggcagaatggggataaaattgtggaaaattctcttgcagtgcttgccatgtattcattcatgtagtcagtaaacaagttctgctgtgtccaccatctaaggtgggaattagttgagtctggggaaccagtggtaagccctgtctaaaaaagggcctttatcatgggagctgaaagatgagttagcaggatgggggcaatatggagtagagggactggggcagtgtccagatcccagagcaggccagcatttggtgtgtgtgtctgagagagcctggtggcgagtgtgacaacacagaggagagggattagagagcacggggccctggaggtttctgcaagaatgtcaagtgtatgctaggacaccgttggactgtggccgacaaggaatggacgcgatcctatttcccattttaaaatgtcactctctggtggacaaacgctgggggtggctggctggcaggagggtggaaagcaaggaggtctgccaggaggctactgccctccaagacaagggaggagggtggctgctaccaacagtgacaagatggcaagtagtaggtggactcaagatggattgtggaaggttcatcagctaggggataatgagttaggtgtgaggaattgaggggaactcccaggtttgtagctgggtgtgtggaggtgccgtttgtagagatgcggaagatggtgaggagtagttttggggcagtggatcaacagttcagtgtatggacaggttgagtgagaactttgggacgtgttcagtaagtagcagctgctactatttatttcagttacttgtattaagtttggctctctaacgagactccttgaggacaggaaatgtgagtccgtcacaatgctctccagggacctctcatgtgccaagcactattgttggcgctgagggcacaaatataataagatgtggtctgtgttattccgaaaccctgttttgcaggggaggtaaatcattaattataacatcaacattgtaacatacaggaagtgctgaatgaaagaacttgtaaggcatttcgggaatgccaaggagggaatggacgagtgtttcctgggctggaaaacctttacagagaaatggatcttggcaaagaattcactcaccaggatggaaagaatggcatgtgcagaagccagaagcaggagtgaacgtggtgagcttgagaaagataggactggggagcagaaggcggaatttgcgtccgttagtacatcttggctctcctataatactgtgaggtcttcaagggcaaattccaatctcacacttcattcatatccccagtcccatcggagttcctagtgaaatgctggcacatagatgaaactgtttggtgagttcacttttttcctaaatgtccccgacttcaaacacaagaatgaggtcttcagccctctttgctggtgctttgagttgggttattgcagtgaaccacctcttggcacctcgccggtggctgggtggggtggggcaggcaccggggatgcctggtgggttaggaggttaggagtgggtgagatgggaagtacattaactggaaaattctgcagcagtgtcagagttccaaggaggaggcttgcactggcccccactcccatattcattgctggacatgatggtaaggtgtgaagatggagaaaacggggccctggggtttattagggtctcacagtgaatagtcagtcttgggagagagactacctcactacaggttaagtgcaaggactcttcctgcctatgctggtgccatttggcctcctccttgcagccacctttgttgtctctaaagccttttctggcacccacaggagggtcctgccctctgtaccagcacgcctgcttccccctccaggctggagtgcagtggtgcgatcttggcttacaacacccacctcccgggttcaagcgattcttctgcctcagcctcccaagtagctgggactacaggtgcacgccaccatgcccagctaatttttatatacttagtagtgatggggtttcactatgttggccagacaggtctcgaactcctgacctcgtgatctgcctgcctcagcctcccaaagtgctgggattacaggcatgagccaccgtgccccgcccccttccttttaaacatagcccagctcccagctccctccacctgcctgcaaagaatcaaacacccagaaaaactcctaacctgttttcttttttttttagagagagggacacagaagctaaatgctttgtagcctagtggattaatgagcctcctttactgctggacccacacacaattcccagtgcattccttggttcagcacctccacatttaggacctaggtttgcctccaggatttcatgctggctcatgtgctgctttctaaggggtcctctgtgtcccacctgcctataaactgctagtgcagggacagttgcctcctcagtctggggctccctgaggttgggagctgttttgctcttctaaggtgctcaagaatggggctgtgtcttaatcacaaggcagttagttgaagggtcaccttatacaagacaactgaataacctgggaccctgttctctgagtcaggagacacatggatttgagcccttgagatcatgtctgtgagtagggagagggtgtcttctttcaggctggggcttcagaggaccctaaagggaagaaagaccccttgttttcaaatcccttcccttccaaaatgcctgcaataccttcccatcccgtcgtgggctctttcctgtttctgtcattcttacctgtgtcccaagcctgttttcccacctgggggtaggaccagggctgttcagtatttctctgcgattctgcaaaagggctcttggcctgttgacataccagtgaggccactgaacagactacagagcccaggccattcctgccctctgctgtgcaccagagaaggagccattcactggtcactcatttattgagtgcctactgtgtgctaggcacaggatacagagtgtgcgagtctcctcactgctgtgcagtgagatgccaactctgagtgtgagggagggcagagtcagtgcagcttgctacggcgaagctgtgcatttatgcaggactgctgcttgacactgagagtccaggaagaagcccagtgggttcagtgtgggccttgtgtgaagtgccagcgatgaggacaggagacacagagaagagagttggcctgccggcttgtcagctgtgacatccaggtaggaagaagcggcaccgtgtcctctgggaagtctgtggtgggggcttttactctgaaccttgggcctcatcctctctgcctggggagagtttggtatatgaaccatggttagtcgggggtcttgtctggctcctccacccttagaagtcttccctagttgcattgaaggccttcatcttcctaacccctctctcctttctggagatatctagggcaatgggattacaggctcatctgtcatatcttccattattcaattgctaatgtctccagagcatggatggagcccaccctcagttaccctctttaaaggtggggaaggctatccaagagtcctgggaacatggcgggtgacatggactaggaagcaggagacacagtttagtcctggctctgttatcggctcactgtgtgactttgggccagtagctttccatctctgaaaaatgatgactgactcctagtattcctgcccacaccatgcatggaggaacattcatct

SEQ ID NO: 1901 - DNA, 2617 bp, Homo sapiens
atctctttcctggaaaggattcttgtagtgactgccatggaacacagacagacctatgggaacacacgggaacctcttttagaaaacctgacaagcgagtatgacttggatcttttccgaagagcacaagcccgggcttcagaggatttggagaagttaaggctgcaaggccaaatcacagagggaagcaacatgattaaaacaattgcttttggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatggcaagaaaaacaagatctactgccaaaacctgtgcctgttggccaaactttttctggaccacaagacattatattatgatgtggagcccttcctgttctatgttatgacagaggcggacaacactggctgtcacctgattggatatttttctaaggaaaagaattcattcctcaactacaacgtctcctgtatccttactatgcctcagtacatgagacagggctatggcaagatgcttattgatttcagttatttgctttccaaagtcgaagaaaaagttggctccccagaacgtccactctcagatctggggcttataagctatcgcagttactggaaagaagtacttctccgctacctgcataattttcaaggcaaagagatttctatcaaagaaatcagtcaggagacggctgtgaatcctgtggacattgtcagcactctgcaagcccttcagatgctcaaatactggaagggaaaacacctagttttaaagagacaggacctgattgatgagtggatagccaaagaggccaaaaggtccaactccaataaaaccatggatcccagctgcttaaaatggacccctcccaagggcacttaaagtgacctgtcattccgagccagcgaaccccagcagtaggaatccgtaccctagggatctgtctgtcatttctctgttgctcttgtgattggcaagtacagtatcctttgggaaggccatccccctcaggactgtcctggctccgacctttgtgtacactgcagacgctggttctgaggaactgttgtttcggcctcagtgaggttgcctggatgggatctgtattagacttgagtgcaggtctctcagcactgacccaaggagttctgttatggtactgtacctgtccagtcactggttctctcctcatgtcctctcgccccatgaggttgtgttgtgtcttctaagcgtggtactagtgcttgccacctggtcaccagacctccaaatatggctgccaccaccaggacctttccagttactccttatatgtgtgttctatggaggggcagggaaaaggtggcacttgtgagtgtgtgtggattggcagggggtccattcactttgggttccatcttgctttaaatttcttcattttgattaagagacctctttttgatctgtattgggctaaccagagccaaatacttttgaagagtttcccagggactagtcatggtaatagcatataattgatctgaatgagatggagagaagaatgaaggggtggtggttctgggtttgatttgagttcacctgtgggcagtgggcagtgggcagtgtcttggtgaaagggaacggatactactttttgcctcaccgtaaagtactcactagtaaatatttccttctctctttactcccactttttacgtttgcaggtgccaaagtaatgtccacttttccctttcatgctgcatattaactggttaattatactgcagaaaccttttcacctccactagtctgatacagtacatctgtacttccatataccttgcactgattttgtctgagtgccctgggagaagtagaaaatgattgaaagtgacttccgtatctcagcccatgactcagcaaggcagaatggccacccctgccaaagtttgcttctcttttcaacagtgcctcaccctccctctaggattaaagtgcttctgcccttccacgaactcctcctccatttcctttttgggatttgtcaccatccttctattctctggtcttctatttttggtgttgttcaagtgaaggaagagatgttccctctaatttctctctagcccattataacctgctatcttggggcaacttttgatgtatgacatgtcacccttcccaacttggtctcctccaacatgctgtcttcatgtggagccctcaccacaatccctgactccggtcatttgtgcctttctcttgtcatctctgtacactacttatattcactgtgggttgggggagctaattttaagcatgttcagtggcagctcccctccagtttcagtgtcactgttaaaatttatcaaaaagcaacttcactaggggttttcttaagggataaaggccttttacagaagctaaacccttccccacatgtggtagaatgtgctcttctatatctactcctcaataaagcatgttctctgctcaa

SEQ ID NO: 1902 - protein, 340 aa, Homo sapiens
ISFLERILVVTAMEHRQTYGNTREPLLENLTSEYDLDLFRRAQARASEDLEKLRLQGQITEGSNMIKTIAFGRYELDTWYHSPYPEEYARLGRLYMCEFCLKYMKSQTILRRHMAKCVWKHPPGDEIYRKGSISVFEVDGKKNKIYCQNLCLLAKLFLDHKTLYYDVEPFLFYVMTEADNTGCHLIGYFSKEKNSFLNYNVSCILTMPQYMRQGYGKMLIDFSYLLSKVEEKVGSPERPLSDLGLISYRSYWKEVLLRYLHNFQGKEISIKEISQETAVNPVDIVSTLQALQMLKYWKGKHLVLKRQDLIDEWIAKEAKRSNSNKTMDPSCLKWTPPKGT

SEQ ID NO: 1903 - DNA, 42772 bp, Mus musculus
  misc_feature (1)...(42772): n = A,T,C or G
ctgtggtgcacactcatggggtaaggactgtaatcaacccatgaccctgaaaggcagctctaacctgtagattgggacataaagtacacagccagggccacatcccatgttaaggcttctatttcaattatttttctctggaacttaactttttttttttttagaaaatactaaacagaaaaaaaaacatgaaactgtactgcatactatattattcattcacatactgttgagtttaggggactagaatgggctggaaagacagaatctgctatgcgccagggaggttccctgtagggaaagagaaggtgtcagtcctgaatttgtttgctctgggacctggtccccactcagcccatgcttggctcagacctggtctcaggcccctgttttgacaagattcctttctaaacagcttcctacagtgttcctaacaagagtgacatttgcagatgcttatagagaattgagaaagcaaaccccaggattcctccatccctattttgggcctcagtttaaaccctcgccccaaccaacccttccctcctccaagtccctccttcaagctaaccctgctccagattctgactacctaatcaccctgtcattatcttctaggctcctttagcccctccccccagagttttcaaccctctctgtcttcagagtagtctctcatttcctattggatcctgatgcaatggagaaataagtgtttataaaacaaaatcctttctagtttttagtttgcctgaaggtgaactctcagaagactggtgtgaaaccatacatattagggcagtgagaagagatgcccccacccacaccaacaacaatgctaatgaactggaaaggaaaccagtactcatgcctagaggcccaggttctgtgccagggggtaaaatggacccaaggtgaagggctcagaaactctgagagggaggcaaaggaacgggctgatgtctgatgcaggaagaaaatatttaggcatgaagaggcaaggatggaacttgctgtactgttgagacctggagccggtggttggcaaagaaactcaaaaggcaggaaagagttggaaaagccttgctggggaaaagaggctaacagcaagagtcagaggtattgtccacagagtcacaaagcacagatgctttccaggcctgggagagccatgtgtgcagattaggctacaagtagaatcaagagatgaaaagcaggctgagggataatgatggaagctgggaaagagcaaggctctgtgggatctcaccaatggtctttttatcttcagattcctgtgaactccaagtccaactgaataacagagatgctaccccagagtcttgcagcctattgcctcagaatgaagaaagtaattattgcttaccttcctgactttgctttttcagatgttgttttgtttgtttgtttaaaaaatcttaatcgttttcaaattttgactattgaaaaagtattatgcgtatttggggttggcagtatagctcagtagtggaatgtttgtctagcatgggtgagggccttggttcattcccagcatctctctctctctcgctctctctctctctctctctctctctttcatacacacacacacacacacacacacacacacacacacacacacacacacacatacacacaatctcagaggccgtgtgatattttaaatagtcactgtggaatggctacatcaaggtatgagtattaccccccccctttttttttgtagtaagaacacttaaaatgcattacctcagaaatttcttgagaacacagtatatttttatcatgttgtacaatggaccattttaaagttattcttcttgactgaatttcccctcctcacctccactctaccctctctgagtcggatccttcacatgccacctaagtgaaatcatgcagcttttctgtgcctggcttgctccgtgtaatgttcttcttcatctgagttgtctcagttgacggcgtctcctttgttttaaggctacctggaagtcgatcctgtgtggatactgcatttttctccagctgctggaagttgtttaggctgattccagatgtggagcttgtcaagctgtgacttgacccctttagcagactgattttaactctctgggttatgttcacagtagaggattgtcaaatcacatggtgttctattttcagggtttttttttttttgaggaaattttgtactgttttttcttcatgtcagactcttcacctccttagtcttacgctcaaagtaccattgctgtctcacactggttctggtcctgaaataaactgacatttaaaacagtgggggccagtaaagtggctctcaattctggtgacctgagttcaagttccaggccacacctggtagaaaagagagaagttattcccacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttgccttctgctcaataatataacaaatgcccccccccccaacacacacacaacttagtggcttaaagcttcttccatcttatttggcatctgcatctccagcctgccgctgtgtgtacgttcccgtccccagcatcccatatatgaccctcatcaaactcacttaaactagaggaacacgattccctttggctctgactcttccatgttgttcccttcagatttcttgtcttctgccaaagaaggatcttccaaaaatgagctgggctaaagagacagctcaatgattataaaggctggagctcttacagagaacccaggttcggctccacaaccatctctaaggccagttctagggcatcctacacccttttctgacttcctgggacactgcatgtataaactaacatggggggggcggggggaacacccacttacataaagtaaaaataaaataaaataaatgcaaaccagttcatgcggcttttaaagcccaatgctttctgtagctctcatcatttgtctgcattatcagacagtgaggggtgcaatgagggttggtggccatgctcatatccctgtcacttgcttcttttcctaacagcttgccccacgtgcctattgtcttcagattcttgcatttgctatgttcctgtctcttcagcttctgcagcttctgggcatgatgtgatttggggaggcagttggatgtaatctcttaagtttgaaaacatacatatcacagagctcagtgattacgttcctcagcagagaagaggagaaatatgtgctaatcactaagacggcatgggaaaggctgggagtaagattcacacctcagccctagcactaaggagaaaggaggatggaagaggagggatcaggagttctaggtcatcctgatctaggttatcattggcctgggctacataaagccttgtctcaaaacaaatgattcaacacatacacatatacacacgaaaggacgttcctagtagtattattcttaaaaactaaataattgaaacaaagaaagtcagcatatttctataacatcaaaaataataatacagaagactctcaaaaacatattaatatatatatagtacttatatgtacatgtatagatctgggtgtgtttggtttctttaaggatagagaactaaaaagatggttatgatttcatttatattgatcacataagtagcaagattaatctaggtcttaaaactggagatagtggttggctatgagaaagaccatggggacagtagaatgtgtcacctggaggcctctggagtgctggtcatctgctttttaattcaggtgatagtttcactttataatcatctacctccaatttttatatataaatgttatactgaagttagaatttttaattttatcttcatttatttttttgaaacagggtcttgctttgtagcccaggctatctgtgaacttatgtcccaccatcttagccttccccaactgggattgcaggtgtgtctcaccatgcctggttaatttttatctttaaaatatcaaaatcaattctctatccaaggattctaggaatggctagaaaggaagattaagagcagagagggcaggaaatttcaggaagagggatcattcatggtattcaaaatgctcttctagagagttaaatgaaaatactttgtgtatatctgtatgtgtttgtgtgtgtgcacatttgtgtacttgtctgtatgtatatgtgtgcgtgtgtgtgcaggggccagaggtcagtctctggttatgttgtcctttgcagctattgtccaccttttttttgaaccaaggtctttcattggcctggagcttactaattaggctagggtggttggtggttggtgattggctggccagtgatgccacagcatccacctgtctatatctgctgagtgctgggagtgcaaatggctgccacttatgcgtctttttatgtggatcctgggtctcaaactcgggtccttgtgcttaaacaccaagcctttacaaactgggttgtctcctcagtccttgaaaataatttattaattgtaatttggccaggagctgtgcaactcaactatgaactccagattaatccctgttttgtgcaactggtagatgtaaagaaggaaaattcatcattttccttggctggtaaccaacaaacccgagcaaggaccaaccaaaatgaggactctgagataataggtaaggataacggaaagaattgaaacagtatccaggcaaggggattacatatgttatcagggaccttgaggtagcccacatagtcaggaggaggcaggaagggaaagaggcccaccaagccaaccttcagactagcagaagaaagtaggggaaattaaaggcagaaatgagaaatggaggttaataaatgttgaggtcagaggacttttttttctgaagagggaggaggaagaggaggaagaggaggaagaggaggagaaggagaaggagaaggagaaggagaaggagaaggagaagaagaagaagaagaagaagaagaagaagaagaagaagaagaagaagaagaagaagaagaagaagaagaagaagaaagagagagagagagagagagagagagagagagagagagagagagagagagagagaagtggcaaatggggattggtatagggggaatagaatttaaggaaaagagagagaaaatatatcagggaatcaaaatacacatgagaagaagtagatagggaaacatacccaagacagacatgaagctgtccgtcactggatccagatgaagaacaggagtgatggacagagccatgaagaaaactaaggagcaaaatgggaatgaaagaaagaggcaggcagggaagtgtcttagtcagggtttctatccctgtacaaaacatcatgatcaagaagcaagttggggagcaaagggtttattcagcttacactttccacactgctggtcatcaccaaaggaagtcaggactggaactaagcaggtcagaaagcaggagctgacgcagaggccatggagggatgttacttactggcttgcttcccctggcttgctcagcttgctttcttatagaacccaggactaccagcccagggatggcaatacccacaatgggccctcgcccccttgagaaaatgcctaacagctggatctcatggaggcacttcctcaactgaagctcctttctctgtgataactccagcctgtgtcaagttgacacacaaaaccagtcagtacacccacctatcccattcaatatcccatcctccacccccaacacacgttaatgcttgggaagtgccttaccaccctgaacgtgcctgatctcatctgatcatggaagctaaggagagttgggtgtggttagtacttggatgggagaccacctgggattatcaggtgctgtaggcttagtttgtcttggctgggagggagcacctctgtgcagaggagatgcatgccagtgactgagaaggagcatctctgtgccagtggtgggctcacagccttgagttaactgtttgggccttcctagtcctcacactcaggtgtgccctgctgtgtgggtctgctatcacccctaagatgcttaagagactttcctttgtgcagaactcagcagtggggattctgataatggagagaacttctcagaagctacaaccacagtcccctcccagccaggtaaggagacccaggtaacaaggcaagctgtggatatttgagtcacaagctactgtgttatgatggggtttgtcccaagtctgttctgtatgctggatctctaggacctgttctgtgcattgatttttatttgattcttttgggaaatgcagggaaatcattacatactatttgggggattaggcttatcaatcaatggatcttcttagtagatatagttatccattgatgtcgtgatagaaacagtcatgtgtgtgtgtgtctgtgtgtgggtgtgtgcgtgcccacgtgtgtgtgcccatgcatgtgttcacagaggtcatgagacatgcccaggtgtttgtccttcccatccacttctaacctcctgtttgttgttgcatatgccaggctagctggaccccaagcttccagggattctatctctgcctcctgccctgttacctgaaccttaggatcacagacctattctacagtgtctgacttcacctcatggcttctgggtatctaaaaccaggtcctcatgcttgtggaacaagcactttgcctactgagccatccctccagcctcatgagtttgtctgtttaaatgattatcgagtttattaaatgttagactcatccaggatttctatagaaagcagaaagcttactattcctttgttagaaagtcataatgttgggctggtgagatgggctcagtggggtaagagcacccgactgctcttctgaaggtcaggagttcaaatcccagcaaccacatggtggctcacaaccatccgtaacgagatctgactccctcttctggagtgtctgaggacagctaaagtgtacttacatataataaataaataaatctttaaaaaaaaaaaaaaaaagaaagtcataatgtcattttttcagaaacttagactagagtccaaggaaaactcatcaagctatcttgtgtaagcagaattgaaacttgagataaaacattctaagacccaaagaattatttctgacaaaatttttcaggtcatggcttacagaggaattcccccaaatactttacaactaatgtgcgcttctttacgacatccttaaagaacaactagaacagatatcaacatcctttttcctagcttgaaaaaagcaaccatagatggcatgtacctgcgtcttctccaaagtcaaatggataactagaccgggtttctgaattctaggttattccttttataaactgtgagatagaaaggttttcaggtgtgatatcatgagcctgtaatcccagcactcagtgggcagggctcaaggttatccttgactgcacctgactttttctcaaaacaaacagaaatacacgactgtgcacgtgtgtgtgtgtgtgtgtttgtgtttgtgagaatcaaacggttgaattatctcagccctatctattttgttggaaaacttaagattctatagtgtgtcctcagtgattcattttccctttctaatttaaatctgattagatccagaagattttagaaatgtgcttcctcggggaaaatacactagggaaagacctgagatcaaatgaaaatgcttcttggtcttaacagtaacaaaagatcaaactcttaagtgatgccttcattccagctgccagagtgtcttctaaaggaagcagaaatgtttcaggttttagaccactcacatactcttttagtgtaagcaaacctccccacctactaagctctcaaatgtgtttatggtttcaatgcaaagattatttttcatagacatgtgggaggtatcagatcaatgggggatgttcaacataagatttttcaaggcctctctgtgtgtgcacatatgtgtgtgtacattcatgtgtatgtgtgcatgtctttgtgcatgtgtatgcacattcatgttcatgtgtgaatatagaagtcagaggtcaacatcaggtattgctcctaaatagacaaccatcctgttttttggagagagagcctctcacttggggactagaactcacctattaggcttctctggctaaccacagagcctcagagagccaccctcccccatctctctctagctctggtatgacaatcatgaaccaccatgctcagctccttacttgggttatagggttccaagccaggtcctcacgcttgtgtgccaagaactttatcaactgaactatctactcaggctcttccacataagactttcaagatttccctacaaaggacacagaggcaaggatggtggggattcagaaagatgaacaggaggggtaagaagtcaacgttttaggaagaaaagggctaggtgatgtcagatggccccttgccagcaaattgcatctgccttggggatcaaaatggagtctcaccatcctactgggctggggatttaggaaggcaaacccatgtggtctggatggaggtcaggctttctaagggaatgtcagcctgcttccaatttttcttattagtgaattttctcctgtactgttttttttgctcacaaccagagggttccaaagaattctttttgtacagtgaccaatatcaatgacttattgagaaaccacatgctcatggcacgggattgtaccagttaagatgatcagaatgcagcttctagactatgaggtatccaaattgcactgaatgtcttgaattataatcgaagcattctctacaagccttgatttagcaaccccagggtaccaccttctacatgtttcttctctggtctggctgggaaatcaaaagctaccacagaatagtttattatctggacaagcccaactgatagataaaataaaatatagcaaaacaatgctagtagaaggacactctctttactccacgagatcatgtctactgatactaacaaggtgaaatcatgcattgagtttctgctgtggcatagtaagcatagaatccctatgttgatcggtgatcctgatatcagtcagtagcttagaaggtctttaaaaacaagttatgctatttctatagtgagcagattaaaattggcctaagggctggagagatgcctcagcaatcaaaacctcttgctgccctttcaaaggacccaggtttggttaccagcacccatatcacgtgactcataaccagttcatctctccagggcagagacctccttttgatctccaagggcatggaacatgcatgcaacccacatacacacagacagacattcatacctataaattaaaaaataaataaatatttttaaaagcaacgacagatatccctgtctaaattatagttaagatgttggcatatgttaagttttttaaattgggttttaatgaacaaagcagcatctagccatcatagagtcttaacagggaggcaagataactaggctattgctcatttatagatgagaaaactcgagctactcatgctcaagagtcgtgtcagatgctcacacagaaacaaagagcagatggacggtggtgaccatgtctttaattctaggacttaggccttgggaggcagaggcaggtggatctctgtgagttcaaagccagcctggtctacagagggagttccaggacagccagggatgagagaaaccctgtctaaataaaacaacaacgacaacaaaaagaattacacagcattctactgtgggtcccagttttatggcaaagggcctctagattcagtgaagaggacattctgtcagtctgcctaggactgcaggctcatctgatctaaagccacagagcttgatgctgagagcacataatagcttttctcccttttatcttacagcacctgcatattccagaaaacctccaacactgagaagagacagaggaggaggtaagagaaaataagggctcttcaggagagcgaatgaactgtgtattcaacaagagactctaattctaggctctattcttcaaagtacaacataaatttgcctttaattttaggtaattcctaccctaacttttatgtcaatcaggcaggctaggttctttaacagatgagtccaaaatgttaatgatttcatatagtaaaagccttttaatatttaattggagttccattttttttccctcaataaacatcctacagatttttagatgaagagtcacctggtctctagtcccagtggtcatcagggaaacagtcaggtagaagagtctcatctttgcctcatactccctcccataatgacccggaaggaaaagtgctgctgtcaaaacctattgaccagaatttaaaatgtacagaagaccccaaaaggaacagagggccagtcccagcagagatggccctggggtgaaagtttctcagcttcaggcttaggtggtgaggataaaatcttaacttagaggtcacacagacttgaaaggacaaacatggttccaagggcagagaccttcctaccctggcattccagagctttgcaacttttttcctactttcttccttctaggattttcttttttcctttattccacatcttacactgagactctctctcggtgacatttctgcagtgagagggtactaggatagcacaccttctctatctctgtctgtttctgtctctctgtttctttgtctctgtgtatatgcacacacacatgtgtatagaaaagaggatgtcattttttgggcgccattcctcagtggttatctatgaaacagatacgttcactggcctggagcccaccaagtatgctgggctggttggccagtgagccccaaggacttgtgtgtctctacgtctttagtactggggttatgagcatcatgtgcggctttaaaaaaaccaaaaataccccatgtgttctgaatcaaactcgggtccccatgctcgccaaccactacatttcaccgagtccgaatccataaaacaatgctttcagaagcctggagctcagtactgagctgcggaactggggtgaaaagcaaaggccgacttgtcttcactccagttcagtatctaatctcagaacttctgctctctgacgtgctttattgtgaccacacggcacagcataccatacgccacctgggagaccatctggaggttttgaaaaaccaaaagaaatctatcaggtcttgaacaaacctggaacaagtctcacttagcccctgtggctcctcccagcacttctcacccctgtccctacttctaacacccctccccccacccctcacccgcaacccaccttccacccctccaccccccatttcctgcttctgatcccatttaacctcagccattttgaacaaaagctctcttgccctcttggccttgcctttcctggcagctcagctcctggatatttcttggtgcacttgccccacctctctgttctctggctcctgctcccacctcctctcaggaccctttcagcctgctggccattttccatctacagtcttccaaatgcccctgacaatgctctccctacatggtctgcaaggatcccgcttaaccacaccgagaagcagccatgtcctatttttttttccattcaaaattattatgaattggggcttggtggaataattgtagttgaaaggcagtgttctttttattatatttgttacattttacatttgtattattacatctatgccagacccatcagtccctacatattgaattcgtgggatgatttgcagagaggattaaaggactcaggatctccatcctgacagaaaagatcatgaaagcatctttatagtccatacactctctactatttaggtagtcagagaattcctatgaccattttagttctagattactggttttattttcccttttcgtcccagatacttctgacactgagagctctatcatcattagaagacggaaaaggacaggacgtaagaacaatttaaaattctagatgtagcaattacttctctgtgttactaaagctctaaatcactctgatttttagataccctttaaaaaaattaacctggtattttagatcattttgatgatgctttttgggttcaagtgagtttaagatatttgctatgacacatctcaaaatattcaacagcacaagcccagtacaggctcattttttaccccagagaagaggatgaagttggtcctaagtgaagaagttcactttgttccacatgatcgtctagggccctgaggtcttaaagatttactttgtcattcaccatgcccaccactccacaataaacagaaatgggagcagatggtgcacaaataaatctctgaaggggcatgaggcacgagaaacagacacagaagagaatgaccaccatagagttgtctccacccccagcactggggacagcttttggagcaagcttgaccagcagctctgatggaagcaaggttggcctgctgactggattgtctctgtgcctcccaaatagactgcaggtctgtcctgccttctcacataggctgcaggattgctgacccctaccacataaactggcaggattgtgccttcctacacactcatacagatcgctctgtgcatgcgtgcgtgcgtgcgtgcgtgctcctgcacatgtgagtagaggccagaggttgatgttaccatcttaaatctttctacctcactttttgagacaagagtggtctcgttgaccctggaactcactcactgattcagaaagggtggttggtgagcaggcttcgggtgtcctcctgcctctgtctcctcagctctgggattataagtacccacttctgcacccaggttttttttattagatattttcttcatttgcatttcaaatgatgaacctagttttttacatgagtattgggggtcaggctcgaggaactttacagatggagccatttctccagccctcttttccagtttttctcagagagaatctcttcctgggttggttcctagggcgcagactagacctgttcaggacttttgtttcttcctgcaggagtattatatagttcctcttctgaactcagttctgaagaggaatctcaggattcctaagaagtggatcaggaggattaggacgctcagccttggcccacaggatgtcaggaatttgatgaccaaaagcaagcctccgtgactagatgcattttgtgctaaacacgatgactgctgtgtgcatcctgttatccagggcgcttcttttcaatcttagaaagtggaggaggcaggaagtgactatgaacatttgtttaacaggttgaatcctatcaattaaatgtatgtgcttatgtactgctgatatggaagaaataaatagcagaataatagttatttttttgccgggcacgcctttaatcccagcacttgggaggcagaggcaggcaaatttctgagttcgaggcctgcctggcctacaaagtgagttccaggacagccagggctatacagagaaaccctgtcttgaaaaaaaacaaaacaaaacaaaaacaaaaacaaaaccaacaaaaaatagttttatgtatatatatatatatatacacacacacacacacacacacactcactgccatgcctactgtggtggtttgtagaggaatgacgccccacaggctcatatttgaatgcttggtcattggctacttgtgaaggattaggaggtgtggcattatcaaaatgggtgtggtttgaggaagtatgtcactaggggtgggctttgagatttcaaatgttcaagccaggcccaggctgtctccctgttgcctgctgatctagatatagaatactcaaatacctctccagcaccctatctgcttgcatgctgccatgttttctgccatgatggtaatagactaaacctctgaaactgtaagccagccctaattaaatatttttcattataaaaggttctgtggtcatggtgtctcttcacagcaatagaacattggctaagatacctcctaacacagagatcctgtattcatagggtcatttgtaattgtaaaagactcaaaatacaactagccaagtgttgaggtttggtcttttgctaactattacaatgctgtgtgggcccccaaaacctggagtctgcacataggccctgtgatcccaagttatttctgcttggtaaataaagatgccaacagccaatagctgggcagaagagatgtggatggggtttaggtttcttgggcttgggctcagagagaaaacacaaagggagaagaagaaagtgcaagaggaagaagcagaagcagacatgggttaggagtaaagaaaatgtggctctgtgggctggcctattggaattaagaacagcccagatgaaacatagtagtaattcaaggttattgataggaaatagattctaacaatatagagtatagtatctgcctgcacttgtgttgtccaaggcttattgtaaatataaaggttgtgtgtgtgtttcatctgggaacggaaatagccatggtcgggctatttaaataaattttacaacagccaagtgctgtaattatagacacaaaaatttcagactgaccattgtcaaatttagcatagttcttgatagatgcccttcaccacctagttagcttatgttatctcaacatacttttggcaagatcataacagccttgagatttaggaggccaactcttgctatccacattttgagtagaggaaagaaatgtacaaatgtgtaagagttaacaaataaggaaggctgagatctatcaacccatgtgtctcacatttagtgactattgtatgtaatgagagaaagaaagcttgtttccatggtcagaatccaaaagggtggttgggaacccagaatattcagttaaatgtatcagaaccttatataaccaagaaagcatatttaataataattcaaaagcatgtaagggtaaagcgagatggctcagtggattaaagtgcttgctactcaagtgtgatcacactagtgttcaatataaaaacaaggaaggcaggacatcctacttcccactgtacaggaggcagagatggaatcccttagacaagatggctagctagactagccaaatctggcaagctcatgggttcattgagagacacggccttaataaatagaggggagaatggtggaagaggccaatataaatttctgcctccttgtgcatgtacacatacatgtacaccacacatacatgtagattatatgtgtatacacacacacacacagggggtctggggacaaaactcagttaataaagtgtctgcaaggacctgcatttgatccccaaaatcttgtttgttttttaaaagaaaaaaatgtgccttatacttgcaatcccatgtcagcgcagtggggacagaaggctcctgggcctcactgaccagccagacttgcctacctggtaagttcaaggcaagggaaagatcctgttccaaaaacaacacagtggagtgcgacttcagaatgacacctaaggttgtcccctgacctcaacatgcaattgcttgcatatccacctgcatatgtgggcatgcacgtacacagatcctaagatacatgtataatatgtgtaatgtaagatatgtaagaaatattgtaacatatacaaatatagtatgtgcctacatgtatgtgattatatatatatgtatatatatatatatgtatatgtatatatatgtgtatatatatgtatatgatcatcacagtgaccatcacagtgaccactattactgaccacacaatgaatactacaacttaactaatgactttaattatcactatggtcatctgagactggctaaccagctcaatgaacactacaactgaccacctttatagtcatggtagtcactgtggttgtcattagggtggtgagttgtagtggtctctgtggtggtcattgaagtggtcagttgtagtgttcactgtgccagtcagtaatacttgtccctgagccattgaggtactgtagccattgaggtagttagttgtagcagttactgtgatggtcagccatagtggtcatcgaattggccagttgtagtgatcacggtgatggccagctatagtggtcactgtggcagtcactgatgtggtcagttgtaatgctcactgtgaggctcagccacagtagtcattctgtgaatgagtgagtgaatgaatgaatgaatgaatgaagacagaaaaaaagacaaccataaaaaagaaggaacagaggcaacaattttgtatactaaatatccagaaatgactaacagagaaataaaggggaacagtaaatcagagcactgtggacaaaaagcagcacaggagttggacaacatgagaatgtcgtcgggttggtgcagaggcagagcaacagccaggaagtgtagcaggatgaggcatggtctgttggatgggggtatagttactaggaagctatgtaattttttctcagatcatttgagtgccgaacattctgcaggaacatgctcagggtgttccttggtcacaccacctccagtcctcagtctatcactttcatcatatctgataaatccaaacctcttcaatgaacacaggaagagagttggaagggatacagtctattagggtatggtggagacgttaactacagtgtctttgtttcccttgagggaaccaaaaaggacttagctgggttccttgatggaggcagggactacttggtagatgatgtaagcagaaagaataggaaaggcatacctctccgttgtctcagaaacatgcaggtaaagtcagagactgacaggtatgtggcacagaattatcacagaaaatggcaaaagatgatagtgtgttctgtgtgagaggagctggcctttggttgccatgacagcaatgacctgtgaggtgaaacaatgtatatgatggagacagggacaaagacattaacatacaaatagcccccaaatcaagataagaaagaagaaacaactagaataaagtacaaaacagaaaggaagattgtgctgagtgttcttgcaacttgacacaagctggagtcatctgagaggagggaacatcaattgagaaaatgtcttgtcttattagtgattgatgggagagggcccaacctattgtgggtggtaccacccctgagttggtggtcctgggttctataaaaaaagcaggcctgagcaagctatggggagcaagccagcaagcagcatccctccatggcctctgcatcagctcctgactccaggtttctgccctgctggagtttctgtcccaacttccttccatgatgaatagtgatgtggaagtataagctgaatagaccctttcctccccaagttgtttttttgtcatggtattttatcacagcaataataatcctagctaagacagagatggaagttgaaacaaggtcacctcatcaagaaaagatccagagacatgagcatggagaagaataaagtatacatagatgataaaggagcagcctgaaaactgtgggtcacataaactagagaacgtgttaaaaaggtgataacaatctataaacaagaggtggtataaacaggaaagaggcgagaaaagagaaacaagggaggcaaaatgaaagggccgcaaaagcatctgggtacaaaggtgtggcagacagctgccctggggtttcactatacagttccgaggcagcagagtagccctgtgccttaccctgattaattaccataagcttcacctgggtctctcatccaccctgggcctcagtcaccagccacaacctagctgtccttaaaaacataagtctgttttgtaaacacagtgcccggggcctctgcccaaggtcctgatgtttttagccttcttcactcctgatgtctcccacaatgacagagtcagtgtttctgaaaccaagcccatcatctgggtcaccactgtttctagatctaattaactaaatctgcacgtttgagatgatcacaatcatttaggagtggcaggtatgaagtgaagaaccacaaaagggaaatgtatctcagaggtagagccatcctttgatatagacacgttgagtgtcactaatgtttgggagtctttggagggggcaaaataaaaattccttgcaaagggcagttagaagcagaactagaagtggcatgtgtttgggtcccatgcgagtcccaaaaggtatgctgaaaggctagattggaaactgacaagcatctaacagggtggacgagtctgcctcagggtcttagaataaaggtggcttataaatagcaggcactgtggcatgtgaccgtggttcaaaaagaaaatcagactggcttagcaggaagtgagggcacagtctcccagctacaggatgttagaaacctgaaaccaacccccacttcctgctgtagtcagttgtgagcactttgtatcgaggaccaggccccgtgagttcagatcccaagaccagtgtaaaaagctgaaaaccatggtgcacacttgcaaccctagggatgggagcagaaacagcaagatcctgtgagctcaccagctagtcagtgcaattgcaagctccaggctcagctgagagaccttgtggcataaagtaaatcatatgaagagcaagagaggaggatacctgagacagacacatacacgcatgtacatgcacacacacatacacacatgtacatgcacacacacattcacacatacaatgcccccaggctttcccagcagtaatgcaaattgccgtaatacttgtgacttttctttatactttacagttctctgaccactatctttactataccttaaaaaagcaaaaggaatgttttaaaaaattataatttagggttttttcaaaatattatattttcatcagatttattctgcttttaagtgttccttctagactggtatgtatctttcaagaatatatcattatatattaacatagcatgtaatgacattatttgcataagttagatatatctatatgtgttttccttttcttgctttgtaaaaaaaaaaagatcacagctggtcaggggacacagtctacatttttacacactatttgttttaacataatagtgctgacttatatacttttaaatgtgcactaatttgtcataaataacaggtttctttatgatcttttcatgtattaatgtactttgatcctatttgcccttaactgaaccgccttaaaccctgcttgaggatcctgttagcatccgttgctttgattttggcatagcagtcatttctcactgcctgttgtgtgttcctctctccctgctcctctctctctactgccttgcagccgctcttccacgctgttaactcctgagcacatgtatccctaggatttctgtctcactccttggctttctggtgagttattaatagaatctattgctattttccccacagtggttcctaggtctcatattgaagttgtagccatttccacctgaagattaaaaaaaaaaaaaaaagatttaaaaaaatggtctatatttgattttagagtgcttgcaagaaacctgaccattttttaatgtttacatccctagtccccatgggatttggctctttgtataaatgggatacaagagtcaaaaaatcatctaggtgtgttggggcacacctttaattccagaacttgggagtcagagtcaagtggatctctgagttcaaggccagcctggtctatggagtgacttccaggacaaccagggctacacagagaaaccctgtcttaaaaacaaatcaataacaaaagaatctgtaaaaccgttccctatgctactgcgcagtgctggagatgctgcttgtctccctgtccatgtcttggtccccacccctcacacctttggcacctgagggagcgacacaaatggacagagtggagggctcatagctacaaccaccgtgatgacttgctgggagtggattttagaataaattcaagaatgtttccccctatccattagtccattggaatctctgattagaattgcattcatcttattaattaattaattgcattcatcagattgatccaagaactcagtgttctcccataaaaatattttttcattatataatttctacacacttaaaaactgtatgttgaataactatgtttctgtgaatatttttcactgatgaccagcataaatttacgtgagacaagattctcaaaatctttatttgaagcccttttattgcctaccttcatgacctctcatgaataacactactactgattcagcataaaatcttacaagtgtttataggttatatcatgaccagaaatcgtcaagtaagataatctgtcagaaatagaggtctctttggaaattagcttcatgagaagtaccattaatttctaattgaaagatgcttgcaatgacaaatttgtcctggtgaacagggcaaattgataagattatgagtaggagaggccccctacttcactagagagcaagaagtaacctcctcacagaatttctcattttaacacttcatcagatcggatctctacagtaagacttgtggtgcagagagtactgtctcccacagcattcattggagacttctctctctctctcctttcttccttccttccccctctctctttctctctttctctctctctttctctctttcttgtttgttggttgctttctttacttttttttaagataggatttctctgtgtaacaaacagtcttagctgtcctggagcttgctttgtaaatcaggctggtcttaaactcacagagatccacctgtctctgccactagagtgctgagattaaaggtgtgtgccaccaccacccaccttttcatttaattctttttatatttattttatcaaacatatgagataaactctgaaaacagatatcaagttagggtgatagcacaatccactcactctcaggaggctgaggcagggcagaagggtgcgccttattaaaatcattgagattttaagcttaagcagaaaccacatttgtttgctcatcctttccaaacctggttctcctaaagctctgttcttgcacagatgaagccatgggtaagcccaggaactatggttggcacttataacagcattagaatgtcatttgatatgaaaaaactaactggaaactacaaaaagccaggtggtggtggtggtggtatgtggctttatgcagagactagtggatatctgtgagttcaaggccagcctagtctacaaagcaagttccaagacagccagggctacacagagaaaccctgtcttgaaaaaagtaaataaacaaaacaacaacgatgaaagaaagagaggagacagagacagagagagacagagagacagagagacagagacacacagtgagagaacaaaaaccctggaaactccacagtagagatttggggtgaggtcagtgtgttttttctcagtaccccctaaaagactcccctattcagagatgtaacttccttctattcctccggcctcccgagtttccacactcttagcaatgctatcagttatgactcaaccttccagcacccaagcctttggggacacttaaaatccaaagcataacaggctcacagtgatgcccggcacacagaaagcacctaagtgttatttctcattattattattttcagtgtgtcccttgggaaacaaaagtgcctgaagttattttctgtattaattctagagtaaatgaattgaatcaatgtcaggcaaaggaaatggcatctgggtaaacccgggcaccttaatttgggttactattgctgtgatgaaacacgataaccagaaagaaccttgggaggaaatgttttatttcactcacagttacataaaacagtttgtgctcaaaagcgatgaggacaggaactcaggcagggcaggaacctggaggcaggagctgatacagaagccatgaagggtgttgcttaccagcttgctcccacaacttgctcagcctgctttcttatagaacccaggaccaccaatccagggatggcaccacccacaatgggctgagacctccccccaccaatcactatgtaagaaaatactttattgccaggtggtgatggtacaagcttttagtaatagaggcaggagaatatctgtgagttcaaggccacctggtctacagagcaagttccagaacaatcaaggctacacagagaaaccctgtctcaaaaaagcaaagatagacagagatagatagatagatagatagatagatagatagatagatagatagatagataggtaggtaggtaggtaggtaggtaggtaggtaggtaggtagatagatagatagatagatagatagatagatagatagatagatagatagatagatagataggatgggtacacacacacacacacagagagagagagagagagagagagagagagagagagagagagagagagagagagagagaaataaaaagacagaaaagaaaaaagaaaaggaaatatcctacaggtttgtctacaggctgatcttctggggacattttctcctctccgatgactctagcttatgtcaagttgatatgttgtcagaataccaggttaaatatcaaagacttgttaattacaaatctatgagctatattttttttttactatgtattaggctttttacaagtagagcataggaaatctgaaaagcatcattatgtacattgtaatcttttagaagcatctggttttggttttgttttctatttcctcagggaaaaagagagagagacttggaagctacttaatacggaacatcaaaatcccaatgaaaccaagctggaaaacaggttaaagacacacacaaaaaaaagcatgatacattttcagtactaaattttcattctttatattacataattctaataacaaacccatttctctgactgcttgatgaagccatggtaaccatggagaaataagcacaatttagtcagtttccaaagtatatctggaaagggaccaacgatggcagcttcacaaacaatcgacatattgatgtgtctgtggtcagacaaggtccctacagcctcttctgaacttccaagggcagaaatagctgtaaagcagaacagaacaaacacctctgtgtgacaggtgatatagcttaccctcctctggaccaaacccatgtggtccctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcccttgctggctctagcccagcctcagccccactgacccttctaggcataaccttcacctttatgctatttctgagtgactctgatagtctctccttccccaacttatccagggccagaggcctattttggtcacggcaaacctttggtttggcttgaaggcaatgtctgacaagtatatctagagaaatgtaacctctctcctgggctacatactgagcccaggccagcagaactatagagtgaggcgctgtctcagcaaatagataaacagaacaaccaaaagaggaaagaaagcctctttcaggaggcctggagtggggaaggttaatgctgataaaagcacactccctgactcccactatgctctgtgtagcatgcttagacaagagcccagggtttctctgtatagccttggctgtcctggaactcattatatagaccaagatgccctcaaactcacagagatccatctgcctcagcctcccacgtagtctaaagatgccagctgtggacacaggctgagaaggaacaaaaagccatctgtactccccaactttatcatccaaatagatttgaccattacagtcccaatcatgattatgaagtgacttgttctctctctctctctctctctctctctctctctctctctctctctgtgtgtgtgtgtgtgtgtgtgtgtgtgtgtgtgtgtgtgtgtgtgtgtgtttgtgtgtgatctagacaacacaaaaaccctgctaattatcacctttacatctagattggaagtcagcaatctacagcccaaaaggaaaacttagcttgccagttatttataaagttttatttgaacacacccttctatttacatagtctgtggatgctttctaatttgaaagctgaggaaccacaaaggaaattatgggccaaacaaccttgtctatttactgtctaggcctttgtaagaaatgttcctgatttctgatgtggattttgatatgtttcacatatcaaaatgtgaaagttagctttaaatggtgtttttgtaaaatgttgctcaccgtgtgatgttataaataagagacatgtatcttgttttgtcagctttcctagcaagaagtgccaatccttcttcacaacgacgcagaaaaagaggtaagaaatgtgattaatcacattctattgaataaaaatatttttaaatgttttgagacagggtctcactatgcaccactgactggcctagaactcactgtgtaggccaggcttctcttgaactcatcaagacccccctgcctctgcctctgagtgctgggtttaaaggcatatgacaccatgcctggtcctattttatttttttaaatgtattatactggatcacataggccatttatatgctagtaaataaatgaactttgagcatactccaccaggacccatgacccttcacttcccactcctgttagtttcctttgtctcctagacaattttggtcctacattcatgtcgtttgtacatacaattttgtgagggaggcatgatgacacatgcctttaatcctagcactcaaaaggcagaggtagatgaatatttgagttcaaggacagcctggtctacagatcaagttctagaacaaccaaggctacacagataaactctgtctcaaaaaaacaaaacaaacaaacaaacaaaaaaaccaaagcaaaacaaggtagtaattttgtgtctctgtatgaactcttaagacccacaagtgagagcaaacatacttttgtctttctgagagtgactagatttgcttaatatgatgatctcccagttatatccaatgttctgcaaatggcataattttgattttctttttttatggctgaaagaacaatttctttacctgctcctctgctggcccctgaggtgggtccacagcttctcaggaatgcttcaacaagcgttcataagtcgtacttctacactctgtgcactgacaagtcagatttctcaattggctgatgaaaccaattccaccccttagcatcggtcaatttcaatagcacaaaggagggttgataactttcatcattccattgagtagttagttgatttgggagagacccagaatggcataggccttcatatgctgattattcttgaagaaagaaataaagtgtgtggctcatatgctgtttagtgtattttttcttacccacatagaaagccacagaaccctacagaccttggtagtgacacaagacctgtattctaatccctaaagtcctgtgtgacttaagccatacttttgtccttttctaactcaatttgcttatctgtaaagatgtgacataggctttcaggtgaattaagctgagtgcccagctggaccactgttgttctgatagactgtactctaaagtaactgtgcgatacctactcccaaccccagtcccactgtatctttgatggatccccttaactgtagtaggaaacactactgtggaaactcattgtaaggccttcattgtctgattcaatggaattagatcccacatactctgggctctgtgctcagatgccaggaaatgagggtgatcttggacagctgggaggttgaagagattttgacaaatgacaggaaaacgagacatattttactcaccagcgtacaggctgctagcaggcagtcaccagcaggcaccctgctgtatgctggcacacatacaggcaggctgagtggaggtaggcacccaggcctgcagaccgacacacaggcaagccagtaaaagtgatagttccagcccctgacctcaaggccatatttatacagacccacacaaaagtgtcacactgccacaactatcacatgacatcactgtttactttggggtctccagacatcttgtgtcagtcattttgtgctaactcattgtccctacccccttccaccatgtccagtgtcagccatgttttggctgacttatctcagatatccagagtagcgccatgttgtctcactataagcgctcttgtggcttcctatttccaatacatacacctctgaagggtcttcggggtccctctggcgcctacagaatcatctacagcagtggttcccaacctgtatgaccccactgagggttcaataaccctttacatgtgtcacctaagacctccactgtcggaaaacacaggtatttacattgggattcgtaacagtagcaaaatgacagttataaagtagtaacaaaaaataattttatggttgggggtcaccataacatgaagaactgcattaaagggtcgcagcactagggaggctgagaaccactgctctagagctagtactgcttgagcccccacccccaccccaggcaagcacagtaaaggagaaaaacagcaaatcagatcaaaggatggagatgacaccccctcactgggtgtctctcccatcccacttttctaccataaatgcatccaacaagccagtcaaacagagtctgagcattatgtttcccatctacaaaactccaaagccctaatacaatgagaattaactctccaaagtatttagaagaaagtcgtcaagcagtgactgctgtagccaacaagtctgggagtggaattcttctcaccaaagttctggctgctgcgtaggagtccaaaggttgggagcagagtgtgttgttatctttattagcatctaatcatgcctaaaagagataatatgtactatattacaaaatgtaactaattcatgtaaaaacctaatgcatttttagttgtacaagtaagataccaaagtgggtggagggaaggtcccgcacggttctagaataaagtgaaatgtgtccctgcaggtccgagaatccccagagaagaaaatgcggattttggaggagctgagcttcctgtggtatgtggcaacgctcagggcttcctggataaggagaaatttaagcaaggtgagtttcagatcttcggtgcctttcaaagccacagtgtagggggcaggcacctgtgttgagggtgtctcatcccggatctagtttatgggactcgagatataggtaatgtcatgcctgttaatgaggtgagaggttgtgaggccaaattaacaataagaagagggcatgagccgggctgtggtggcacgctcctttaatcccaacacttgagaggcagagacaagcagatctctgagatcaagaccagcctggatttcagattgagttccaggatagcaaggacgagagaaagagagagagagagagagagagagagagagagagagagagatcttggcattactcacctggtagagactacctgagtctagtgccagaatttctaacagccatgaattatgaaggcacctctctctgtagatgcccaggagggaaccaactgagtcgtatgtgtcgagtgtactccttgtaacagtttcagcacagcgagatgacatttgcagatgccagtcaagggctgactgtgttggatggtggttactcagaagagtctcggggttgctgtgtttatcctgtgtctatctgcatcacaccccagagaggctagacccagggctttgtgcatattagggaagcattctatcatgagctctgccccaagttgcagttttgcgtgtttaaatataaaaccatagcttatcaggctacctcccattccccttgagaaaagggcccataagatgtccatctagtatctcataccagagtgaaaacttccacagctgggcaggaaatgtacatgtctgagagattcatcatcaacctttgtgggtctgttacctgcaacatctgtcaaactttaatctaagttaaaagggtggggcagatatttgaattggaagaaagatacactcaaactttgtgtttaccagtatattagcccactgttcctggctctattttagtattcaagtaaggctactctatttaacttacagatttaggggctaaaaagtcaagatcgtgcagcctattgtgtggcttttggtaagagactgctggtaggtggcttcatgacaagagaacgtgtaggaggaagagatcatatcataagacaggaagccagcaattggggtcccatgagagttaccatcatccctcctgagggcagctccctctatgatcgagaatatcttattctcatataccaagtgaaggaccaggttgtcaatgtgagaaccctgatggggtgacactcatagctaaaccccaagtcagttgctctgtcatctctgtcagactctctaacactgaacttcctcttttatgaaatgagaataaaatttctctcactggactgcaatgagaaataaaggactatagataaaaaaaaatacagtgaaaatgatcattgttaaggtacagaactactgctctatcacccattgtgactgaccttcctcctacaacacagttctttctttaagatttatttttgttttatgagcatgggtgtttgcctgcatgtgtgcctgtgcctggagcccatggagaccaaacggggacatcagaactggagttaacaagtgcttagatgccaccttgtagactctgagacctgaacctgggcctcatgaaaaagcagcaggcaattttaaccactgaaccatctccctagcctcaataggttcttttgttatcaacaaataggcattttccctacagttctactgtctatgtgtaatctagctattccctctggattatatttccaaaccacttttaacatccaatagccatgtgtcaaaaatatgtgaatattttatagctagctatcatgagctggaagagcgatgttgttgacaaaagacaggactggctgtggtgatagcttcctcctgggtggattcacaagagcccagtagggaactttgtgtcctcactcacctttctaaaatgcaagttggctctaccctggagcacagtaaaaggaggagaaaaaatcctgtttgtgtctcagagaccttcctttgctattctcttttcttttaatattacagtagaatactttaaaaggtgatgttaagggctggggagacagctttgtggttaagagcactagctgctgctcttccagaagacccaggttccatccccagcaaccacagggtggctcacaaccccagttctaggagagacaatgtccttttctggtttctgtaggcagaaaacatgcatgctgtccacagaccaacaaaacaccccgcaaaacaccagtactcctaaaataaataaatgaattctttttaggaaaaggtcaaagggcaatgtcaactagtctctgtccttgcctgtcaggtggatgtgtggcccttggtgactcacagggaaatgtaaaccttcctgactgagcctgagccccagatccagcctgaccgtaggccaagagcaggtgttttccgagctggctcctcagtttatcctgtcttacaggcatctatgtgaggagtatacggggcaagacagggcggttattcactcccatggactttgaaatcgaaggaaactgtgaaaaagccaagaactggcggcaaagcatccgctgcaagggatggaccctgagagaactgatacaggtattctgcgggcagaaagcgtctgcggtttctggagccatggtagatgaaaagtttctgctgtgtgacaggcagcttccaatattctgggggaacggcaacagattcaaggctctctcggtgtagctggtagcttcaaccaaagatttcacaggcataactcactggtagaagatgttagcagaatctctgtgtccatcatgactcttgttagccaggttccatggcgtgggtgttgccagcatgccatggaggtgtttgtgaccttggctggcttgtattacagcttaatcctcttaaatggattgactcccatccttcagatggtaggagaacagactgtgtgtggccttttccatgaactgattgtataagatttggtagcatggatataatttaaaatctgacagggggaggggcaggtgtgtctttaaactcggagtgtcagtgatgaaagaaaataaattacatatctgaaaataattcaaccgcatggatgcctgagttacagaatgtcccagcaggatttcttccagtaagtcatcccacacttagtcttgaaaaggaatagctgggtgtggtggctcacacctgtaatcccagcccttgggagactgaggcagaggaattgcccagaccttgtagtgagtttcaggacagcctaggtcaccaagtaatacccttagctccctctatgccaaaagaaaagtaaataaaagaaagggtaatttaaagattgcttttttaaaagtaagtccttcataccaacgctctgaactgagggaaatcaggagtttcctttgatagctgaacctatttcattcaactcagggtacactgtgctctctgtcacacatctcaggtggcctttccctgtgtcacattcacaataaaggaaaagggattgctcattgggtattgactgagctgcatctaaagccgtgtagttacaggtgtgagcccctggccagagccaggctgcaccttcatgctgcagttagtactgtgaggagaggtgccagcaggaagcgatgctgtagctaaggggtgggatggagagttttcacagagttgggtggtaaaggaagatagttctgacaaagtgtagaatggggctttctgcacggggaagaagaacatgaaaacgaagcctcagtgtgtcaggaagctgggggtgatcgtgtgggggaaaagtctaaaggtttccctgactcgctgtggagagcatggaaataaataatttccagggagttaccttgtatctaacaatgggacatccagatagcagtatctagaaggcagttaaaaatacctagctcaagaaataaaagccaagaccaaccctatcattaatctctgtctttcagaaaggagtactacaagacccaccaaggaaaaaggtatttatatcccacagtctcctgccgtgatgtctgagcctattgtctacaaattgtttgttctccatccccacgtgatggtatatacgtttttaaattgaccgatttggatttgaccagatttgaatttatcctatggtgttcgtctagttgttgttttataatgatttgcttctttgagcatcaaaatatctgaggtagagatgggagccgaccttgggagctatcccacaagtgatctcttctgtctttcagaaggaaactccacgaaacccaaggcaaacaaggagacaggtaaatgccctgtgaccttctgctatggtgtctgaggccaacagcttcaaactgttagttgtctatctctgtcacgttatagttgttaaattcgctgatggtgataaaaatggattctataatctggaatcattgtggttgacttttttttaaagtttttatttattcatgagacatctttgtctgttttgttgtttttttttaagatttattatatatatatgtatatgtgtgtgtatgtgtgtgtatacacacacacactgaaatgtataaaccagctcccaaaatgtatcctttgctctccacctgagggtcacaggagtaaccccacacatgcataaaatgtgatttttaaaaacctggggcatgggaagatggctcagtggttaagagcactaacaaaagacacaggtttgttctctgcattcatctggtagctcataaccatctgtaactccagtcccaggaacccctctcccccttctggtctcttacttagatatagccatgcttttcttgtttctctgctaggggcaggaccctccgctctccagtctctggataacttactggatggctaaagcagatgctgagtctgctggtccgtggggcacagcttcagatacacaggtctcacctgatgaccgtgcattagaacccctcagactatccaagcatccagctcagtgaactgaaattgctggtgatggggtctgagatgtgggtcttcttcctctgtgttaaggatcaaacctagggcctcattcatgtcaggctaaacattctgccctggaacgacactcttgaaccttgaatttatttctcgttccacgagtggattttagtctatagcatgttgaagactattactaaataagagaacaaattgcttgtttaaaaggggggtcagggatggaaaaatcgctcagcggttaagagcacttagtgcccttccaaggacctgggtttgaaacccagcacccacatggtggctcacagccacctgtaattctaattccagggaatcaaatttcttctgacttctgagggccccaggctcacaggtggtatacagacatacatgtaagaaaaacatctgtacacgtagagttaaaataaaaaactaaagggacaagagcctatgctcttagtggtaaggtgtttgcctggtggtagagtacttgtctagcacatcaggtggcctgggttcaaaccccagcaccatggatggatgaccactataaaggggggctagggtgcatggtggtgtacctcagtggtacagtgagtgtcatggcctggattccttgcccacattaaagaggcaaacctcaggcctcccaaggactctagacaatggaaccccatgtggatttgtctgggtgctgctctttctcgggactcgcttgaagtgtttttaacaggatgatgaatcagaaaccttggcccaacgacctgaaaatagtcacaacacctgccattataaaaagcaaggactactccaagatagatggagatatgtgcccccaaacgtggtagtttttgtgtcatagtaaatctctgaaagaagaaattacaaattatgattttattcacttcacctatgaattgttagattttttttctttgaccccatcagggttttcacatcaagataatctctctctctctctctctctctctctctctctctctctctctctctctctctcatgtgtgtgtgtgtgtgtgtgtgtgtgtgtgtgtgtgtgtcagtgtcacagatatacaggccatatcagaccacattaaaagcacataaacgcaggtttattagattctgctcccaggcaggcaggctcatcagttccaatgacgagaactgaggaagtcatgtgcccaggttaaggtgggggtgggggacaagtatagctctttaggtgaggggtgataagctgggcttgtgcccaagtatggtcaagatatgagcgagcacttaggcagggattggggtggctggcagcatccggggaggaggttacgacagctgccaagaatgcagaactggactcttggcgcctttccgttgtttggaggcttcctcgtgcgggtagagttgggggaagagggcagcttgcttgtacagggatgagcggagattccagacaagcgtaaggaattctgcaccccgaaagcagcaggcccttcaaaagctcaagaatgagatgagacttagaaattgagataggcatgattggtggagggctgtgtctgaggcacggggtgggcggagccaagcgtcacatccaggcttcgcatatgattggtggagggctgggagtctgcgacacggggtgggcggagccagggttcacacccaggtttcacatataggctgttagaggctagagaaccgttgtaaaagaggaacagtcagtgttacagaacgaaacagattccctagagaacaggttatgaatgtagcaggcccaaaccaaggccagaatatagatctgaaagtctaggggtggggtggtcatgggaggagctatgaacattagggcaaatgaaatgagtcaagggtgcaggacagagcccaaggaatccccacattctaatagcagaggctgatcttcagccctgggtggttcccctggccacgtgccttgaacattagaaacgtgaccttggaaggggaaccagaacccaagctagccctggctacatgaggcccctctttaaaaaaaaataatgatgatgaagaattaattagctaatgaattaagccagatacaacattatattttggagtcaggctttcctgaataataaatttatcagactatctttaattcaactttcttgctactgttgttattacaacagtatttctgttatttcactctcagaatttgctgtcttcacaatataaacttttctagtctgacatagcccaacaattctatgaactttatttcataccagaatgtcttctaaaatctctgttcaataatacttcttagtattttgaggagatgggctggagagatagatcagtagtttagagcactggctgctcttccagaggacccaggttcaattcccagcactgacacaccagactactatctcctgcaatccaagtccaagggctcagattctccctctggcctttgtaggcgtgtgtgagtgtgtgtgtgtgtgtgtgtgtgtgtgtgtgtgtgtgtgtgtgtgtgtgttaatgcacacacatacatatatacatatatggtgtttgtgaatgtgtatgtaaatgtgtatgtatgtgtgtgcctgtgtattcatatatattatatttatatacatactatgtaatatattatgtgtatattaacgcacagacacacacacacaaataaatatttgaaacatactttgggactggagagatttctaagccactttggtataggcaaaggccatttgttctagaattctggggtcacactgatcttgaagttgtttacaacatttcttcttgtagcgaggaaatccaaaagcatgtaaagtatgcggccagccacggaaagtgcacccttgtactgcttgtaaagaattctatcataagaattgccacatcccacctgtggaagataagaggttagtaagacagccctgtctccagcccttctttctcagagcatacttcacccctacacacacacacacatacagagagagagagagagagagagagagagagagagagagatgctggctcttagtctcaagatccaaaagtgtccagtggtgtttctcagcactcatagcagaagtctgatagaaataaaggccttgcaagtggttacctgtgagaagcatcgctccatcttcctgaggtactccattagggtgatgacaccgtagagctgttgttggtctgaaccatatattcttcttccccactctggaattccaaagttgacacagctgggttgtatcaagccttcagaagtccaccctagcattctaccaaactagttagtgctgggttccagagcacatcataagaactgtgaattctgagtgtcagcacttcaccccaaccaaagcatgtctttgctacagatttgtctctggacagaggtggtgtgtgagattccaagaggtggacaagggatttgatgtttctgtggatggtgtggacagaactactgtgacccagaaactggtctctactggaaaccctctaacagagcattgtcctctggagtcctaagaccactcccaggctcccagaacaccatctcagagaatcatcggaaacatcttctgactagttagacaagctacctaggcacaaaatgaatcagctctttaactctacccacatgcagctctcaacaccctgccaggggcattttgtaatggccaccttgaaaaaaaatactggatggacaaagagaggccagtcttgttaagatggatcattgaaatgaatgaaagttggggtatcttagtcaaggtttttatcactgtgataaaacaccacaaccaaaataaacttcggaagggaagactatttcatctaacagtttgtaatccaccacccagcaaagtcagaatgggaacctagaggcagacgttgattcagagaccatggagtgctacttactggcttgttcctcatagcttgttcagccagttaatttcttatattacccaggaccacctgcccaggggtggcaccacccacagtgagctggagctcccatatcaatcatcaaccaacaaaatgtaccacaggctctcccacccacagaccaatctggttaaggcatttattttcctcaattgaggtttcttcttccaaaatgacttgagttgacatgaaactagcaggcacgtcaggtaaagtggaaagcatttgacactgtgagcaaatctcctttccactgtttccataacacaatttctggccacagaccttacaatgccaggtgaaaagacaccggtagcttgttctcagctggactgagagaagcaagatctgctttctggtttcctgactgtatctctatagtctggttggcccatcaaggttcaagactccttgtttaaggcaataaattcactgttaggaccaaacatagcttcttgtcaaacacccaatgcttttggatggagaagtcaatggaaatccatcacttccttggataaactcctcattcaacatattgacttttaatggaaggggttatccttgcattttgagcctacatggagatccagtatagggtcctccaagagcaaaggtaaacacaaggtagaaaccactcctctctgtttaacagaggtctttatcagccacaggaaggggggtggtgctggcttacagactctgtctgctcttgctcactttatacctgacctcttagtagatcatggcattgtgccttctgcaagagaaagaatcagttaaggggccaaaaaacccaagcatgtcataaggaagctgaggtcctgaagaggaagatgtcacctgaggaacagctggtgagtccgggcaaagttgaaggtcccctttttggttggcagaggaactcagtctcatagccgctgaggaacagaaccccaaggtaaatggtgatgtcctttgatcatgtgactcaatgctagactttggactccagggagtagctgcatttcatatttgtctcaaagaggccaaaggtctgggaattgttccttgcatcttggaatttaaatatgccttttctctgtaagttatcttccacttagaagtgactacctttcattttctacagaaatgtgaactgcttcttttgactatctattgctatccaaaaagtggcttttttatccccaaaccaaagcaagtgagtaaaacaacagaactgcaaccttgtgatcttctcctcatacatgtgggctttctctttgccttgtggacgggtccctttgtgtaggtagccatacatagcaaatgaccatagtctgggagcagtatatacgtactatttgtatatagaatacaatttgtttcttatggttctagagactggaggcctgaggctgaggtgccaatatgattgggttctagatagggtcttctacttcttagttgtttggttattgttgttttgtttttgagacagtctcactgtgtagctctggctgacctggaactgtataaccaggctggcttcagactcacagaaattcatctgcctctgcttcccaagtgctggagtatagatgtgcaccagcatagctggctaaaagtcttctgggatgcagatggttcactctgactgctctctcatatggtgaaaagagagggagagggctccctggagtctcagtgagggcactcatccctctcacaggtactacacctccaaaacctaatgaccttgcagtgcctttacctctcagtacaccaggggtttagactggagtggccatgcaaacattcagacagagtccataaccatgggagtgtgggaaggccaactcaggattatgctgatagccctgccttctctgctttcctcaacagaggaaagagaagtttccagacctccgggagcacatgtggttaaacaaaatcaagaataggctgaataagaaggcataccattcggtacgacgctttgtggaggacatgcgcctcatctttcacaaccacagcatattttataaagtaagcgcctctgttgtgcttccttttggctctgagttgagtctctttctctactcaggtagatgctataatttccctcatcaaggggtaagccctgtacaagtcaaatctgagggaggattctagaagtcccatggtacaggaggagaaagccacagtgacccacagaggaccaaaggctccactttcagacaggtgatttctcacctgtggagagcagtaggctacagagctgctcttcgttacagggaacagcagtgtgctttaaagacagctagcatttcccatctataaagggagaaaaatcagatgtctcaagttgcaaaacctcacatttctgaatccctagtgctgtagcaaaaacaaaacaaaacaaaaacaaacaaacaaacaaacaaaaaaacaacctcttacccagacactattgcatatgccagaaagattttgctgaagggaccctattatagctgtcttgtatgaggctatgccagtgcctggcaaatacagaaatggatgctcacagtcaggtataagatggaacacagggcccccaatggagaagctagagagagcacccaaggagctgaagggagagggtacacgccacaatgggtgcaggtgcatgtgtgtaggtcacacattattagaatctttccacaatgtgggggtcccaggaattggactcaggtctggttaggggcaggtgcctttaaccactgagccatcttgaaggccccactacctcctcttaattgggtttaccctcactatttggaatagtctaagtgaggttctgggttatccggagggatggctagctaagtgtgttcagtgatggctatcaccaatttcctacttctttttcagaaaaggttcaaaaatcttggaatcatagtaggaaagaaatttgagaagaatttcaaaaggattttttcaatcgaggatacaagcgagcaacatgaaccgtgcaaccacaccgttttgttaacctagtcctttctggtccctccagtaatcgtccctcaagcagccaacagcatgatgctcagagagcccacctttatatgtagacagcctgccacactcccgtctctaaccttctatatcgtccttcctgtttgatcatctttctaaagaaaacttagggcataccatgtctgtcaccctggggaacagtcaggtctgagcctactgagaagaccactctggaagcaggattgccccctccccccatttcaaacccaccctccgaagtgtcttgtctaggggtggccttgcccctctaactctgtgacagggaggaggaaccaacaaagccagtccaagagtgaaaataccttgagagcagctagaaggagaccatctctaacagaggttacaactgattatcctggaatgtaaagtgggaaagagaagccggacattcagccacagaagcccagtcatggagagaaagctcaactggaaactggctgactgttgtttccacaaacagttcctgctgcctgttgtgagcgtccagtttgatggcagtctctctctctctctctctctctctctctctctctctctctctctctctctctctctctctctctttctctctctctctcctctctccctatatattcttttatctggaagccccactagaggttaactcttctctgtcctgaactctattggaaactccagctgattgcctctgcaggatttcccctggattcccccctccctgtccactccccctggatatttgaagtacattttgaagtacatgattaacgtgatgttttgtcgtgttggattttttttctatttactcttttacttagcttgttatatgcttaataaattcatcatttgaaactgaaagtatggctaccattgtctgatctcaggactgtgcagaacacaatagggtgggtgtcttagtcagggtttctattcctggacaaaacatcatgaccaagaactaagttggggaggaaagggtttattcagcccacacctccaaaccgctgttcatcactaaaggaagtcaggactggaactcaagcaggtcaagacctaggagcttgggacatcttctggatatatgcccaggagaggtactgctggatcttccagtagttctatgtccagttttctgaggaaccgccagactgatttccagagtggttgtacaagcttgcaatcccaccatcaatggaggagtgttcctctttctccacatcctcgccagcatctgctgtcatctgaatttttgatcttagccattctgactggtatgaggtggaatctcagggttgttttgatttgcatttccctgatcattaaggatgttgaacattttttcaagtgcttctcagcccttcggtattcctcagttgagaattctttgtttagctctgtaccccatttttaatggggttatttgaatttctggagtccagcttcttgagctctctgtatatattagatattagtcccctatcagatttaggattggtaaaaatcctttcccaatctgttggtggcctttttgtcttattgacagtatcttttgccttacagaagctttgcaattttatgaggtcccatttgtcaattcttgatcttacagcacaagccattgctgttctgttcaggaatttttcccctgtgcccatatcttcaaggcttttccccactttctcctctataagtttcagtgtctctggttttatgtggaggtctttgatccacttagacttgagctttgtacaagaagataagaatggatcaattcgcattcttctacatgataaccaccagttatgccagcaccatttgttgaaaatgctgtctttttcccactggatggttttagctcccttgtcaaagatcaagtgaccataggtgtgtggattcatttctgggtcttcaattctattccattgatctacccgcctttcattgtaccagtaccatgcagtttttatcataattgctctgtagtacagcttgaggtcaggcatggtgatttcacccagaggttcttttattgttgagaatagtttttactatcctaggtttcttgttattccagttgaatttgcaaattgccctttctaattcgttgaagaattgagttggaattttgatggggattgcattgaatctgtagattgctttcagcaggatagccatttttactatattaatcctgccaatccatgagcatgggagatctttccatcttctgagatcttcttcaatttttttcttcagagacttgaagttcttatcatacagatctttcactttcttagttagagtcacaccaaggtattttatattttttgtgactattgtgaagggtgttgtttccctaatttctttctcatcctgtttatcctttgtgtagagaaaggacactgatttgtttgag

SEQ ID NO: 1904 - DNA, 970 bp, Mus musculus
gattcctgtgaactccaagtccaactgaataacagagatgctaccccagagtcttgcagcctattgcctcagaatgaagaaagagctgtgcaactcaactatgaactccagattaatccctgttttgtgcaactggtagatgtaaagaaggaaaattcatcattttccttggctggtaaccaacaaacccgagcaaggaccaaccaaaatgaggactctgagataatagaactcagcagtggggattctgataatggagagaacttctcagaagctacaaccacagtcccctcccagccagcacctgcatattccagaaaacctccaacactgagaagagacagaggaggagatacttctgacactgagagctctatcatcattagaagacggaaaaggacaggacggaaaaagagagagagacttggaagctacttaatacggaacatcaaaatcccaatgaaaccaagctggaaaacagctttcctagcaagaagtgccaatccttcttcacaacgacgcagaaaaagaggtccgagaatccccagagaagaaaatgcggattttggaggagctgagcttcctgtggtatgtggcaacgctcagggcttcctggataaggagaaatttaagcaaggcatctatgtgaggagtatacggggcaagacagggcggttattcactcccatggactttgaaatcgaaggaaactgtgaaaaagccaagaactggcggcaaagcatccgctgcaagggatggaccctgagagaactgatacagaaaggagtactacaagacccaccaaggaaaaagaaggaaactccacgaaacccaaggcaaacaaggagacaggtaaatgccctgtgaccttctgctatggtgtctgaggccaacagcttcaaactgttagttgtctatctctgtcacgttatagttgttaaattcgctgatggtgataaaaatggattct

SEQ ID NO: 1905 - protein, 288 aa, Mus musculus
DSCELQVQLNNRDATPESCSLLPQNEERAVQLNYELQINPCFVQLVDVKKENSSFSLAGNQQTRARTNQNEDSEIIELSSGDSDNGENFSEATTTVPSQPAPAYSRKPPTLRRDRGGDTSDTESSIIIRRRKRTGRKKRERLGSYLIRNIKIPMKPSWKTAFLARSANPSSQRRRKRGPRIPREENADFGGAELPVVCGNAQGFLDKEKFKQGIYVRSIRGKTGRLFTPMDFEIEGNCEKAKNWRQSIRCKGWTLRELIQKGVLQDPPRKKKETPRNPRQTRRQVNAL

SEQ ID NO: 1906 - DNA, 74788 bp, Homo sapiens
  misc_feature (1)...(74788): n = A,T,C or G
atggaggaggcaggggttgttaccccagttacacctccattttaattcagcagtctgccctctggtatctcctggtggttcatgctgctaaatggctcctaaaacttaaccaaggagtagcccctattacagttgctgtgtcaaacgtggtatctttattataacgggttagcacagccttagcaagtgatatgcaactattaatacggaaatgccacttttaaaggatccggcaggatgtaggttgagaggaaattcacattctcaaggattggacaagagtatatctttacagtcttgctccagggcaaggtgaatcctgctctgtgttacaatataggctttctggacactctgcaatacattacattggtcaactgtattgatgacagtatgttcatgagcctgataagcgagaaatgttgactattctgaatgacttagtaagtcataaacactgcagatggtgggagaaaaacgttacaaagatacagagatatgccatataggtaagctttcaggggttcaatggtctggaacgtgtcagagcatcccctccaaagctccaagctgttgcacttcatacctcctgccactaagaaacccagagcttggtggtcctctccaagtgaggagaatcaccgtggttgacattctgatgaaagtgattctaggctttgtaatgtggttgtgtgtttgggaggcagggagtggggaggcagtgggtataccatcttcataaataaaaatgtgctaatcaatgtttttcacttaacaatataagatggacattgtcacatcagtaaatacagctctacatcatctgtgccttacctttcatttatcctcaaaactggatgacagttggctctttgattatttttggtctggtaagcatagtaatttgtactgaggggcagcacagactagcattcagtagcacagcctctgtaagtggaagcccagttcctgcacttctccacttgctgacggtgtgtccttgggcaacctactcatccttcccctgtactgtttcatctgtaaaaaggagatactagtagtaaatagctcactggattattgtgaggattaaagagttaatatttattatgcacttagaaagtgctggccctccatgcaatacatatgtaataaacaagcaaacttaaaagattaacataaacacctttgtatcaattcaggctctttgctgtcaagaaaaacccaatatatacccaaaagaatagaaatcattctatgataaagatacatgcatgtgtgtattcattgcagcactattcacaatagcaaaaacattcaatcaacccaaatgcacatcagtgatagactggataaagaaaatgtggtacatatacaccatggaatactatacagccataaaaagaaactagatcatgtcctttgcaggggcatggatggagctcgaagccattatccttagcaaactaatgcaggaacagaaaatcaagtaccatatgttctcacttgtaagtgggagctgaacaacgagaacacatggacatagggaggggaacaacacactggggactgttgttgggggcaggggaagagagaggatcaggataaatagctaatgcatgcagggcttcataccttggtgatgggttgataggtggtgcaaaccaccatggcacacatttacctgtgtaacaaacctgcacgtcctgcacatgtatcccagagcttaaaattaaattaaatttagaaaaaaaaagaaaagaatccaatcacaaaagaccacataatttattattccatttatatgaaatgtttagaataggtaaatccatagagacagaaagtagattgattggtggttgcctaatgctgggaggttgaggggaaatgggtatgtggtttctttttatggtgacaaaaatgttctgaaattgattgtggtgatgttaaaaagccctatgaacatactacataaatttgaattgtacaatttaaatgggtaaatcgtatggtatgttaattgtatctcaataaagctgttaaaaaaataaaaaagagagagacccaatttatctagggtagacaaaagttacttcgatgatgatatcacagtgcctcacagaaagggccggaaggcagggttacagagttggcaaatggccctggaaaagggcaggaatcagagcatttccaggcaatcatgcaacaggaatgacacagccattccctaaggatgttaagattttactaaatgttgttgttgatttttttaacctctcacaatacttcactcaaaagctcaactccccgcaaacagcatctggctggcctggcctgctcaatggccagcattgtgattaacagcccctcactcctacacccagaagggagagctccttcacccaaaggaaccagggactgttaggcaagggggatggaggaggctggacagccaaggaaatcacagctgactgaggaaacccacctgggacactcacagcctagaccactgctgtctaatggaggaataggggcaattccaggccagtcagagaggtggaattgctgggggatgccaagttccttgggtacacaggagcaggtaactgtttcgccattgtcctgtgctgcggaggcaaagactgagttggtcactgttcatctgacatgaaactaccccttactacattatatcaacaccgagatatttctctcctgaaatatttgttcacattttcccctgaaccccgtggtgtgtgggactgaaagagtctacactggttcatacaaggacggcacactccatggtcgtgtagtgtggccccaggaatgttaagctggaaactagggtatggtgtgttcagggaagggggtgactcctctgctgagacacttgattacatctttaactgtgtcctgctggagctgctgggaaggtgggtaggaccactttccatcccctgatcacctcatcctccagagggttcatccacagttgcctgagtctggatggggaggaggatgtaggatctcagccttgagatctcaggaccttgagtcttggccatataatgatgtagccaccacttctggctctctctggtgtctgttttcactcctctgagtctcacagaatgggattgtgcccatgactggtgcactctgcatgccagtggataggtctgctcttagatgtttttgtaacgtctgtgtcagtacatgtggcccagagtgctgtacaggagctggctggtgctttttgttttgtgcttattcaggaaatacaagaaataactcctgggttcctgcattgtgccattgtctgaatgataaatggtaaatcccggccccacttcctcatgcaccccccagtggggaagcacctaatttccaattctggattcttacaagcacagctcaagactatcattattgtcatcacagctcagcctggaatccaggctctgggataaatgtgagcccctcacttccatagctccacattcaatgggctgaacaccctttagaattattcatgagagagggtgtgatagaccatagatggtatgggcagaggggtctccaattctctctggaaaggagagtgtcacctactagactgagtccactggccattcccaagtggctaatagctgcagaaatggatctacgtcagggaacactttattcccttatacaccaagaaaatggatcagtagcagatgagatgaatgagtttccaacttcaatgccattgttttggaaaccagcaaaactgtgccagtatgttgcccagaaaaacatcagaccagaacaccctggaagccatctgctccccaaaaaactattctacctggcagttttatagcccacctgcccctgagagccttatcccaaggtaagacacaggatatccagcaaaacctggttcccagggccacttcatgacctggccggaccaggcggtcatcctgtgttagtgggctggggccccataggatgtcaacctgttccctgagcacagcatttgtacccatgagaaacaggtgcaccagttaggagaaatgcacagggctgtcccaccagttctggagtcatccttggccctgggaagagctcattagactttattttggatttcccctagagcagatgttatgactgacagtctaacaagacccacctcatcctcaaaacagggtcttctcagcccttgctaggcaaaggtgccctgggagagccccccagtgctctggtcagctgtctcccacccacatttccaggaggagcacctgtggaaaggcagactccaccccttccctgcacatctccgccagacaatggttggcagatgggcattggcctttgctggaactgtacctcctgtctcataacctgtctcgtaaccactaaatcttcatgaagctacactttccaaccctgcgcttcctttattctgttcagcaatactgaggaacctgccagggaccctcctcttcatagaagcacccacttgcaagcccaaagaagcagaagctgctgcccagcaggtgctggtggagaccatctggaggggccaccaggtatctccttccctcgccacacatgcatcacctggcagtcctaagatctaggacagtctgcgggccattccagctcaccatggtaaaagtaatagacatatggaggtttgcagaaacattaggagtgcagacttggtaaaaggctgcattgttcattcaagcctttcctggctccagccccagccaccaggctccctccgctcctggtggtgttcagccctgcctccttggcaccctgaggctcacaaggagaccccaggccgaccacagctcgaaagacattcctcctcctttctgagggtaggtctgaccccgcagccttagttccatgcttgtggaggcatccaacatggagctgcctggttccatatgtcaggtgacagccccaagtctaacggggacccactggtgaacacaggaaggtgccaccaggaatccccagaatgtgaaacatagtgagcctgtagggtcgttctgttgcagtccagcagttggggctcaaagtgaaacgaaagggaaggtgaagccccctctccctcactcagggagactgggtttcggggtggggggcattgacaaacttctgtgcatgaaacgcacttctctgaagtctcgtgtcttctaattcactccatgccacccgtttttgccgtttgcccactattttttaatcctttcaactgctcagcatcgagtcatatcagtgtgccccgcaaggacagcaggagtgtcctgcagggccttagggtgcggggcaggcttaagggcttcagcctccggggaggtgcagaaggcagggcggcttgtggctccggacggaatgaaactcttagggaagaggacagagaccaggaggagcgaagggcagagtcccccgcccctcacgggctgaacagagggcaggcggcgacccggtggtgctcgtgagctgccagagggcaaaatgatctcagaacccagtccttacatgggttcgactttatttagaaggaactacggctcttctaccacacaattcgaagtgtttggtgagctagaatcccgataagaggaggattttcggtttctgtttctgcccagccctgaagaggctgcagcgctacgcgctgccgggagactgggcgccggccgggcgggggcggagcccggaggagcgcggggcggccgcgggaacgggaacgcgggaggcggacacgggggatggcgatcaccgacccctgctcgttgcgcgtgctcacggtgtgtccgtggcgggcctcgccggctaggtggcctcggaaaggaggcatgaggtggcgtccatgggccaccaggaccctgtgctgtccgtcagttaccaggggacagggatctgcggatgttcatctgcggatacaacaggggctcagctgaaggaccctgcgtgatgatgcggactcaggggtggccctgggccagtcggtttcttcctggtgctgcacaaggactgagggcgtcctccggatttctcatgaatggtccccaccttcagaaggtggccagagggacttcctgtgttgtccaatgctccccttgtctttctgactccctacaatccttcacccatagcctctttaggccagtcactgaggctctgctgagcaggggaccctggtgagtgggccagggaggatcagaccagcctggtctcacccaacttcctaaaagctgaaatattgctaccaaatgcccgctgagcccgggggataattgcatcacaatcatgcaattgcaaggagctatgaccccagcctctacccatctgcggcacagatagaaaagaacctcagaagagagatgtatacccatgtgcttgaaccctttgaaatataggcaaaatggagagacagacggcgatcaaaataccagctttattccggataaaagctggattggggatgtggcttagatatgtggcagtaaagggacccctaacactgaactccagaattgggcttatccgcatggcctcaggctgttccaactctcccccacgctatgcaggcccctgtccttgtgcacttgagcttggaggagccaacagagtcttggtctctgcaggcaggatgactccagggacacccagcaaagagcaggctcactcccactcccagtcagagaagcgtcccctagaagatgggcggggaccggaagggaccgggccttgactgattgatgttccacctcctagaaggagacagttcggcaggactgggtgctcccactaaagatcccaggcgcctgcccttcactcgtcacttctacgtcccttggagggtggccaggttctctattctcatgccccagtggcactgttcctgtagctgcctcctgccctgaaactctctggtccatgatgccaatgacctcatctcaggtacagacctctggttctcacatgggggtcccaggttgaagaatcaccccccaccatgttaccagtagagggtcttgactgcaagttgtccaggttcttggcgttttgaacaaagaattggacaaagcgcacagcaaagcaagaaaagaatgaagcaacaaaagaacgaaagcagggatttattgaaaatagaagtacactccacagtgtgggagcaggcccaagcagtattcaacggtcccgcatacagaatcttctctggtccaaataccccctggaggtttcccattgaccacttggtgctcacctcatgtaaatgaagtggcggcctgcaatcagtctgattggttgaggaaagcaaccaaccagaggctgaagtgaagttacaaaggtcacactcctgtgcaaacatctcattggttgcagaaagcaaccaatcagaggctaaagtgaaattacaaagttgtacttctatgcaaaggaagacttggcctgcaatcagtctgattggttgcagacagcaacccatcagaggctgaagtaaagttacaaagttacactcctatgcaaaaaacaactatacacaggtactttccatttcccattgccccacagaaaaggtgggggtttgcaaagggagtagcctctggaccttttgttacttaggcatggaaagttagggttttcctttcaatttagttctaggaagttagcatgaaatggccttaggttccctgcctccagaccctattctcctgcctcacccacaccactgaagtctgaactgaagctgctcttggtgaaatgtaagaggcccatcatctggctgggtgccctgcctgtggtccttcctcaatcactgcctcccctgcttttgagttttccaggctccagtaactggaactacttcttgacaacagaaatattccctattgcctgtgctccttgcagccatggaaaatgccccaggggttccattatttccttctaaacagtccagcaggatttttagctcacatgacttcttaatgtggtcctgtccctttcccaaccccagtgtgtctgacattgttttctggatcagagaaactttgctttcttcacagaggcctacagattctccatataccagcggagcatggtgcatgctcatctgtctccaacctcatctgatgagaacatctccttccctgctgccaggaggtgccccagcatgggcatgtctgcccgtgaagttcaacccgtaaggaattccctgccagtctgtggctcattggtctggaattccaggtgctgctcatagtagcccctaagcacatccagggaaaagctggcacgtttatgtcagtgccactcaatggcctgagcctgcctgctgcccagaggcagcgagaggggagaacgtgaaccacaccaaagcatactgtgtggtccatgccaggtcttcttgggaccaatgtgcctcatggagactgggatcaaaggacagctgtgcccaaaagaggctcagcttaccagcccttcagccccataaagtcggggagtcatggggggtaggaagaatgagagaaagagagagagacctacaggtgagagaaagagagagagacctacaggtgtgcagtgcctgatagaaacagtgaccttcgcccaccggaaaagctgtcctcaccaatgtcctggtgcctggtcattcactcatggggaaaagaagagcagaagtagagtgagggtagaaagccccttcccccacattttcaaatgtacctggacaagcatccttattcacagctggaagaagttggattcagtagaatgccatttggaaaacaccgttctgaagtgccatcccctctggcccctgaatcctcaccagcttccaccctctgctcaccttgggccctggattccagcgcccccaggctcccagctgcctccctgtctctgccccatggtccggcctggagttctggtccctggttgtgtcctgtggccccattctcatgcgccctttgcttctgtttctttacctatgactttatactgatgtaaagcgagtcttctcggtcgcttcttgttctctgaggaatgatgaatcagaatctaaatggaaaatctgggcagagatagaacctcccgcgggagccaccctgcccttccatgtctagatcatctgggttccaacctccatcctcctccaatgagaagcttttgttctctcaagattccagtgacttctccgaagcttaggtgtctcttcacccctggctgttccaaggcggccccatagtcaagattccttaaacccttgccccttaaaatgtttgcctttcttaccatgctggctccagcctctggtcccaggggtgtggagagttctctcttacttctggctgatttccaggaaggctaagcacactctccccaggttataatgctgagcattttggttctctccagccctgggtccccatgtcaggacctaccttagtccagtccatgctctcccatgggcctgagagaagatttgaggtttctggctttccctccaaccctccaactcccaccccaagccatgtcagcaaggggaaggggcaaacatggagtttcccccccaactcccatgtaaactatgccccctcttagagggcagagcagctaaggacaattttggttcaaggacattttttttggctgtgtattgcacaaacaagtggacacccgggagctggccctgctcgtcccctgggccctccttccctggtcctgcaggtcttgctgcttgtcaggcctctcctccaaccctctgccacatttcagaaaagctgagaaccccttggagtgaaaaaggaggagaaacacagtgtccgtagcccagaaggaggttaaatactttcacttctcttttccccatttgggcggagccctttctgagtcagtctgtcggccgacttcctgcttggggcctgggcagccacactgcacgcaggctgggccgactgaggggctcagaggccaggctctgaggcccacgcagggcctagggtgggaagatggcaggtgggggcggcgacctgagcaccaggtgagtctttatctcccttcctttaacctttatctctggctatattgcagctttcatgcctttagttcagtttgtgcctaaggcttcactttaatccttctttgcaagaacataggtatgcgatgttatataatgaaatgaaagacaagtaatgaggaaatcagattttttaaacaggagcaggacagctgttggtgtgagttcaacttgccataacacacgtgactttcttgttttggatttactgctcagctgaccgggacactctaaacatagcagttgttggtggctgggattaactatttcctcatgatctgtgaaccctttcacccctcagccttcctctaccttcaaatatgtcatgtcaaaaaaggtgctttagaaaataaacactccagggtaaacacctggcttacttttaaacatcagacgctgtggtctcacctgtcctggcaaggggcctctgccggctgttcccatgactggctcagggtctgagttcttattccatcaaccttgatcaaaagaaggaaagggaagaaaaaggcccagggtgacaaacggctaaatattttcatttttacctcaatttcctgtcccaagatgggggatacctctgaccagaaaagagaaggaaatcctaacttttctctagtagtgagttgagaaataacattacttaatcttttaaattttttaatacaaaagaaatacactgtacattattgttcataaaatttaaaacagtggagaagtatattaaggaaaaagtcatctttgccactcagccattcttgtagcttctcttcccagtcctgtgaagagtcttgggcacagcttttcttatatttttctatgcatttatatatctaatgcattttttgtaaatacgtaatttatgttcttgttttataataaattatattacatgtgctagtctgcattttgcatttttacttattttaatagtggaaaacttagagatcttttaaccttaatacatatagatctgcctcattctttttatacatgctattccatagaattgatatatgataattatttattctccaattgaaggacatttagattgtttttaaattgttcacatttaccaataagctatcataacaatgattatatatttctttttgggtttttacatctaaacaaatatttatcttgtctctaaaccttaaaaatgtaattattgaggcaaagggtccagttatttacttggtcctgccaaattgtctttctaggaggctgaatgaatgtatttcaccagtagcaaatgagatgaaccatcttcctgcacacagccacgatttgcaaaggtgatgaatgaagagttatgtcttgttttaatttgtattttccttacgatgggaaaattgatcagcttttcatgtttcttggccatttaaattccctcttctataaattgcttgtttgttttttgccaatatgattccgttgaggtgtttgtcctttttttcgtgatatgggagaattcactaaatattctgtaagtataaatatacttttcttgtccattacctttgtctatggtgacttttatcttattaaagcttaaaacttaacatataggcctcttgtgatacagatttttttaagatagatgcacccttgttataaacgaggtgatgctgacaccctctgtgagcactcttagtttttacaattatttctgtgttaaggtggcagattcgctgctaccgctattccaggaagagttcctcctctaatatctctgaaaattttttaaatttttaaacaaaaatattcttacattggagccactttagccttcacagcttttatttgccccgttttcatcttttcagtctttcactttgtgttcataatagttgtctcaaacttttcctccatgacaattatttaccttctagtaggtttcttgtttcttgtcatttctaattttttaaaaattgatagtgtttatttttgaggagggatcttaattggtttctgtacgcctgcaagctccataacctcttgtcattcagtcttcacagtcttgctttatttaggtttgcctgtgctgttaagaactttgggatattctccttgttgtctcttagttatttttccagactgattctgtctgatcttgtgttccacgtgcctgtggtggctttacagctcctctagccaggcttggccagggcaggtcaccccaaacttcccgtttgcttagtcataatctggatgaactttttttctttttttttttaacattccctgttttatctgagatcaaattgttttttgtctgagctacagtttgaagtctttgttttgattcttatcaatttttctgagttcaccgttgattgattaaattatccttttccctgctgattcgcagtgctaccctttttgggagtatagaggcagggtgtgcttctgtgttctctcttctctccccttggccggtgacagcccctccttatgccagtaccacgctgccatagtgatggcagcttcccaggaactcttgacatctgagggagcaaatctcttcctcttcctccagaatgtcttagactcccaaatttgcctgtcaaaatctcgagattttgtgtggaactgcactggatctataaatcaatttgaagagaacggacatctttacattcacgagacttccatctcatgaatatggtttatgtatattattactttaaaaatgtctcctattaaaatttgtatttttctctctgaaggttttgcccttctgctagattccttcatagatatttgatatttttatgccattattaactaaagtagtcctcccttatcaacagttttactttctgagatttcagttacttgcagtaaaacttggtccaaaaacattaaatgcaaaattccagaaaacaattcatgagttttaagatacttggcgttctgaggagtgtgatgaaatctcatgctgtccctctccatcctgcccaggatgtgaaccatccctttatccagggtatccacagtgtagacactaccagcccatgagtcgctgagtagctgtcctggtgatcagatcgactgtcctggtataacagagcttgtgttcaaggaacccttattttagtcaataatggccccaaagcacaagaaggttgatgctggcaattcagatatgccaaagagaagccgtcaagggcttcctttaggtgaaaatgtgaaatttcctgaaagaaaaaaataatatgctgaggttgttaatatctacagtatgatgttttgagagacaaaaagagaccacatttacataatttttattacactacattgttatagttgatctactttattattagatattgttattcatcttttattgtgcctaatttatgtacagattggggaaaacatagtatatgcagagtttggtactatctgcggtttcaagcatccactggggttcttggaagcatcccctgtggatagaagggaactagtgtgctaaattttacatatgaatttgcgttggtgacccatgatctgatccatggttctattttcattcttgtttcaatactgaaatgttttagttactatgattttataggtagtgttctgtaacctaccttactgggattgaattgagagacactaaatgaacagataaatttaggaagaatttatgttttaaaaaaatcctgaatggccccagtgagaaacatagtaaatctctccatttattcatgattgtttgaacttgggaccttgttgggtcgctttagttctaggcattttaaaattgtatttgtaaacaggaattcattttccttttacattttctagttatttcttgctggcataagggaaatctattcattttagttagctgatcttgtgcataggagtcttactaagtggtcttctccctcttaatattgtcttgtgtttttctggagaaataattacatcttcaaagatagtagcagctttgtctcctctttttcagaatttatacctgtatacttttctttttctttcttttttctttctcttttgccttagcgcattagccaggactgccagtgtaatactgaatagtaacagtaaaaatgaacattttagttttattcctgatttcaaggggaatacttataatgtttaaattgaggctttcttatagacaccttttttcaagttaaggacatttcctgctggctctggtttactaaaagttatttattttaatcaggcctgtgtataggatatttatcaaaatgcctactaaagaatctttgagaattgtatcatttttctcttttaatctgatttatccacagtaaattatattgaaacattttattaattcggttattaatttcaccaaagtaaaacatatatatatatatagcttaaagtatcagtcaataagacctttaaaaacacaagtagtactttctgccatcttcccagcccatgtccagtttccctaatggattaactttttggctcttacttttgtatttacttctgtattttgaaatgatgtgctgatacagctctttgtaatttttcaagtttcagacattaatctgttcacataataggacagaagatgaagactttttccataacactccttttcattccctgtccattctcataatacatcacagttggaggttcatcagtaatcagtgttaccattatgatgactatttacatgttgttcataaccaagtcatctactatattatgattacatttcctttcctgtgcaacatcctcccgcccctccccgccgaccccacaaataactattgccctcttatatatttgcttggattttgtgtgtcctcattatgaattcttcccaagcactctgcagaattctaaaattcttttcagtacagtgaggcacattgggtaatttatcaagtccattttactttcttggggaaaccctcctggaattatccattcccctgattccatcagttctggttagtttcagcttccaaggctgaccttgaagcttgacatctctcctgtgttgggtcttgttttgtggattacatgtatacctctttcttgctttactatctcattttggtttaccacattatccagtagcctcctgactaagagtttatagaagatatacatatatatatatatatatcctaccttactgggattcaattgagagacactatatatatatatatataaattgtacatgtctggaaaaaaaattttatccttaatcctcacaactgcataaatatttggtaagtataaatgcagagtttggaaattaatttagttcactgtcttgcaacttccagcattgctaataagaaacctgatgccattctgattattgatcctgtctttctatgtcacctgttttgcctgtctgaaattttctggctcttctctttgatcccttgattctaaaatctcatgatggtttgccttgatgtgggtgttaaattcatttgttgtgctttgctctccagggccctttcaaatggacaactttatttcaattctgaccattttgcttgtgatattatttgaatagtttctcccttctgctttatctctctcttttatcttttggaattcctgttagttggatgttagctttcctagattgatcctctagagactccctggttttttttcttgaaaatcttatatgtcttcttttcttgaatctaacttctatgacattttctgaggaacttcattccttctagtgattaaaaaacttctgccattatatttttaatttccaaaagctcttttgaaaagttgtttctcttttatagcatcttgtttcaagaaatccgaaattttctctctactaatgaggatgaaaattttttttaaattttacgtttcttccaaggttgttttaagtgttagttccttccaggtttctttcccagctcctcctccattatttgcttgttctggaagaattcatcaagtgtccactgggtgtccattcacatttcggaatgagacactaaaaatctgattaggagctctgtgcaaggaatgcctctcattgactgtgcctcattttgatttttcattttccaactcgccttctaaaggaatggtgcctctaattcctgacaacttccagagttcaaaagtgtacactggcttactccttgtcagcttcccctaagcaagtaatcaagatttttgttttttcattctgtgaaattagctaccatatatgcccctatcttccaaaatgtttgattatctcttatttgatgcccttttctattccctgatctttgcttcttttctgcctctaactctctcttataggtggtttcatgggatttcagaaggaacacagatgaatgcaggtgtgttcaacctgccaggcttaaccaaatgcatagattggttctctaatgtgacctttcctggaatccctgagataacacctacatggtcatgccatatgactctttcatccactcctgggttggatttatttatattttgttgtgggattttacctcacgtgtttataagcaactttgtgacctacaattttcatttcttattttgtatttgtctagggttgatagcagaactatagcagcctcatgaaataactgagggtgattgaaattttgaatatatttatatatatgcacatatatgtattagaatgatttgtttaatacagacatcatctgttccttgaaagattgcagaaaattgtccattaaattatttgaaactgatgtctgtgtgtgtagttgttaggagaaagcagattagtgaagctctggaagtatattatgcatttctcctgttatttttagttcttatgctgacctttgagccagttttgattgtttattgtcctaaaaagtaactatttccctagattctcttcttattgggagaaagttgtatagaaatttcttatataaagttttaatcctttccttctctgaagatgtgtcctttttcctattcctaccattgtttattattgttttttcctttgttttcttgatcaatctttccattttgttggtcttttcaatgaaccaccttttggttttattgatccactactcttattttctgtttgagatttaattaaatcttgattttctttattatatttttctatatatttctttcctaattctttacttctcctttgttgaggggattaccttgtgttctgtttctaatacgttggtttaaaacttaatttacttgcagtgtttcttattttctaataaatgcattttaggccatgaatgttcatctctgtgccactttggaaatgtttggcctttataacgtatagtgttttcattggattttatttcttagccatttgttattttgattttgatttcctggttaacctaagaagtgtttgggagtagcttttaaaatttctcagtggaacgagtgggggaagtcgtcctctgtcctttggttgtttactctgatcctattacattgtggttagaaaatgtgttccttaagatttccatttgtgagagtcaattgttgtttcttttgtggcctagtgcataatcagttttgaggcttcaccacatttgaaaggcaatatagtgcaatgattaagagtgtagtaactaatgccagatagtagagagggtaggagcagggaggatcaacactaggatgattggggaagggtgatgtgaagtccagctctgccactgcatacatgtagaggtggggcaagccttgtttcttccctgtaaaatgacggtattaataatggtgctgccagcaggctgatacaggttcttgtccttgccccagaaaagaatttgaaggccagaccaaagtgaaagtacagaagattgattgcagagcaaaagcaaatacacactcaagagaggattgcaagtatgctcaaaagaatgagccatgcccaacctggccagagctcacatgctatatggataagcataatgaagtcatggaatattacataataagaggagagattggctgggtgcggtggctcaggcctgtaatcccagtactttgggaagctgaggcaggcggatcacctgaggtcaggagttcaagaccagcctggccaacatggtgaaaccacatctctactgaaaaatacaaaaattagctgggcgtggtggcaggcacctgtaatcccagctactcaggaggctgaggcagggagaattgcttgaaaacaggagatgaaggttgtagtgagccgatatcgcaccactgcactccagcctgggcaacagagtgagactccatctcaaaaaaaaaaaaaaaaagtgggggtggagcagggaagggattttctgggtaatgagtgggcaattcccagttggggtgccagcattttcttaactaaatatggttaatttggaactgctgtggtgtcaggtccgtgatgggagtgggaggtttccccagggaagttttatggtaataggggcataatgtagcccctatttgaaaacttcaaatttgtcgtcctacagaaatcatctaaatgtgtaaaaacaatccagtactttaggaacacagaccatgatataattgcttgaatttaaaagtctcctaaggttaaaatatttagttgtgattacctttcttttggtgttattgaggtataattgtataaattgaaggtgtaaaacatgatgatttcatatatgtttatattgtgaaatgattaccacaatgaagttagttaacatatccatcatgtcacatagttaccattgcgtgtgtgtgatgagaatatttaagatctactctctcagcaaatttcaaatatgtaatacattattgttaactatagtttccatactacacattaaatacccagaacttatccatcttataactgaaagtctgtgccctttaaccaacatttccccattcctccgacttccaagcttttggcaactgctatttgaccctctgtttctatgattcaacttttttagattcctcggtctgaatctaatctaccaatgggcttgtcatacatggcctttatggtatatttcatttatacccaatttgttaaatgttttttatcatgaaaggatgctgaagttttcaaatcctttttctgtgtctattaaaatgttcatatgatttttgtccttcattctgttaacgttgcacaacaccattattgatttacatgttgcatcatccttgcatcccagggataaatcccacttgatcatagtaagtgatcattttagtgtactgttgaatttggtttggtttggtagtattttgttgagaattgttgcatctatgtatatctggagaaatggcctgtaattttttttttcttgtagtatactaatctggcttaggtatcaaggtaatgctcataaaattagtttggaactgttccttgctcttaatttttttttttggaagagttttagaaggattggtattagtttcttcttaaatgcttggtagaattcactagcatagccaactggtttttctttaatggaaagttgtttacttattcaatctttttactcattattggtctgttcagattatctgctttttcaggattcagttttgatagattgtgtatttctaggactttatctattttttctaggctatacaatttgttgatgtataattgttcatagtaatctcacgattctttgcattatcatgttatcagttgtaatgtttcctctgtcatttataagtttatttatttgagacttgtctcttttttaacttggttagtttagtgaaagagttgctaattttgtttatcttttcaaagaacaagttctgagttttgttgatcttttctattgttttcctattacctatttatttctgctctaatctacattattttctcccttctgctgctaactttgagtttaccttatctttcttcatcaactgtaaagctaaatggtttaagatttttctccctaatgtaggtgtttatagctataaacttgcctcttagaattgctcttcctgcatctcattaagttttgctatgttgtgttttcatttttgtttgcctcaggatatttatgttacctttttggcttcttctttgatctattggttattcaggaatgtgttgtttaatgtccttacattatatattccgtacagaagttatgaattcttcaaatttcctcctgttatggatttctagtttcataatattgtggccaggaaagacacttgatatgatttcactcttgaatttgttaagacttcttttgtggcctaacatatgatttttttcctggagaatgtttcatatacactggagtagaatgtgtattctgctgctgttgaatgaagtgttctatatatgtttgttaggtctatttgatctaaagtctggttcaagatcaatgtttccttatatttttctgtctgattgatctatgattattgacagtggagtattacagtctcctactaacattgtattgctgtttctttcttttttcagttctgttagtatttgctttagttatttagatgttgcagtgctgtatgcaaaaatatttacagttgttgtatcctcttgatgaactgtcccctttatctttatatattgatcttctgtatctcttgtggccattttttacttaatgtatatttcatttggtataaatatagtcacctctgctgtcttttggtcactttttgcatggaatatcttttttcatcccttcaccttcagcctacctgtgttcttagagctaaaaggagtctctctctctctttttttttcctttggcagagtctcactctgtcacccaggttggagtgcagtggtgctatctcggcttattgcaacctctgcctcccgggttcaagcaattctcctgcctcagcctcccgagtagctgggattacaggtacctgccaccacacccggctaatttttatatttttagtagagacggggtttcactatgttggccaggctggtctcgagctcccgacctcaagtgatcatccgcctgggccttccaaagtgctgggattacaggtgtgagccactgcgcccaacctaaaatgagactcttctatgcagcagattgtttgatattgtggggttttttttaatccattcagtcactctatttcttttgattagagaatttaattcatttattgataggtaagaacttactattgccactttgctaattgtgttctgacagctttgtagtactttttttctttctttttttcttgttgccttcctttgtgatttgatcacttttgaaatgatatactttgattcctttctcttaatcttatctactacaggtttctacttagtggttactatgaggcttacataaaatattttatagctataccatcctattttaagccaacaacttcaaacacatacaaaactctacacttttacttctcccctccctcacatttcagtcaattgatgttacaatttacatactttttatattctgtctccaataacaaattactatattagtacattctcacactgctctaaagaactacctgaggccagctgcagtggctcacgcctgtaatcccagcactttgagaggccgaggtgggtggatcacttgaggtcaggagtttgagatcagcctggccaacatagtgaaaccctgtctctactaaaactacaaaaattagccaggcgtggtggcatgtgcctgtagtcccagctactcgggaggctgagacaggagaatcacttaaacccaggaggcagtgagccaagatagcaccattgcactccagcctggttgacagagcaaaagcaagactctgtctcaaaaaaaataaataaataaaaaataaaatagaagtacctgagactgtgtaatttataaagaaaagaggtttaattgactcagttccacaggctgtacaggaggcatggctggggaggcctcagaaaacttacaatcatggtggaagggcgaaggggaagcaagcacgtcttcaaatggtgacagaagagaaagagactgaagggagaagtgctacacacttttttttttttttgagacggagtctcgctctgtcgcccaggctggagtgcggtggcgcgatctcagctcactgcaaactccacctcccaggttcatgccattctcctgcctcagcctcccgagtagctgggactacaggcgcccgccaccacacccagctatttttttgtatttttagtagagacagggtttcactgtgttagccaggatggtctcgatctcctgacctcatgatccacccacctcggcctcccaaagtgctgggattacaggcgtgagccaccacgcctggccgagaagtgctacacacttttaaactagatctcataagaactcactgtcacaagaacagcaagggggaaatgcacccccatgatccagttcctcccaccagggccctcccccaacactggggattacaattcaacatgagatttcagtggggacatggagccaactatattaattgctatagatataattatttttaatagtttgttttttaacttttataccagaattgaaagtgacttatgcacaatcattacaatattagagatttctgactttgactgtatatttacctttactggtaagattttgtatatttatatattgttatgctgtgaattagtaccatctcatttcagcttgaagaacccctctagcatttcttgcaagacaggtctagtgatgatggattcctttagcttttgtttgtttggaaaggtttttatctctccttcacttctgaaggacagctttaccaggtataacattcttggtcagtagagtttctattctttcagcattttgaacatatcaccctaatctctcctgggctgagaggaggaggtttctgccgagaaatttgctgctagtcttatgagagctctcttatatgtaatgagttatattttccttgctgctttcaaaatattgtctttatcttttgataatttaattataatatttcttgatgtcaaattttattgttcagtctgcttgggcacctttcagcccagtgaatctagatgttcatttctctccccaaatgtggaaagtttccagccattacttctctaaatgtactttctgttcattttctctctcttttctccttcagtaattcccataatttgtatgttgttttacttgatggtgtcccataaatcccataggctttttttaattcatttttattctttgctatttttgctcctctgagtaaataatatcaaatgacctatctttgagttcacttagtctttcttctgcttgattgagtcatctgttaaagctctctattaaattcttccatccagtcattgtatttttcagatctaggatttctggctttttaaaaatggttcctgttcctttttggcattataattttgtttatatattgttttctaattttgttgagttgtctatctgtgtttacttatagttcactgaactttttaaagagaattattctgaattatatgtcagtaagttcacagattattatttctttagagtcagttattagagcatattcgtttattttagtgatattattttttcctgattctttatgatccatgcatcctatcattggtgtctgcacatttgaggaaacaataacctcttccaggctttataagtttgtttcggcagggaaagcccttcactagtcagtccagcctggagttctgggcaggtcagctggtagcatccatggacaggcagagcttgctgttgagatctccagctgggtcagatcattgcctgtgctctgaggttgggtaaggccactgctgctctctatggttgtttggatgttttgactggacccttttgttgggcagcggctaacggccaggctctaagatgggacaaggccttaagctactgttaggtatggtcacaggctgggctctgtgattaggcagggttgaagactgtgttccacagttgggtgttgccactggattagttattctccagagtagggccactggctgtgcttcaaactttatcagagttgctaccaggtgcccaggttcagtgggaccacagaatatgcccctcccttaggtccttgctacaagctgggctcatcaggaaggtagcataaatttctggaatccctgttcaggcaaagctgcaagttgtgccccacagttcagaagtgtcactggctgggctgagtgattgggtaggaccacaggctacgttctacatttggacagggtgacttgttctactccctgcctgggcatggccataggctgggatctctggttgcttggggccccaaagctgtgcccaccattgagagaggtcattggcttggtttcctgcccatgcaggtcattggctgggctttgtgcctgggcagggtctcaatttggacttcctggttaacagggttagagaccatactctgtagttaggcagggtggctggcttgattacctgcctgggcaaagacatatgctaggatctgaggctgggcagaatttctttgggggttccctggtcaggcaagacagaaacctaaacgtcttaggtgggctgggctgctggctaggcacccaagctacttagaactgctgaccatgctacctggccaaatagggccaccagcttgcctctgcaggtggacagagctgctggctgagctctctgatagggtgctgatgtcaggagcacagtaccagcatgacaatctctgcattggccactgtgagccctgccctcacttcttcatttctaatcaaacccaggtggtccagcccctctgatttcctgtttgtttcccatgaggcaagacagaattgggcctcctaagaagcagcccagaatgccagggaagctgggtgtcctcctcaggctctgttttccccactggagaaaccttaggctcagggaaaacctcttggtgtggtgctgtgccagcctggggtaggagcaacacagtcaaagtgaatccattcctcttaccccttctaatgtggtttttctcaggttttgtggtccaagggaggtggttcagcttcactcttgggttctgaaattttcacaaaggcatccttgtctatggatagttgctacttagtctttctgtgagagagactaaagccagaaacctcctattctgccatcttagtgacatcccatcctggatgtgccttttaaatctaaggttctagcttcagctctggaagactatttttttttacttgatttccctattctctttctttctattctcttctggaattccccttggcagaatgttgaaacatcctatgcagtttaaccttcttttttcacattttccatatctttccctgcctatattccagaaagaaaaatgtggctcactaagttactcttcaactgagtctattctgcacacccacctttattttttaacagctttaatgaggtataatttacatactgtaaaattctcctgttttaagtgtgtatctcaatgatttttaacagaattacagagttgtgcaaccatcatcacaagccaagtgtagaatattttcactacccttaaaagcttcttcatgactatttgggatcaattcctgctcctattctccagccctaggcaaccatcaatatactttctatctctgtagttttccctttcctggccatttcatgtaaatggaccatatattatacggtcttttacatctgggttatttcatcgaacgtaatattttgaagttcatccatgttttagcatgtgtttatattttgttcctttttcttgctgaattgtattccattatatggctctatcaatggtattttttcatttgccagtcaatggaaatttggattgtttttattttttgactattatgaataatgctgtcctgggtatttgcatacaagcctttgtgtggatatacatgttcgtttctaggtagatatttaggagtgaaactattgggttctatagtagcattatgtttcacttttttcaaatctgtcttacagtgtttccgaaagaccattttacagcaatgtataagggttcaagttttgctaaaatttgttattttatgtctttgtagtcattccagtgaatgtattttggtattttgttgtggtttgatttgcttttctctaataatgaatgctactgaacatcttttcacatgtttttatttttcatatgtcttttggagaaatatctgttcaaatcatttgtccatttttaattggcttgtcttcttattgagttgtcagaattctttacatatctgaatacaagtagtttattaaaaatatgattggctaatattttctcccagactgtgactaatcttttctttctctttatggtatatttgaggcacaaaagatttaaattttgttaaattttaacatcatttattctcttatgattatacttttgtggtagctaattctttgtcttacctaaagtcacaaagatttttcctgtgttttcttccaaaagtcttatcatttttgctgttttacaagactactgcataatttgggaaacgcagtgaaaaatgaaaatggggggatccttgttcaaaaattattaaggatttcaaaacagtgaaagcagaacactaaactaagcacagagtcttttgtgactgcacaggatgcatgcccataaagccatccctgcttttacatttagagatgcatgatccattttgagttgatttatgcatatggtgtgaggtaagggtctaatttcatatttttgcatgtgcctatccagttatactagtactatttgttgaaaagactatcttttcctcatttaattgccttggcacttttgttgaaaatcaattgaccaaaaacctaaggatttatttctgcactctcagttctgttgtattgatttttatatatatttatgccagtactgtcttgattcatgcagctttatagtaagtgttgaaatcacaaagtataagtcttccaacttttttcttctttttcaagactgttttggatattctgggttctttgcaattccatgtaaattttaggatcagcttctcaatttctgcaaaaggccattggagattttgataggaatcatactgagtctctagatcaatttggagagaattaccatgttaaacatattgagtctttcaatccatgaacattggcatcactattttgatctttaatttctctcatcaatgttttgccattttcaacatacaagtcttgcattctgtttgttcaatttatttttaaatgttttattattttgcctacctttatttttgaatttgcaaactcgacttttaaattcctaagtttcctagttggttgaatattattcataacttattcaatattattgaataatattgacctaatattgagtcatagacttttgagtaagtatatttaataaccccataacttattaggtctcaatattattaaataagttatggggttattaaatatacttactcaaaatcttgttctgtttactgtattatttcttttctctgatattacctaaaaaatggtaaaagaaagatctgaagggacctggttagaaccctgaaactgtccactaagccagtgttgacacctggggtgtagtggttccatgccttccctaacatttattctgaattttatatacaaatgaaagacttttttagtttaatttatataaaaattagatcataatatattgatctaaacatgatgttttcactgaacaacaaaactatgactgtctatccaaattactagaattaaatagctatgtaatagttcaacagtgtatatttacaataatgtacttaaccagtcagctgaatacacaattaggttgttttcaggttgaggagtatgtgttattgttgaggggtttttgctggtaaaaacaatgcttcaacaaaaattttgcatttatgagcatctaatcaacaaatatttatggaacaccttgtatatatcagatactcaagaaaaatcagtggacaaaacagacaaaatctctgccctcatggcatatatatttttgggggaaaagagacaataaagaatatgataaacaataaatacacaaataagtaattcatttagcatgttagggagtagtaagggcatgagaaaaaaaaatagaggcagattaggagcttgggagtgtgggggcaggctaaggggattgtgattgtgatttttagataggttggtcaaagcaggcctcattgagaaggtgatagtgaagcaaggatctaaaagagacaagggagttagttcactacatagatatatgtgtctatgctaagtagagaaaatagccagtatcaagtccctaaggctagagaatctctggtgtagtcaagaaacagcagaggcgagtgtggcccgacagacatgagcaaaaggagaggagcaaaggatgtatcatttcagaccctttgaacagtgtaaggatctggctttcactcatgaagaaattgggagcattgaaagttctgcagttcttgtttttataagatggatgttgtctttttatttctatacgatagattccaaaagtggatctgcatggtcagtctgtagtatatcttaaaatttagtagatgttgccacatcttttctgaaaaggctgtagtaattcatgcttacaccagggatgagtaagtgtctgtttttctgaatcttctccctcgtgacatagtgtcactaatgaaattgtgtttgccaatctaatgggtgagaaatggtttctcattgatattttagtttttatgtattcatatgtttattagacattttcattttctcttatttaagctgcctgttcaggtccattttggaggagttatttgttgctttttattaatagactgtagtctttgcccattaatatcagatatattaaccctttgtcatatatattgaaaatgcttttctacactcttttatatctgtattgctttttaaaaacattttaacctattaagagaaatcttcctttaactattctcttctcaaatgttttttgtctgactcagatatttgttctgtcatttaaatatttacattatttgattcagctttttttccaacttttatttaagttcgggggtacatgtgcaggatatgcagatttgttacacaggcaaaagtgtgccatggtgattcgctgtgtgattcattccatcacacaggtgttaagacaagcattcactagctcttcttcctgatcctctccctcctcccagcccccaccctctgaaacacccaagtgtgcattgttcctcctgtgtccatgtgttctcatcatttagctcccacttataagtgagaacatgcagtcagcactattcacaatagcaaaaacatggaatcaacctaaatcgccatcaattatagactagagaaagaaaatgtggtacatatacactatgaaatactatgcagccataaaaaaggaatgagatcatgtcctttgcagggacatggatgaagctggaggccattatccttagcaaactaatgcaggaatattttatccagtttcaatggggttccaggttgcaagtgcactatacttacataataatttcagaataatggatgttttaaaactactaccttttttgtaattggaggcctttcataatctctgtttatttagatcttatttaattttcttcaataagatttttatagttttcttcatacaagtctcatacctttcagatgtttataaatacatacatttgtatttgctattgagtctgagtatttttttcaatgtatgtcgttccaaataaaagctataagttttatatatctattttctattcatactctcatatggttttgctgtgtccccacccaaaatctcatcttgaattgtaatccccgtaatctccaggtgttaagggagagaccagatggaggtaattgaatcatagggcaatttcacccattctgttctcatgataatgagtgagttctcatgagatctgatggtataagggcctcttccgccttcacctggcacttctccttcctgctgccttgtgaagaaggtgccttggttccccttcgccttccaccatgattgtaagtttcttgaggcctatccagccacactgaactgtaagtcaattaaacctctttcctttataaattacccagtctcgagcagttctttatagcagtgtgaaaatggactaatatatactccttggtaaattctttttctagttcttatgaattttattaggtctataggtttcctacatatataattatagaacatattgtacactattttagtattcctaccaattattttattttcatgtcctattgcattagctaaagcttctaaaatatgtatatgtgaacacatatgtatatgtgtatacacacacatatatgtgtatacacacacgcatatatgtgtatacacacaagtgtatacacacacgcatatatgtgtatacacacacatatatatgtgtatacacacacatatatatgtgtatacacacacacacatatatatgtaaaagaccgtggtaatggtagacatccccatattgttttctatttaaatgacttcaccattaatgtttactacaacatttgctgattttagagacttcattttgtgttagtttttatttcatagttttaatttttaaaaaataactgctaggacttatcaaattcccttttaaacccattcatgaataggtttaaatacgttttctccttttatttattggtataaaattgtagagactttctaaagttgaactatttttttgtttcattcaatctcattgtcattggttttctctttcttcttggttctaaataacctctaactacaagttttatttcatctttgatccaacacagtgcattttcttttgttttctaaaatcttaagtaatttattttctatatgaagtctgtttcacttctagtgattataactttttgtgacttcttttgtggctaagattatgctgaatattgatatatatttcaagggtattgagaaatatgtgttctctgttttttctttgttttttttgttttgttttgttttgttgttgttgttgtttgggacagagtcttgctctgtcacccaggctggagtgcagaggctcactgcatcctccacctcccaggttcaagcaattctcctgcctcagcctcccgagtagctgggattacaggcatgcaccaccatgcctggctaatttttgtatttttagtgagatggggtttcactatgttggtcaggctggtcttgaactcctgacctcgtgatccgcccgcctcagcctcctaaagctctgggattacaggcatgagccactgcgcccagccgtgttctctgtttttaagtcacaagattaaatattaaatcactcattaatttatccagagcctgtatactttgtccatttttgtatatgtaaagaatcaaaaaacaggggtgaattgtttttcaatgcctgtaaaacatttgtctcatgatttgtttcttgaattttgatttgacattaaatgggaacagtcttgctttttgttttatttacagttgcataccataacttgctgattttcaatttcaacattttttgtgtcattttttcttagttgtgtctttagttggattctctttgattccagtcaatatcgatatcatcaatattgatgattctttttcaatattattaatattgcctttcaatatcatttttcttttacattctgtttaaataatttttcatactttttccattttgtctttatttcatttcagtagttttgggggaacaggtggttttggttacatggataagttcattagtggtgatttctgagattttggtgcatctgtcacccaagcagtgtacactgaactcaatgtgtattcttttatctgtcactcccctcccaccctttcccctgagtccccaaggtccattgtatcattcttatgcctttgcattctcatagcttaactcccactaataagtgagaacataacgatacttggttccattcctgagttgcttcacttagaataatggtctccaactccatccaggatgctgagaacgccattattgcattcctttttatggctgagtagtactccatggtgtatatatatatatacacacacacacacacacacacacacacacacacacacacacatatgggatatatatatgtgtatacatgtatatgtgtatatatacatatatatatcacatttctttatctactcattgattagtgggcatttaggcttgttccacattttctcaattgctaattgtgctgctataaacgcgtgtgcaaatgtctttttcatatcatgacttattttcctctaggtagagacccagtagtgggattgctggatcaaatgatagttctttaaggaatctttatactgttttccacagcagttgtaatagtttacattcccaccagcagtgtaaaagtgttcccttttcaccacatccacgccaacatctatcatgtttttattttttaattatggtctttcttgcagaagtaaggtggtatcgcattgtggttttgatttgcatttccctgataattagtgatgttgagaattttttcatatatttcttggccatttgcatatcttcttttgagaattgtctattcatatcctttgcccactttttgataagattatctgaattttttcttgctgatttgtttgagttatttatagattctggaatttttgcttagtcttgctttggcaatgtgggcccttttttgattccatatgaattttaggattgttttttctagttctgtgaataatgatgatggtgttttgatgggaattgcattgaatctgtagattgcttttgggcagtatgatcattttcacaatattgattttacccatccatgagcatggaatgtgtttccatttgcttgtggcatctgtgatttctttcagcagtgttttgtagttctcctcatagagatctttcacctccttggttaggtatatcctaaggttttttggatttttgttgttgttgttgttgttgttgttttgctttgtttttgtggtttattttttatttatttatttttttgcagctgttgtaaaagggatttgatttgattctcagcttgatcattgttggtgtatagcagtgctacttatgattttgtatcctgaaacttaactgaattcatttatcagatctatatcttaggatactaatcatatcattggtgaacagtgactcaagtttgacttcctctttaccgattaggatgccctttatttctttcttttgtctgactgctcgggctaggacttcctgttttatcttttacaactcattgtttcccttgttttatctctctaaaaatgcaaactatgtctgctttttatttttattttcagtgttacataaggttttataaggtctgatttcactcaatcagtagttattttcaaatcttttcgaaaggaaagaaggaaggaaggaaagaaagacgcaggaatatgtataaaggtatagcaaacatcacacttaatggtgctgctaagtgcttcttccttgaaattggaaataaggcaaggaagtccactctcatcacttctcttcaacattgtattcaaactcctaaccagtgaaatgagaccaaaaaatagaaataattgtttggaaagaaacagtaagtcagtctatttgttcatgatataattattttctttaaaatacaaaggaaatctataaataatttactagaaatactacatgaatttagcaatgccataaattcatggttaatatgtttcaaaccaattatattttcatataatagtaataaggaatttgaaaagcattatcatttaaagtaacaccaaaacaataaaataactaggaataaatttattattttttaaatttaattaaattaaattttttatttcaataggtttttggagaggaataaatttaatgaaagatgtacatgacttctaaaaactataagcagtgctgggtaaaattaaacacatgtaagtaaatggagagatatacaatgttaacagattggaagctcaatgttgttgtcatctcccccaaatttatctgtagcttcaattcaaatccaaaaaaaagtcctaaagttttttcttgaagaaattgacaaactgatttgaaaagataatgtataaaagcaaagaatctagaaaatccaagccaatcttttctaattgacttcaagacttttgttaagccatgatatttaaggcaaaatcttaccagcataagggtagacaaatagatcaatggtatagcatagaaagtacatatataaacccatgctaatattgtaaattgttttttgaatattttcatgaccttggagtaggcaaatatttcttagatagtacactaaagtcattaattataaaagaaaaaaaaataaattggatttcatcaaaattacagatttcttcccatcaaaagacatgattaagaaaatgaaagagaagctacagactgggtgaaaatattcaccatacataaatcagacaaaacacttctatccataatatatttaaaaaatgcctacccatcaataagtaaaattgaataatataaatgggccaaagacttgaacagacactttacaaaaaataaattgccaattaacacatgaaaatgtgcttgacatcattttatcattaaagaaatacaaattaaaacgaaaatgacatatcacatcacacacactggaatggctaaaactagaaaggctatctctgatagtctttgaaaaacagtttggcaggttcttaaatggttaaatgtactcttacacaatgaccaagcaattccactgctacatatttatgcaagataagtgaaaacatcttgccacaaaaagacttgtacaagagcagcaattttatttatactagtctcaaagtggaatcaactccaatgaccatgaacagaaaactgaataagcagattgtggtatattcacacaatggaatgccactcaacaacaaaaatgaacaaactactgttcaacacatcaacatgaatgataagcaaaagaaggcagacacaaaagcatatataccttttatcccatttatacaaaatccagtagcgggcagtattaagatacgatggaaaaaatgacagcagtggttgccctgagagactgcctggttgcatatggtcaggatgtgggttgacgggcagggcacacactgttctgttcatttctcaaataacacatcagtttttggctctgtgtctcccttcaaatctccattgtttcttacaaattctgtagggcaccatgattcctaacctctgaaagcatccatcccctatctgctattgcaactagcacttttctgaccacttttcaccttcaagattttacttgaaatctcttatctgctcattgtcctctgccattctctttgtcattgtgaatctaattcctttgttatcattttagtgatctttaaccagaaactttttttacagaaattcaaaacaataatgtaacattattgtttcctgcctcatgttagatactggacagtgccaataattctcttctagttgggaaggaagggctcataaattttcataatattaagaaatactgagatgttgactaaaacattatcagagcaataaagtaatcaactaagaaccagaattagagattcaactttaaaattactttcataggaaacggcaacaatttctgaaattcagatgcctaaaatgattcaccatatatagcaataatacagagagattgatattaatacaaagtagaatcaggcattctaggagatatcattcatattctcatgaaattctcaataatgtggtctcattattattattaaactgcattgtattatttgtgaattaatgatgtaggattatatttctttcttaacagctacagattagagaaggacatgttattttcatctttctcagatttgttttctctcagttgattaagatgcatattcaaggttagattttatttttattccattgtttttcatttctctgtggatgacctgtttattccacctagattctgtaggaatttaatttttatttcaaaaaatattccatatatggttaggtgaaggtatctttacaatggctttgttcagtttagacagaactttttcagtcctctatattagtttttcacaacctccatttcttctattacatcttttttgttgcttcaattgcatttattctggcctctactgaggaccacctaatttatatatgttcattctttgtagcttgtcctttatatgtaaactcttacagcctccacaaacatctcagaatcttgatgaccattttcacatggtgtcctttttccctaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagtaagtaaagtttattatgtcacaatctggtaaagcagccccaaaataagttatgctttgatatcctagaccaaaacttcagggtacaatttgctaactgacaggtctcctatgagtggggaactttttcaagtgtttctgtaagtgctcctgtaaagtagaaaaggagaggagaagcagaggtcgccggagatggtcccacttccagccgaggaaatggtgttccatggtgtcctctggagttggagtgaatggtactggagaaactggaacggaaacaggtgttctccataaatgtacaatgttttgtagaattcgtacactataacataaactaaaacttaaaaataattttaatgaagtgatttacttgaaatagcagttgacacagcattttcttccagttaacatcaatttaaaatgcctagatctgggaacattaaaacccacagggaattgatgtctagagaggacaaatttggaggtagatgcttgttattctttctccaacacatttgttttctttttctttccttttttttgtgcatttctggagtcttggaatatgggtaaattccacccataggccctgttggagatacagagcagcgagtcatctctggctatgaatatgcttcctctgtggccaagttcacagcaaggggagactggttgcctggtttccttgggcccttcaggccaaatcagtcttgggggaagagcaggggttgtccagccaacaaaacagccactcatcaattgcctgctacgtctatcctaaaaacatatggatcaggctattaaaggactttgagcccacttttatccttccaaatttcccctttttgcatctaatgtaaatgagggtgaagcaatcaggctcatcagtgggcatttttaaggacaagggacttacttctttcattactggctatacaaataagtaaaaattatagaacctcacatgaaaatacctacgtagagaaattagaatacagtaaccatagaattcctttctagagctcttctgtgacttggaagtctttatttatattttctccattcaatattttttaaggattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatggtaattagatttattatctacctttttatttccagggccaagttttttcaataagtatatactgatctcctaccatgagtgacatgttgtgttgggcagtgggcatagagtagttaacaaaatagacatgccatgagtcttctcttagctcatggcgtatggctatggtaaaacaagtacccggaggtctgcttcactggccacttagactcacaggacaaccagagccacactggcatcagatttacttagaagagtataggataagaaacagaatcccaacagggcagcttcttatcttcagtgggagcccttgcagtggtctacatagcatccaccaaattgactactacctgccctgagtgacagcttagctgtgggtgcaggatccaccttggctcagcaccacatgcctgtgggagtgtatgtctcttgtaacaactccacagtcacagctttcaggatgccctaagaggcaagctgagttacaagagttatcaattgaaggaagaccacaactatggcttccccacaggtatttattgtccatatatagtcccagtcaacctgtcatgggtcatttctaacctcagtgtttgcctagtaacactgcaaaaaaggctacctttattaggtttccagaatatgagcaagaaagttaaccctgggtcaagtttgccttcagtgaagcagaagtggttttgctaaccctttatccacaaggggtgaaacaaagattgacaaaactgattactctgccagggactatttttggtgctataccaaactaaaggtttcattcttgacctttttcctgagaatgcataatttatactattaaaatggtacacgttaaagacgtcctccaattttttttacttgcctggaaaactttttattcccacacagtttaatctcaacccagttctccaaataagagatagagacatcacaagaaaaatgggcacatgctctgaagatggtggatgctatgggaactggaataaaagtgtgaaaacatgtctgcaaaacagggcaaattagatttggctaaatctgagagtgagaagcagtatacaagttgacttagatcaattggaggaagatattgaaaggcctggaatttaaagttaaggaatttgaagtttactcgctaggcaatcaagaaatactgcaggtttataaacaaggaaagaagtgtaagcagtagttgtatatggcttattgatttgtgtcaatactaaccttatctaaattaataataaaataatttctatagcaaaaattcaagtcagaaaaggaataaaaggaaatcaaatacctgggcacaaattttgagtcaatgttatgtttgtaagcaggatggtccaggctgcggggatgaagggaatggtgctacctttactgcccacattctcaggggctctgttcctctccatggactgcagggatcccccttcctagctccagtgcccacaactcacgtcttagtttctggcgctccttgtgcttgggtgacctgccctgaggctcactgtcactgacctgggacagcaccgcccaccgccccacccagcacagcaagcccacccaccatcagggagatgctgctgactctcggaccctgaagtccacacaagctgcccctgtgtcctctgttatgtttatttgagaactgttcatcctccctgacccaattaagacaacattctcctgtttctagcctcatctttaaagatgttgaggtttttctcatttattttttatttatttatgttttttgagacagttccaatctgttgcccaggctggagtgcagtggcataatctcagctcactgcagccccagcctcctgggctctagtgatcctcccccctcagcctcttgagtagctgggaccataggtgtgcaacaccacatccagctaattttatttttcttttcaaagatgaggtccagctatgtggcccaggctggtctcaaaatcctgggctcaagcaatcctcctgcatcggcctcccaaagtgctgtgattacaggtgtgagccactgcacgtggctgattttctgtgattacaggtgtgagccactgcacctggctgattataaaaaagtggaatctctctaggacttgagaccttctccccagggaattccccagtttcttccttacacttgatatatgcctaccctgccatctgacaattttgagggtaacacagctcacaatgtttccattactcctttatccttaaatcttgaatgtctcctttttgtgtaggacaataaagccttcactgttggggtcttctcttctctgtcccaggggatgacgggagaactttaggtcatgtggaaccctctgagctctgagtcacccaagggctggaaattcctaaaagcatgatttccagacattgtccctggtccctgtagatctctaattgcttcttctctctcccactcttcagtaatccatgacaaattgcctctccaagaaagtgaagaagaagagagggaggagaggtctggcctccaactaagtcttgaacaaggtaaaaatgacagaataaaagcttttttctaagagaggttagggatccaaggttctgagtggagattgtgaatcagggaagacatatggaaggactatggagaagtcaaggagagagttatatgagcttctaaccaggtgcagggtcctggagaagtggccatgacaaggcatagttggctcaataaccatgagggaatcagaaccaagcgtgtcagtaggccagatttacagatgccgactacctagaagtaattgtaatttagaaaggtccctgtaggggatcagtgtgaagttgcaaagggttaagaaccacagcccgtggcccgtggtcaacatcaaagaggagacccctggggaaagaaaggctcctgttttacctgtactgtcatattcacaacacttctgacaccaaacatgtcggtgatctccccacatcagtcagttctccaattctctgtagataccatctgatatcttataatttaattgaattctggcactaattgcccagacttggcacagactccgcaggttaagggctcattcccataagaatgccccccacttcagatgccagttgcaagtctcaggttgtggcctgtgcctgtaaattggaggttcccgcaagcccttcattggctttcatactttcctagtagatcacacagatctcatggaaatgttgacttatatttgacatttattataaaggatacaactcaagaagagccaagtggaagaaatgcatagggcaaagcgtggggaagggcacagagcttctgccctctctgggacacgactctcctggcacttccatgtgtttgccaacccagaagatttctgaacccagtcacttagggttctttatggacattccattatacagcctggattgattaaatcattggcacctgattattaagttaacctccatccctcctctcccctccctggaggtcaagaggtggagctgaaagttccacccctctaatctcatgttcagctcccctggcaaccacaccccaatccttaggggctttccaaaagttacctcattaacataaacccaggtgtggtcgaaaaggggttgttatgaataacagaaagtgctcttttcacttgttatgacttaagatgttttagggttttaggagctctggccaggagcagggaattaagactgaaatgtatatttcttatatcacgggagaaacttggtgatggcagaagaggggacaaatttaaatgtgaggatgttgttcaagagcaggaatattcaaagagaaaggcggtcatgtagagagactcagaaaggaagtgatgcacatgggaagaggatgtaagtacctagaggacaaaggaagggaaatgaaaccgtgaaaaggggtaaaagacaacaaaaataaccttgtcattaacagctcactttgattgaacatctactctgtggcggttggtttaatgctcatgacagccattggagattaatattacttatatgcctattttgcagataaggtaactgaaatccagagataccacaaatggagtttacatagggtcagatgaataaggaaaaacccagatgttctaccccagagcctgcattcctaaccctgtgctatccaggcaatctaaaaaaataaaaacagaaaaatgaaacaaaaatgaggaaatatttgcagacaaaaagatccagaaaaaaagaataccaagagctggaggaagtagaggctactcagacactgagtcctcatggaaaagccaatgagaaagcatgaacagatgtggagagggagggtgttgtgtgaaagggggtgggcatgaggcaaccaggacttcaaagaaactgagctaagggccctgggcagggtagctctggggacaaaggcaggatcactctgccatcatcacttaccagagtgtctcacagaggacacgcagcagagttgtctggccaaggcccctgtcatccaggggtgcagctgacccagtcccctactctcaaggctggagtctgacttcagtaattaggtagcatctgccagctccaggtggcctttgcattgagacctagaaggggtctttaactcctacgttacagagaccaaaaagggattaggggagaatggcaaaatccatacctcgatttctgaaataaacttctaatttcttcctgccaggaactggtgaaaactcttttcgaagcctgacttggccaccttcgggttccccatctcatgctggtttgttcctgtttactactctttgagcctctgctattcttgcccctttctggaatgtgctgtggggttgcctctttgtgttaatgattgtccagaattttcaggttttacatctacagtttttccatttctgggatttaaataacaagtccttatcctctaggttgcctaggagggtttcttcctcccacaccccttaatcacacttgctgctggttcctgctgccgctgagcctggtcgttttacccatgtgcctgcttcaccattttctgcctgcatctgcttgaatctggctgttgccttggtgccttgaccttacgtccatcagtggcccgtgctgtagtggttggaggggagtgacaggcagcagagggcaaataaaatacctgtgaatcaaaccatggtttaggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacaggtaagactgactgggttggcatgaatggggaggagccaaggggccctggctggtggcagaggaagagtctaatgcacaatacaaggagacacctgtttaacaagcaggggaaaatcacatagacacagagggggcctgttatacagatgagcctgatacactgacatactgatgacaaagacctggaggaagaaagctagaagcaaaaaactgagagagaaaggggaagagttgcagagtctcaccaaagaagagagacaaacaaaaggcaaaaggagaaagtaagagagagattggacaggaatcaatgaagcacgaacaccttcacgcagcaatatatgcagacaggggtataagtagaaacaggagaagaaaggagaagcagggtgaggtctaaccaaatggaaacaggacagagcaaggctctactggatctcagctgtgatctcgtttatctccagagtcctgcgaacaaattgctgtccaagtgaataatggggatgctggaagggagatgccctgcccgttgccctgtgatgaagaaagtaattattgcttaccttgcctattttctttcctttcttattcagatgctatacatttggttggttggttggttggttgttgttttaccatcgtaaccactttttaaaattaccagattaaaagctggatgtatttatcattacatgttgttttgaaatatgtacacattgtgaaaaggctaattagagctaattagcataaatattacctcacgtacttatcatttttgtggtgataacacaaaacctattctctcagtaatttttaagaatacattattaactatattaatcgtgttgtataaaagatctcttaatgtatttctcttatttaactaaaattttgtatcctttgaccaacatctccccagtcctcttcctcatatccccagcctctgttaccaccatatactctcaacttctataaattcatcttttttacactctacatataagtgagatgtcatatatgtctttccatgcctgtcttattttacataacataatatcctccaggttcatggttgttgttgcaaataacaggatttcttccttttcaaaggctagatagtatttcagtgtgtagatgtatttcattgtgtatatattttctttatccattcacccactgatgggtacttaggttgtttctgtatcttggctattgtgaatactgctgcaatgaacatgggagagcagatatctcttccatatacagatggtccctgatttatgatggttagacatatgattttcaactttacaatgggtttattgaagtattaaatgcatttttgacttatgatgtgttcaatttatggtaggtttatggaaatgtagtcccatcgtaacgctaggagcatctgtactgatttcatatccttcgaatatatattcagtagcgaaattcatggattgtatgggtagttctactttttatttatttgaggacactccatactgtttttcttagtgattgtagcaatttacattcccaccaacagtgtacaaaggttcccttttctgcacatcctcaccaacatttgttatctttagtctttttgataataaccattctaaccagtatgtggtgatgttcattgtggttttagtttgcattttcttgatgatatctgaggcagggcattttttcacatacctgttagccatttgcatgtgttcccttaagaaatgtttattcaggtcctttgcccatttaaaaatctgtttgtttgtttgtttgtatttaatattgagttgtttgagctccttatgtattttggataataatccttatcagacacatggtttgcaaatattttttcccattctgtaggttgtctcttcactctgttgattgtttccttgcctatgcagaagctttttagtttgatgtaatcccagttctttttgcttttgtgattgtgcttctggtgttatacccaaaaaatatttgctcagaccaatgtcgtgaagcttttcctctatattttcttctagtagttttacaaccttgggtattaaatttcagtatttagtccattttgagtttttaatatggcatgagatggggtcaaatttcattcttctgcatgtggatatccagttgtcccaacaccatttattaaagagatagatatcctttacccattgcatattcttggcacctttgttgaaaatcaattgaccataaatgcatggatccaagctctctattttgttccatttttctacatgtctattttatgcaagcaccatgctcttttgattaacatagctttgctgtatatattgaatcaggtagtgtgatgctttcagctttgttctttttgtttaaaattcctttggctagttggagtcttttgtgcctccacacaaatttttaaattgtttttctatttctcaaaaatgccatttgaattttttttttttttgagatggagttttgctcttgttgcccaggctggagtgtaatggtgcaatctcagctcactgcaacctctacctcacagattcaagtaattatcctgcctcagcctcctgagtagctgggattacaggcatactccaccacgcccagctaattttttgtatttagtagagacaaggtttcaccatgttggtcgggctggtcttgaactcctgacctcaggcgatccacccacctcaaactcctagatgctgggattacaggcgtgagccactgcacctggccgccattggaatttttataggtattgcactgaatctttagaggacttcgagttgtctggacattttaacaatattaattcctccaatccatgaacatggggtatcttttcatttctttcttcttcagtttctttcatcaatgccttagcattttcagtgtgtgcatatttcacctccttagttaaatttattcttaagtattttgttgcagttattgtaaattggattgttttcttgatatgtttttcagagagtttattgttagtgcatagaaatgcaactgatttttgtatgttgcgtttgtatcctgccactttactgaatttgtttattagttctagcagtttttttttttttttttttggtggagtcttcgggattttgtatatataagatcaggtcatctgcaaataaggacaatttaaaacttcttcctttccaatttgaatgccttttatttcttttgcctgcctaattgttctggctaggacttgcagtaacatgttgaatagaagtgagaatgggcaatctgtattggtccatcctcacactgctaataaaagactggataatttataaaggaaaggggtttaattgactcaagagttcagcatggctggagaggcctcaggaaacttacgatcatggcagaaaaggggaagcaaacacgtccttctttacatggcagcagcaaggagaagtacagtgcaaaggggggacaagttccttataaaaccatcagatcttgtgagaactcactcactgttgtgagaacagcattgaggtaactgcccccatgactcaattacctcccactaagtccttcccatgacatgtgggggttatgggaactacaattcaagatgagtttgggtggggacacagcaagaccatatcagcatcctactcttgtttctaaccttagagggaaatctttcagttttttgtcattaagtatggtactagctgtgggcttgtcatgtatggccactattgtcctgagatacatttcttctatatctattttgctgagagtttttatcatgaaaaaatgttgaattttgtcaaatgcttttcctacatctattgagatgatcatatggtttttgtccttcattctattaatgtggtgtatgaccctttagatatgtatatgttaaaccattcttgcatcccagtgataaatcttatttgatcatggtgtttaatgtgctactgaatttgatagtattttattgaggatttttcatatacgtttatcaaggatagtggcctataattttcttttcttgtagtgttcatgtctagctttggtatcagggtaatgctggcttcataaaatgagtttggaagtagtccctcttattcaatttttaagaagagtttgaaaaagattgctatttgttccttaaatatttggtagaattcaacagtgaaaccatctggtcctgaacttttgtttggtgggtggtattttattatggattaaatcttactcattattggtctgttcagattttcctgtttctttgttattcagtcttggtaggctgtgtgtgtttaggaatttatccatttcttctaggttatccaatttgttggcattaaattgtttatagcagtgtcttatgattctttgtatatatgtggtatgagaaaggtagtgtctcctctttcatttctgattttattcatttgagtgttttctcttttttcttagtctagctaaagctttctcaattttgtttattttttcaaaaagccagtgctttgttttgttgatctcatttttttctagttttgaactcatttatttctgatctgatatttattgtttccttctttctgctaatttttgccttagtttttcttctttgtctggtttcttgaggtgtaacattaggttgtttgagatctttcttctttctttatgtattcttgtgtttattgctataaacttcccctcttgtaactgcttttgctatatcccgtaagttttgatatgttacatttctatcttcatttgtctcaagatttaaaaaattttttccctttaatttcttcattgacccattggttatttgggagtgtacttaatttccatgtatttgcaaatttttcaaaattcctcgttattgatttctaatttcatatcattgtggtcagaaagtatatctgatataacttcagccttctttactttgttaaaacttgttttgtagcctaacatatgatgtatcctgtagaatgtctcatgtacaattgagaagaatggtacttttctgcttgtagataaaatattctatatatgccttttaggtcctcttggtctaaagtatagtttaagtttgatgtgttcttattgattttctccctggacaatctgtccactgctgaaggtagggtgttgaagtcccctagtattattgtattagtctctctttccttcagatctattaatatttgttttatatatttagttgctcaaatattgggtgcatatgtttacaattgttatatcatcttgataagttgactccttcatcattacataatgaccttcttattttctttctttctttttgtttcttttgttttttgttttagtttttgttttggagacagggtcttgctctgtcacccagactggagtgcactagtgcaatcatggctcgctgcagcctcaacctcctgggctcaggcaatccccccaagtagctgagatgacaggcatgtaccatcacatctgactaaatttttttagttatttatagagacaggattgccttatgttgcccaggcaggtctcaaacttctgggctcaagcaatactttcacctcagcctcccaaagtgttgggattacagatgtaagccaccatgcctggttttatcatgaccttttttgccttgttttatattatttgattcaaactgtatctcatctgacgtaagtacacctgtgctttctttctttcatttccatttgcatgaaatatctttttctatcttttcactttcagtctatgtgtttccttaaaagtgaagtgagtgtcttgcaagccacatatacttggttcatgatttttaaattcattcagccactctatgtcttttgattggagaatttaatttatttacacttaatataattactgataggtaagtactttctaaaaccattttgtttattgttttctggttgtctgtagattctttattcctttctttctctcttactgtcttcctttgtgattaggtgattttctctagtgatacactttgattcctctttatcttttgtgtaatcactgtaagtttttgctttgtggttaacatgaagtttacacaaaacatcttataacaggctattttaagctgataacaacttaattttgattgcctacaaaaactgcacttttactttgctccctcatttaaaatgtttgatgtcagagtttacaagttttatatagtgtatactctaaaaaattattgtagctactattttttgactatatatttactttaccagttagttttatactttcttatatttttatattattagttagcatttacttctttcagcttgagcatttcttgtaagacaggtctggtggtaatgaatgtattcatcttttgttttcccgggacggtctttatctctcctttatttctgaaagacagctttgccaagaaaagtattcttggttgtcaggtttctttttcttcctttggcactttgaatgtttcatctcattctctccttatctgtaaggtttgtgctaaaaagtccactgttgtccttattaaaactccctcatatgttagttgcttcttttcttttgttgctttcaggattctctctttgtccttgaatcttgacagcttgattatagtatgttttggtgtagtcatgtttgcactgaatctgattggagaccattgaccttcttgtacctggaaatttatgtctttcaccagattggcaaagctttatactattatctctttaaattaactttctacttttgtctttctcttcccttttatgaattcctgtgattcaaatatttgctcttttggtgtgtttcataaatcctgtaagctttcttcatgacttttcattctcttttctttttcttctctgattgtatttcaaataacctgtctttgagttcatattctttcttctgcatgatcaattctgctgttgatgctctctgatgcctttttaaatttcattcattgtatttttcagctccagaatttgtttgattttttaaataatttcaatatctctgttaaactttctcattttggtcatttattgtctccctaattttagtgaattgtttcctatattttcttaaggtttgctgagattccttaaaacaattattttgaattctgcataaggcagtttgttatctccattactttggggtctgctatggggagattattgtgttcttttggtcatgttgtgtctctttggtttttatgtttcttgttgccttacatttatgtctgtacatttgagaaagtagaaactattctagtctttgcaggctgactttgtctgggaaagcctttcaccctatttaaagattctaagatggccatctggcatggtacaagggcaggcttgctgctagagtcctcaagcaggctagtctggtgcctaggacaaccagtgggcaggtctgtgctgggggaaaccttgagccagaatctgcagggctctacaccactgatgcaggcttcttcaggcacttcagtaggcatgaagcccagtgctattgaagccagcttgctgctaggatgggcctcaagcccagtgccacttggtccagtttggcactcggtctggtctggatcatgggttcactgaggctgaaatagtgctgtaggaggctgaagactgagttcgcagggctggcctgagtcctggggctgcaggatttaggttggggtcagagtgagcttggaggttcagaccatgggtactggctagagtctggggctttgggagctgggttttactgaagtcggttctgtggtttgggtgtaaggcaaagtctggtgctcacttccttctcctttccccaagcatattgtatcttgctcaatgctgtgcttcctggagttggggaagatgacacagtgaaacttttcttcctgcccttttcaatgtgctctttcttatttctgtgtttcactcaggtgctgtgatctttcatctggtttcctcagctcttgcaaaggtattttcatgcataggtcgttgttcacatcagtgtttctgcaggggatggagggctggagagtcctattctcccatcttgctctacttctccccaattttctaattatatctttatttttctataagggcaaaacttccctttgttttctcatactaactgcctacactcatccaagacacacagactttgttcacagcctctggctgcttttaacaggtatgagatggaagggaaaaagagagtgagtctttttaacagagggactgtccctggttagagaatgcaagaagaaagaatacaaaagaggtcaactagggaatattaaataacaaaacacagttgacccctggacactgtgggaggttaggggtaccaatgccccatgcagtcaaacatttgcacataacttttacattccccaaaacttaacaactgctgttgaccagaagccttactgataacataaacagatgataacacatattttccatacgtattatgtgctgtattctcacaatgaagtaagatctccaaaggaaaatgttattaatacaatcataaggaagagaaaatatatttactattcattaagtggcaataggtaatcataaagaccttcatcctcatcattgagtagtttgagaaggaggaaggagaggaggggttggccttgctgtctgaggggtggcagaggtggaagaaaatctgcatacaagtggactcatgtagttcaagcccctgttgttgaagggtcaactgtgtatgagtgagacagattttagataaagtgacatggtatccatacattgtcatgttgtggagttgttgaatagaaatatgttgcaagttacttttcagaagttatcatgaaaacgtagaaattatgcatgatgctgcttgtcagatttgcaaaggaaggaagcccaggtgaaagaccttcaggaaggaatggcaagtggagggcctctggtgtggtagacaatggcactggaagagacctttcgtaatgatgggaatgtttgagatgaggaagatatagaaagacaaaaagtgatatagcactcacacatcagatgcgaaagtatttttgaaaaaaaagtgacatagaagaagcttgcagaggtaacgttaataattaagaaataagggccgactcaaagcaggtaggaaatgtaacagagatgcaacattacatatgggacaacaggcctggcacgaggtgaggcagggaggcccccagggcacagcatgtaaggagacctcacttggcatgtgagactgagcttccttaaatttcaaggcaccccatagcaccaccttcacctcaccctggttctgtctctaagagacaataatttttaaaaagtgtagataaaaagactatgaatagaaaaaacatagagggaaataaataccaagaaataggaaaaatggagggaggcacaaagagaagtatgcagaaaatgagttaaaggacaatgaatgaaaaattggtagagagtggatcatgcaaagaagggaagagagaagacaaatcaagacattctctgatctgaggagataagagctagaaaggaggcacagggtgtcctattactatggagaaagatcagctgccctcttatcaaaatggcccctgtgactccacctccacccccagattacaataagcctctcctcaggcatcacttcctctccatggctcaatcaccatctaagatctgttgatttctaaacatacatctccagctcagacctgtcctgttgactcccttccccaattgcctgaagacctttatttaaagacctgaagaacatctctctttggaagctgcatctgtcatctattgctgtgtcatgtaacaaactatcctgaaacttagtggcttaaaacaatcatcatttcatttgccacttgtgtcaatcccaactttaaaatatctctaacttgtccatttctcttcatccccagcacgaacaccctaatctagacccctgtcactctcactaaaattagaggaacagtctcctgtctggcccccagtcttgctcctctcaagtctgcacttcagttgaatggacttttccaaaatagaaaccagttgatatgactttcctgtttgaaacccagtgccttcgtgtggcccttagcagtagatcaacactgcttggagtggtgaattgaaggatgtctaccacgcacctgcgcgttccccgtcacccacctctcgccctttcatgccacattcccaccacactaagcttcctttacttactggaatttgccaagctctctttctttcatctctgcctttatatatgcttttgggaaaacagtttggggtaatcttccaaaggtgaaaatatacataccctataacccaacaattatattcctcagcagaaaccaacagaaatgtgtgttatgtcaccaaaacacatagaaaagaatgctcaaggcagcattattcatagaagccaaatgcttgaaattgtacaaatgaataaataattcatggcttatttctataatggaatactatctagtagtgaaaataattatacaaaacgaatacagatgactttcacaagcatgttgagtaaaatatccatacaattttgggggatttggcttcttttgggagatctatatatattgagagagaggtaaagggagaaagaaagagtggagagaaaagagattattccatttttataaattacacaacaagcaaaattaaccttagtgttggaaacctcaatggtagttgtctttgagcaagttagtggaaacagttaatgggaagtgtcaccaggaggtgtctggggtattggtaatctgtttcttttttttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggtaatctgtttcttgatcaaagtgatttacttccttcgtgatcattcaaaacccacttttattcatgtgtcttatactgcaattataatttttattttttttaaaaagcaaaatattaaccatcaaagaatgagacgagtaggtaaagggaaaggtaaaaaacaaaacagagccaagagaggcacaaaggaagggacagagttgagcaaaaggaaaaacacggaggtggggtgaaggtctagccccagcagtgaaattgcagagagggggagttattaatgatagtgaaggaggttcactggggannnnnnnnnnnnnnnnnnnntcttttgggagatctatatatattgagagagaggtaaagggagaaagaaagagtggagagaaaagagattattccatttttataaattacacaacaagcaaaattaaccttagtgttggaaacctcaatggtagttgtctttgagcaagttagtggaaacagttaatgggaagtgtcaccaggaggtgtctggggtattggtaatctgtttcttgatcaaagtgatttacttccttcgtgatcattcaaaacccacttttattcatgtgtcttatactgcaattataatttttatttttttttaaaaagcaaaatattaaccatcaaagaatgagacgagtaggtaaagggaaaggtaaaaaacaaaacagagccaagagaggcacaaaggaagggacagagttgagcaaaaggaaaaacacggaggtggggtgaaggtctagccccagcagtgaaattgcagagagggggagttattaatgatagtgaaggaggttcactggggacacaaatgaaaattcttcatttattacaattaggcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataataggtaaggctgactgggagagtttgtaactgtgagtcacaggttaccaggtaaggggctcagggacttcatcacggaccatcggggcagtgcaggtagcctgggatggaggcaggaagggaaaggggctggcacctgatgcagtgagtcttcagcttgacagaagaaagtccttaggagttgggaaaataccagaagacagaaatggaggtaatcagtaagaatgtcagagaggctatttctgaagtcagagagggctgggcctgatggctcatgcctgtaaccccagaactttgtgaggctaaggcagggggatcgcttgagtccaggagctcaagatcagcctgggcaacatggcgaaaccccatctctacaaaaaatataaaaattagccagacaaggtgacacatgtctgtagtcccagcaacttaggaagctgaggcaggagcatcgtttgagcctgggatgcggaagttgcagtgagccaagattccgccactgcactccagcttgggcaacagagcaagactctgtctcaaaaaagaaaaaaaaaaggaaaaaataaataaaaaataaaaaagagaggaaggcatgggagaggagttaaaaaaaaaatcagagagccaagatattcacaagaggagatggggagggaaacacatcaagacaaagagaggtataaagagacaccatcgctggaaacagaggcagaagcaggggagatggcagaacaaagaggaaagatgagaagtaaaatgagagtgaaagaaaaaaatagaatgagggttggggtaagaacagtgtcagtggatgggcacaactgccttctgtgtgtcaattttatcagcttttggttaagaacttggaacaaactgcaggtggcatgcattcaaggaacaccccagggtcttgagttaacttagcttcctgggtcttcctagtgctctcattgtggaatttcctggtgcatggactccttggtcacaccctgagactcttaatggtttttgctcctttgtgcagtcatcagcagtgaggactctgaaggatccactgacgttgatgagcccttagaagtcttcatctcagcaccgagaagtgagcctggtaaggaagtttgggagagcaaggcttgggctgtgggaatctgatttaagagctactatttcctgaggcattttattctgagctcattctgtacaatggatccagtttatcctgggatcccattctttgcattaattttacttgacctttttggaaaatgcagggagacaagaaattgttataaacttatttttgagaattagccttctttcttgatggattctattaatcaatattcatacccatacattgattatatagtaggaataggctagccaagtgatgagtttgtttttaaaactaactagttgctatgcctatatagtgttagatttatatagtgatttttatagagaacagaaaactaaatattcctttatgggaagatgttattgtcatctgatcacaaactttgaatagggtcaaaagacatctcatccaactatctggtgttggcaaaaacaaacacctgagataaagtattctgaaacttgaagtattgtttctgatagagttcttcagcaagtcatggcacatttagtgattttttgaaagacttttgcaaattgtcttatttttaaatttacaataaccttaaaggggtaaacagaagagagattctcgtccttgtttcctagatgagagaacacaattgcataaatgtttcaaagtcatctccaaaatctcatggtaaattaaaggaaagacaagactagcatcctggattctgagttacttcctttgtgaaatgaaagagagaaacattattaaaatcttgtattatctcaatcctatttgcagcatgagttgtcataagatttataacataaatacttatcataacataagtatgcaaattggttgatttgttttgccctttactttctagatccagaggatattagaaatatgccactttagggaaaatacactagggaaagacctaagagcaaagaagaacctcatcttgatgttataaaataacaatgtaataatacattcattctaattgctcactgtatctttcaaagtaaaatgtaaatttgcattagtttttagacaatatgtactctaactttgaacttagtgtaagcaatctgctgtaaaaaatagtcccaaaatatgtctttggctcaaatacatgaggagattatttctcagccttgtaaacaattcagcaaggcactgggttggtgggaggtagaaaaagctcacgaatttaacagaagatcttcaaggtccccctgcatgaaaaatagaagcagaaacaaaggaaatgtggaatggcaagcagaagggataagaagtaaaagaagcgtgggaaagcaaaggccaagcaaggcaaatattccctctggggacaagaatggagtatcactaacccacaatgaaggttagttgaaaggcaagacaagcatggcctgtgtacaggcgaggacttgcacggattttcaaggttttccaggttttcttattagggaatttcctactgaactgattccttggtcacacactgagacctctaaagaatcccattcttttgtgcagtgatcaataatgacaaccctttagaatcaaatgatgaaaaggagggccaagaagccacttgctcacgaccccagattgtaccaggtaagaatattagagttgcaacccgagactgtagaatatccagagtacaaatccagagctctgttttcttgattaatttcattctgagtggtctccttatgccttgattccataaattctagaatatcactttctacatttaacctctctggccctgttgagaaatggaagacattaggaaggtgttataaactcttgtttaactggattggttcaatcgattgatacattgaaaatgtagcaaaaatatgctagtaaaataacagtctttttaacaacaaactatcaagagttattatttcaagagttgaaataatgtacttattctctactactaccctttatatttgatagagcatgataagcacagtcttcctttgttcattgataattattgtcttaatcacaagctcagaaagtcttcaaagaatactttgtgctgctatttaattattaatggcaaaaaaaaagtgacttcaactacacccaaacccaaattatagttcacttattggcttacattgtgatttttcacagggcttttgaaaatgaaccttcatttccccatcacaaaaaccttaacagggaggtagggtaactagtttatccctgctttatatgtgagaaaatgggagctagtggtgtttaagagtcatttatgaccaggcgcagtggctcacacctataatcccagcactttgggaggctaaggcaggtaggtggcttgagctcaggagttgagatcagcctggacaacatggagaaactccacctctaccaaaaatacaaaaattagccaggcatgggccgggtgcagtggcttactcctgtaatcccagcactttgggaggcgggggcaggcagatgatgagattaggagttcgagaccatcctggccaatatggtgaaaccctgtctctactaaaaatacaaaaattagccaggcatggtggcgcttgcctatagtcccagccactcgggaggctgaggccaaagaatcacttgaacccaggagagggatgttgcagtgagccaagatcataccactgcactccagcctgggtgacagagcaagactccatctcaaaaaaaaaaattagccaggaatggtagtgtgtgtgcacctgtgatccagctactcgggaggctgaggtgagagagtcactggaacctgggaagttgaggctgcagtgagttacgattgtgccactgcactctagcctgggtgacagagtgagaccctgtctcaaaaaaaataagtaaaaaagaacgagatcatgtattttgagagaacgtaaatggagctggaggctattatccttagcaaagtaacgcagaaacagaaaaccaaataccatatgttctcacttgtaagtgggatcttaataataagaacttatgaacacaaagaaggaaacagcagatgctggggtctacttgaggatggagggttggaggagggagaggagaagaaaagataactattgagtactgggcttaatacctgggtgatgaaatcatctgtacaacaaactcctgtgacacacatttacccatgtgacaaaccttcacatatacccccaaacctaaaatagaagttgaaaaaattaattaaaaagaggcatttccaaataatacacacagaggattatggagagagctgggcaggatcccaacattatgaccctgaacctccagaactggattcactagaaggagagagagaaaaacgctcatcaaaactttgttattggcagggcacgatggctcaggtctgtaatcccagcattttgggaggctgaggcaggtggatcacctgaggtcaggagttcgagaccagtctgaccaacacagtgaaaccccgtctttactaaaaatacaaaaattagccgggcttggtggtgcacaactataatcccagctactcaggaggctgaggcaggagaatcactggaacctgggaggcagaagctacagtgtaccaagattgcaccactgcactccagcctgggtgatagaacaagactccatctcaaaaaaaaaaaaaaaaaaaaaaaaactttgttattaacccaagcccatttgccatgtcagttgtcatagaatttataagtctcttgcatacaaataacgggtttctcccttttactttacagagcccatggatttcagaaaattatctacattcagagaaagttttaagaaaagaggtaagagaaagctttaggaaaagaggtaagagaaaataacttctcttcatggttataaatgaacaatattttctacaaaagagtcagtctaattccttgctatatccttcaaagtaaaatataaatttgctttaaatttcaatggttcctattttagcctttgtattagggaggttggctaactgctataacatatgaacccaaagaagtcaatgaccccaacacaacagaaggttttttatttttttagtagaagtttgtatttttttcaactgaatatttcaaggatttttagatgagggaaaggttgggctctgtttcaagcagttcttcagggaagcaggcaagtagaagatctgccttctcccatcctagactttcatggttgccctgagagagaagcaaatttacaaataaatacaaatccatatacaaaaaccacaacaaaaccataaagggacaagtaaagaaagaaagataatgtggtgtaagaagacagagggccaagacaaagcagagatgcccactggggctaaaattttctcagcctcaggctcaggtgacagtgagggataaaatactaaccttgagccacacaaatctgaatgaaaaggcagatcatgggggtttgagggcacggacattcttgccctgaagtttcagagcatcacaaattttcctagtttccttttcatagaatattattctgacttggttcccttatcatacactgagagctccaaaggacatttgctcctttctgcagtgataggacaagaccacgacttttcagaatccagtgaggaggaggcgcccgcagaagcctcaagcggggcactgagaagcaagcatggtgagaagggtaagaacagctcccttgacttcagggctctgacttcagagcacctcttccctgatgcactgtgctctgagcacacacaacagctatccaggagccagttctctgcatctacctcatctggccattttgaaaaatgcaaagaaagaagtcactctaaattcaggcttaacaagatggttgtggttgagtggcagtggcctgtttactacatactgcctgtattagtccattttcatgttgctgataaagacatacctgagactgggtaatttacaaaagaaagaggtgtaatggacttacagttccacatggctggggaggcctcacaatcatggcagaaggtgaaaggcacgtctcacatggcggcagacaagagaagagagcttgtgctgggaaactcccccttatataatcattcagatcttgtaagacttattcactatcacaagaacagcacaggaaagatctctccccatgattcaattacgtgccaccaggcccctcccacaacacatgggaattcaagatgagatttgggtgaggacacagccaaaccatatcactgccagacctattaactccaaagtattggatttatgtagtgatttctacttctgctcattctctgttttgtaaagaaaagaaagtacactagtctgttattgcctgattttgtcaccaacttgttcaaaattccaaagcttctggtcatactctctagttattgacagaaagaaagcctcctgtttcttaccatcagattcaattcatagcttttgacagatggcccccaacatgaaattggccaaatagtgatatttgaaaatatatttacaaataagatctacttgcatctttacaacaacctaaaaggtgggtgagataactattgttccccccatttgacagatggggaaactaaggcacacttaaggatcttttttctttgcacatcacatatggaaagttataggaggagacaagactaacaacccaaactcttaataaacattcataatcctctataaaaccttcaaagccagatgtacttcaaagttcaaaaaatgttttattattttagaaagacaatgtggtttatattctatatacaacaaaataccccagtaggatccagggaagaatcccattctcaaatatactaatgtttatacagcaaattatataaatattcacaccaaatatgataagattttacacggactcatggcaactcaagtccagattcactgccaaattagttagctgcaaacctatgaaaacaatactggttattaaaatatctttgaggccaggtgtggtggctcatgcctataatcccaacactttgggaggctgaggggctgaggcaggtggatcttttgagcccaggagttcaagaccagcctaggcaacatggcaaaaccccatttctaccaaaaaatgcaaaaaattagctgggcatggtggtggtgcatgcctgtagtcccagtgatgtgggaggctgaggtggaaggatcatttgagcctggaaggtcaagactgcagtgagccaagattgcaccactgccctccagcttggctgacagagtgagaccctgtctcaaaaaaaaaaaaaaaaaaaaaaaagtcattgattttgcaattagggctaaaggattgtgggtctgtgctccatttgatagtaatctctttcccttagatgggaagagacagaaatgatcctcatagaatatttatagtccaaattctgtcaacagtgtaagcagtcataagatttatagatcttttagttagatattattgatttggttttcctttactttctagctcctatgacttctagaagtacatctacttggagaatacccagcaggaagagacgtaagagcaattaaaaactcttgatgtaacaaatgtctttatttgctgcaaaagctacattcactttttatgttatatcctttaaaataaaaaattaatttgttgggattttagatgatttgcattttacattttcaattagatgagttgggctggtataaaacataagcctcaaaatgttcaaaggcacaagtgcaacataagtttatttttcactcacataaataggataaagtagttcctgagtagagggggtgcccacacagtcattcagggcccagctgatgggggctctgacatctttaagatgttgcttccatggttcccttggataagaaactgagatggaagcagaagtatgtgcaaactaataatgaaagcctaagaagcgtaagaaacaacgttgtcctaggattgtattcagaaaagattgaacattatgtatgttccttttatttgattatgcatgaatgagataggagaaaacgatggaaggatccacactgatctgttgacttcactagctgggagaccagagacagaatagggtaggaaaagagagctttggggttatatacatttgcattcattggtcttcttatgacaagcatatattgctttcttaatttgaaaccacccaatgaaatggatgatttataataaatacatatttttcccaaagttaaaaaaaaaaaagaagaagaaacaatgtcatccccagccccagcctcagagagggctcctggagcaatcttgaccaacaggtcagatgatcaaagccaaagggtggcctagtggtgggactatttctccccctcctccacaagcttctcttgttcagttttgcttttaaagaattccctgctgattcctaagactcagactaagactgttaaggaattttatttttttctgcaggtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattcttttttttaaacctgctctcattcctattaacactaagatcttagatttttatagtgataaatgggttgacatcattgtcatttgtaattgtaaagcctcaaaagacaactgttcctactatgtaattatagacagaaataaaaacttcagatcaaacactctcaaacgttagtatagtttttggtagatgtccttcatcatgtaattggattatattgtgttatttcaatgtcttttggcaaataatatcttattttgtcatcacaaaatttttaagacataggcaggctaactatacccattttggggtgaggaaatagatgtacagaagtattagggccaaaaaactaaagaaacaatagaaactagcaacccaggtgtctcacggtgggtgactgttgtatgtaacagacaggaggataagagctgtgtcatttaagtcaaagtccaaagaagatgcgcaaggaactcagaatattcacaggagactataccagtgcctgatgcaagaaagcttatttaacaaccactgtgtgtgtgtgtgtgtgtacacatgcatatatttgttacatataacatgtatacatacataaacacacacatgtgtgtgtgtatatatgtatattggttaatacatataatctttagggggagggaaaaataaaaatcgcaaacagacagagataataggaatggaaccagctatataatatacaaaatacctagaaagacagaagcaaaatagataaacatagaaataaaggagaacagaacatcattgatggaaacagaaaaagcaacacaggagacaagaaaaatcaaagggagatgagctcaccgaatcaaagagacagagacaaaaatgtatagcagcagggcaatgggcagaaaaatgagaagtgagaaggagaacgaagtgtggccagatagagtagggctatgaggtgtactcattgatataggtgtatttttttgtcagtccgtttaagctctgaaaatagttcagcatgaccacattgagacaggttccctggtttcctcgtcactgtctatagtctattatttccttgtttgtcttcattgtcctgtgaatttagagctcctccaatgaatacacaaagagagtcagaagagatgcagcccattagcttgtgatggagaagccgattatgatgttcagttcattattaattatcttttttttcctacttgcatggaggaaaagttcttttttcttttccttacctctcccccaaaacatatgcacacacacatacacaccacacacacaaagacttgtgcacagactcgggctgcttgcgacaggtttgagggagcgaaaagaaaaagaagagctgggctcctgaatggagggaggagacactgagtggataaagtaaggagaaagaatggagaaaggtaggctagagtcaccaaatgaaaagatataagagtcagcttcaagtttttctaagtggacaaggaattcaaatattccaggtaggggaattttgtgggggagggagggataattttcaacacacttctcagaaattgtaccagaaacgtgaaaataaagttgctgattgattgacagccttgcaaggtagaaagctcataaagaacagacaaaggtaatagagatggctatgtggtcagtgtcctaacagcaggcatttggtgatgaaagtaataacctgtgagataaagatgaatatagatgaagaaaatgtggataaagacaaagattgaaattgcaaaaagagtcaagatcaagataagggccaggcgcagtgactcatgcctgtaatcccagcactttgggaggccgaggtgggcggatcacgaggtcaggagatcaagaccatcctggctaaaacggtgaaaccccatctctactaaaaacaaaaaaaattagccaggcatggtggcaggcagctgtagctccagctactcaggaggctgaggcaggagaatggcgtgaaccttggaggcaggtcttgcagtgaaccaagatcgcaccactgcactccagcctgggcgatcgagcaagactccgtctcaaaaaaaaaaaaaaaaaaaaaaaagtcaagacaagattcagagaaacaagctagaagagagaatagaaggaggaagtgatagtagaaagaagttcacctcaataataaaactagatctaaagatataaacagaaaaacaggtggaatgagatacattcaaagggtgatgagtggtgtaaaaaattaggtacaacaagaagtatgtagagaaagaattaaaagatgagagaaaaatggaggcaagaagggggaagtgtaaatgggagagaagagaatgatggagaaattgtaggatctgaaatgaccatgagataaaagcaactttagcacaaggcatgattcacaatagcagtaagttttcagaataaggtgtcccctggcccctctgactcacccagattacaaaaggcctcacccaggcatttcatccactcctgtgatttcagtcaccacccacaacctcatgattcctacatgtgtatctccagccagccctgtcttctaaactcattcatccaagtgtcagaaggctcctgttggagattctgaaggccttagacttcaccacttggatgttactcaagaccttcaaacttaacacctccaaaactgagcacatcatctttttccctaaaaccagcctttgctcctccagtgttcttcatcactgaaacaaactattaattgaccctttatttcaagatgaaattctcagggttatttatgaacagaagggaaaaatacagtgaggaaccacaaaagaaaaagagatttcagatgtagagcccatcccttaatttagctgtggggagtgggtagtcactaatgttggggggaaggagaatctttgaaggggagtgggcacaaataaaaatgtttacaaatcacaatttaggatcacagccacaagaacctgaaaataagaagtgctcctgtgtcatgtgttttccaaaaggtgtgccaagaagccaagaagcaaggactgaaagtagtcaagcatctgacatgatgggtaaggctaccctagggtcttgggatggaagtggctcagtggatatcacagacactgggtagggatgtgggaagtgatcagagttgaagcaaagcatgaaacagcctctggatcaccaacaggaagtgggcccacaggccccaagcttcagaatttcaaaagtctgaaatcatagtcccggtttcctgctgcacttgactgtgagcagactgtgacaaagaacaggtttggtgccgccagaatcctgttctctacatttgcttaacccgacccttttgggaactgcagggaggcaagagatcattataaagccatatttaacagaatgggctctcttggttaggtggtaaaaaaatacactggtaaacatagtagtatctcactatattagcatatcaatagtaaagtgttgaatttataaagcgagttccatccttgttcttgaaaaaaaaaaaaagaaaacatgttcttccactcacaggtaatagtgtcattttgtcacaactttggaaaggcctaaaaagacaaatagtcctgctacctgtcaggaaagaaaaatcagatacctactcttatgctaaaaatacattgttttgaaagatatcctctggactgttattgatttatatagtgatttcctattaactcttgcaagtaagatatttaatattcataaaaattttaaagctgaacaggataaccgttgctgtccctgtttcataaatgaggaaattggtgcataaaagtaatgaagagctgtttcaaagtctcagagaactagacgaagaccttagacatcaattcagtgtctgtttcctttggaaggaagacagataaattatactcagaatattgttataaacgcaagccttccatgcagtgtgaattgtcataagatttataaattttacttataaattacagttctctgaccactacctgtcactttctagataccatggatgttgaaaacaattctactttggaaaaacacagtgggaaaagaagtaagaacaaataagaatttacttaatttttatgttacaaatgaactattttttaatgctaaggtttattatcatcattttcttttttcaacttttattatagattaaagggtgcatttgcaggtttgttacatgggtaaattgtgtgatgctgaggcttggtgtcccaaaaatcccatcacccaggcagtaagcatagtacccaacagatggttcttcagcccatgccaccctctccccctgccccatctagtggtccccagtgtctcttgttctcatcttcacatttatgtgtattcgatgtttagcttccacttgtaagtaagaacatgcagtatttggttttctgttcttgcattaagttgcttaggataatggcctccgctccatccatgttgctgcgaagggtgtgatttcattctttttatggctgcatagtatttcatggtgtatatgtgtgccacattttctttatccaattcactgttgatgggcaactagattggttccgtgtctttgcttttgtgaatagcactataaggaacatatgagtgcgtgtatctttttgatagaacaagttattttcctttgggtatatacctaaaggtagtgggattgctgggtagaatggcatttctgtctttaagtctttgaggaattgccacactgtcttccacaatggttgaactaattttaccctcccaccaacagtgtatgagcattccttttcctccacaacctcaccagcatctgttattttcttgactttttaataatagccactctgagtagtgtgagatggtatctcactgtgattctgatttgcatttatctgatgattagtaatgttgggcatttttttcatgtttgttgaccacttgtatgtcttcttttgagaagtgtctgttcatgtcctttgcccattttttaattggattttgttttttgcttgttgatttgtttaagttccttgtagattctggatatcagaccttcgttatatgcacagtttgcaaaaattttctcccattctgaaggctgtctgtttactcttttggtaatttcttttgttgtacagaagctatttagtttaactgggtcccacttgtcagtttttgtttgagttgcaattgcttttggagacttagccataaattctttgccaaagcctatgtcaggaagggtatttcctaggtttattctaggatttttatagttttaggtcttacatttaaatctttaatccatcttgagttaatttttgtataggatgagaagtatgggtccagtttcgtttttcttcgtatgtctagccagttattccagcatcatttattgaatagacagtccatttcccattgcttatttttgttgattttgttgaagatcagatggttgtaagtgagcaggtttgtttctgagttctctgttctgttccactggtctatgtgtctgtttttgtaccagtaccatgccattttgattactgtagccttatagtatagttagaagttgggcaatgtgatgcctctagctttgttctttttgtttacaattgctttggctattcaggctcttttatggttccaactgagttttagaatagatttttctaattctgtgaaaaatgacgcttttattttaataaggatggtgttgaatctataaattgatttaaacagtatagtcattcaaactgtattgattcttccaatccatgagcatggaataattttctatttatttgtgctatctctgatttctttcagcagtgttttgtacttcttcttgtagatatctttcacctccttggctggatgaattcctagggatctcattttctttatggctattgtaaatgggactgtgttcttcatttgattctcagctagaacgtttttagtgtataaagatgctactgatttttatgcatcgattttgtattctgaaactttactaaatttgtcagttccaggagcatttttttctactcctttcataagataaaacctgaatgccttttaaagtagccatttatttttttcaaaatgctcatgttgctttattctgtcttcatcttgcttttcattctgatttgaaaatagatgttcttgtgaacattggtgtctatctttccagaattttactatgcatgtattaacacgttttggaatatagttttatttaaatgagtaactctgtacacacttgtcctttcttgctttttaaactaatatacctggacaataaaaacgttttaaattgaaatataaaaagtcttatttcagagctgctttaatgtgcattgttttcatttttagtgtcgtcaggaatttttcatttattatcggtcatttctttttcttcttcataaaactctttgtcagagaatgctctgtgtttctttgttttgttttgttgtgtttttgtttatttttgacggagtcttgcactgttgctcaggctggagcacagtggtgtgatctcggcttactgcaagctctgcctcccaggttcacaccattctcctgcctcagcctcccgagtagctaggattacaggtacctgccaccacacccggctaattttttgtacttttagtagagtcggtgtttcactgtgttagccaggatggtctcgatctcctgaccttgtgatctgcctgcctcggcctcccaaagtgctgggattacaggcatgagctaccacgcccggccctctcagtgttttaagtcatggtgtttttcttattattctgaatgaatatagaactcttaaatattatatatattaaatcttggtcatatacgttgctagtattttgtccatttgttgtttttcttttagatttgttaagggaatcttttgtcctagagaagttttaaatttttatgtagtcaaatttgtcagcctttttctgactggttcttgggttccatatcatatttacaacagctatttcttcctcaatattttaaaaatattgttttatatttgattctagaagtttgatataactgatcatttttaatgtttacatatgtaatctacagggggtttgcctttctgtgtaagtgaggtgggaattttaaaaatattctccacactatggcatggtgacatggtgatttgaatcaccactttgattacacactgcctttacctgtctatattctatgttcttcttttgtaattgaaggcactacagaaaagaaagaagagctcagaggtagaaccatcctgatgcttcattggggtgaattttagaatgagctcaagaagatctctcccaactccttcccaagtccattgaaagctctgatcagaaatgcattgaactggctaggcatcatggcttatgcctataatcccagtttctcaggaggctgaggcaggagtattgcttgaacccgggaggcagaggttgcagtgagctgagactgcaccactgcaccccagcctgggtgacagaacaagaccctgtctcaaaacaaaaaaaaaaaaaaaaaaaagcattgaatttgaaggttaatttgggaagaacagagacttttactcttttattcatgtcttatgtaatgttcttccactaaaaatttttttgtacaattctggcattttaaaaaagttttatacattgtataaatttatgtgttgctatgaatatctttttttctattacataataactggagggaatttaaatgagacaagactctcaaaatctttatttaaaaggaaatctgtagtcaatttattacctacttgcatatgagagaatcagaatgccacttagttaatataaaattttacaagcatttataagtttagggatccagatgtcacttaaaatattatggccaggcccaaaaattatcaaataaaaccatcgatcagaattacaggtttctttggaaactggtttcataagaagtggcagtaattttctattttgtgggattattacaagacctcttcaaatagctctcctaaggacaagtttatgttaacatagaacagaacaaatcagtaacggttatgaaaagacacacttccatattttgcaagagagtaagactgatcttcttttgaaatttctcaatttaacactttgtcaaatcagattctttatgttagtcttgtggtgcagaatgtcctctctccttccacaactatgggtcgaggggcctttcctttcatctccttcagcaatttcttttgttagttatgaagacttacatttttaaaatctggtcagtggaattcattagttagccttacaagaaatgtaagcccgtggagctcaatgttactgggaaaaatagaggtgcctgaaatgaatttcacctaaaaacagtgaaataggatgcataaagattttttttttcttttgagatggagtccagctctgtcacccaggccagagtgcagtggtgcaatctcggctcactgcaacctctgcctcccggattcaagcaattctcctgtctcagcctcctgagtagctaggactacatgtgcccaccaccatgcctggctaatttttgtatttttagtagagatgaggtttcaccatattggttaggcaggttttgaactcctgacctcaggtgatccacccgccttggcttcccaaagtgctgggattacaggcgcgagccaccgtgcccggcctaggatgcatatagatttttcaactacagctctcccacattctccattctgaatgagctccagatcccatatcattttattttcagatttcctttctgtcttgtcttcacctaaatacataacgtgaagttagttcagtatttaggtgaagatgctgatggtgtctttcttttaacactacatcttgtgtaatattttataggcattgctactgtttataggctaattattattcccagcatcattaaaatactttctgcattttattttcttttatctcaaaatactgatggcctttctttataccacttccatttgccagacctcatcctatggacctcatcacgcttccctttttattgttctacttatctatttcacactcccaaccctcccacaacttttctttccttgtaaattagaccacagctgtactaaagactcagtcttccttcagggtacctgttttgggttaggacgtacaaacaggcttcaaaactgtccatcactattggagtaaaataggaaatccagtgaaatggaagaaacagccagatttaaagcgatcccccaaccaatagtgtggaaggcttcagcacagatgccaagattttgagagattttggccaagcccatgctcacagtgaagatggtggaatgtttttcgttggagatgaagtcaccatagctcagtctataggacatggcaagacaattcacagtgactcccagttccacaggataaggcagtgtgctcagagcctgcaatagtctttctagagcatgatttgggcatcttgaccaatgaaggacaggattcatggcttactctctgactttttgtcaggcctctcctcaaatgctgacttatgagaagttcttcctggctcttctacataaaataacacatcctcctcccacacacacttctagccccattcaccactccctgaagttcttattctggtttacttttccacaaaacactctgccatcttctgtgtttatttcttcattgctgtctccccactagaccataagctctacgccagcaaggactttgttttattcacaactgtatcctcagcatctaggatagtgggttgattcacagtaagtgcccgattaatagttattggatgagtaatttgcatgaataaattaattctaccagcttgtgaaaatctaatccaaatatatgattgtacaaaatatgtacttaaagcaagcaaagaaaaaacattaaaaataaaaggatgggtaaagaaatgtcaagacctataaattagaagatcagggatttttcattgcttgctctttgtcataagtaatcacatggtaatcaatattgtcagctaattcaggttccctgtggatctcatttatgggggccagtc

SEQ ID NO: 1907 - DNA, 1879 bp, Homo sapiens
ctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattcttttttttaaacctgctctcattcctattaacactaagatcttagatttttatagtgataaatgggttgacatcattgtcatttgtaattgtaaagcctcaaaagacaactgttcctactatgtaattatagacagaaataaaaacttcagatc

SEQ ID NO: 1908 - protein, 483 aa, Homo sapiens
GGKMAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGKED

SEQ ID NO: 1909 - DNA, 31946 bp, Mus musculus
  misc_feature (1)...(31946): n = A,T,C or G
tattttaggcttgcatttctatctcgggtttcatgtgactagcaattatctttataagattttattatccttcatactaggttgcaagaattgttccttcacatgtggttgctgggaaagtttaagacttgtataaaatatacaaagaaaaccatgaatgccttctcctctcacctccattccagaacaggtgctgctgttattttgaagcctgaatccaacctcagctattcttgtttgtgtttgttcttaccaacaagctacacttctgttcctaagcagagtataatttaatctcgtgtaaagagggcaattatatacatattacatggaaattcattttctatttttttaaatatatgtaagtacactgtagctgtcttcacacacaccagaagagggcatctgatcccattacagatggttgtgagccaccatgtggttgctgggaattgatctctggaagagcagtcagtgctcttaaccactgagccatctctccagcccctacttttctattctaatgtttgtgtatatgcttgcttaaatttatatgcagcacatgtgggcaggagcctacagagacccgaagagggcatcagatcttctggcagtgggcatggaactcgggtcctctgtgagagcagtaagcactcttccagagcagtaagcactcttccattgctgagccatctctctagtcccagaccttccttttgttcacctcctaatgtgtgtcagaggtccttcgaatcttctttacaaagccttggccaagtatgtcagatatatgggaaccaggtgtagtgaaatatgcctgtagctttggcacttgaaagctaagacttgaaagctaaggatcttgagttagagaccagactagtctacatatgatgaccctttcccccaaacacaaacaacttatgtatcatagttttagtttgtgtagtgtctcagtaagggttactgtgatgaaacaccatgatcaaaaacaacttgggaaggaaagagtttatttggcttacacttccacatagtagtccatcagtgaaggacgtcaggacagggactaagaacaggaacctggaggcaggagccatggaaaagtgctacttactgttctgctccttgtggcttgctcagtgtcttagttaggtttttactgctgtgaagaaacaccatcaccacctacataactcttacaaagaaaaacatttaactggggctggcttaagtctcagaggtttagtccatcattgccatggcgggaagcatggcagtgtgtaggcagacaagctgccggagaaggagctgagagtctacatctttgtccgcaggcagcagggagagagacacactgaccatgtttgagcatgtgagacctcaaagcccaccccacagtgacatgggtcctccaacatcaccacacctactccaacaagaccatacctcctaatattgccattctctattggctaatgggagaccacattcagtctattttctcatagaaccccaaaccaccagcccagggatggccccacccaaaatgggcagggctctcccctgtcaatcactaattaggagaatgcccattggcctacctgcagcctgctcttatggagacatttgattagtttcccttctcttagatgactctagcctgtgacaaactgacataaaactagccagcactacattatactccttaaagaaagaatcgcatccatcactgtatccccagtacccagaccagagcaataaataagattttacttgtcaataactaagattttaaaaatcaataactgaattttttacagccagcaacacaaaagttgttttgtgtcctggggccacaataggcattaaattctgaacagcaggtgggtaacttttatttcctagaacaaaaaggtaagtgcatttgtgtattctgacttcacctgacaacctttgggagtttactattgatttccacttcacctgacaacctttgggagtttactattgatttccaactacactgtcatgattattcacattaataagtttctgaggaagaatcagaaactttagtagctcttcacaatatccttttattggtgagaaaagtttaaggaattgccaatattaagtaattttcaaggactggagagatagctcagtggttaagaacactgatgactcttccaggggtcctgagttcaattcccaaaaatcacagctcacaaccatctgtaatggaatctgatgccctcttctggtgtgactgaagacggccacaatgtattcaaatatataaaagtaaatctttaaaaagtaattcacttaaactctatgagttattaaacaatactttttacccagtgagtactttctaatcctgctttttacttttctgtattgaggagaaatagcaaataaaataaattgctggatatagcggtacatacatttaatcccagcatttgagaggcagaggcagacaggcaaactgtgagttcaagtctagtctgatctacagaggtagttccaggacagccagggttagacagagaaacccagtctggaaaaacaaacaaacaaacaaacaatcccaaaacaaacaaacaggaactagagacaaatctagaagcatgtaagtgttatgttttgtgtttactttctctttcctttttctgagattaggggagggagccgtgtagctcaggctagcctgtatcttgctatgtagtggcagatgaccttggactcctgatcctcttgctgtctccactttctaagttttgtttacaagcatgtcccagtatggttggctgatctggttcttttaaaacagggtcttaaaagtttccttaggttggcctcaacagtctccagtctcagttcctgagtgctaggattgcaggcaaatgccaaagtgtttctcttgttttaattttaaccacagtggcctttggttataagacaacaaattaataggcataagaattagaacccaaaaatctggaagccaactttctacctattaagttcatcatcacccaggcccgagagatggcgcagtccattaggagcacacactgttgcaggatatttgatcatgttgtgaaccccaagattgcaagtctgcaaatccttgttgtggtatggctcagccctagcacacatctttaatccaagcgctaaataaagtcaatctaggtcaagaggcagagcaagctgacagggactgaacgtaagtaaacagaaaggagggctttgagttgaaggggatttcagacaccatggaggagagcctttttcctctgggacatcgatggagtaggaaggtcagctgggtgctttctctgcctctctgagaaagcaggctttcaccacagcttctggatcctgaatcttctttggtaaaatcaaagggctgggaattttgttatttaaaacacctgttcttccagaggacctaagttcagttcccagcacccatgtcaagcagctcacagccccgcctcccctaaagtccggcttcagggggatctgacctctggcttccacagggggacctgcacttacatgcacacactgacacacacacacacacacacacacacacacacacacacacacacacacacacacacacacacagtatcatcagagaggagggagcctcaatcaagaaaatgcctccataagatctgactgcaggcagtttcttaattaataattgttttggggaaggcccagctaaggcttcatagtaccacccctggattagtggtcctggattctataagaaagcaggctgagcattccacaaggagcaagccagtaatcaacacattcctccctcctactggctactctaaaagctcctgcctcctggttcctgcccagtttaagtttctgtcaggactttcttcaatgataaactatgatatataagtgtactggctggttttgtgtcaacgacacaagctggagttatcacagagaaaggagcttcagctgaggaaatgcctccatgagatccagctgtaaggcatttattttctcaattaatgatcaagggggaaagaccccttgtgggtgatgccatctctgggctggtagtcttgggttctgtaagagagcaggctgagcaagccaggaaaagcaagccagtaaggaatatccctccatggcctctgcatcagctcctgcttcctgacctgcttgagttccaatcctgacttcctttggtgatgaacagcaatgtggaagtgtaagccaaataaaccctttcctccccaactgcttcttgattatgatgtttgtgcagaaatagaaaccctgactaagacaataagcaaaataaactttcctccccaagttgtttttgactatcttgtttcatcacagcaaaaaaagcctagctaaaacatacacataattaaaggcaataaaaatatatctaaaaacattaacactagtaatttccaaaaaacacatgctattttacatacatgtaaaatgtgaactttataaatactaagatgtgtgtatacatgtatgtgtgtatatacatattcttactaaatgcaaagatctattccacctaatttgttcaagataatgtcttgattcatagctgatgtgagcaaggcacaaacatcacaaggcatgtgtatctatagagtggctcccagtttcctgctaggcatttattctaccattgatctacatcccaagtctgatcacaggctttagacaatgtttacaggtattgctggaatattaagagtaagtattgtttcatatgaaacagcttcctattaaaattcttatgtttgacagtttcataagacagtgccttaaacccaagtgagtaactatggaacaagcagagcttcttagcactgtacgcagtttgactagttttaaatttctcagggatgctaacttaccctcatttaagctccgggtgtgctacacaggtggtagttcccttctccactctgcaggggttcacgcagtctgcttttctctgcatgtgtgactgactctcactggttgtgtcactcagaattaagtgacaactgacctttatttctgttttagagatggctggcttcaggctggtggttcacatccaacagcataaaagaacttgattactgtggcttttttccttttagggggcccttgggatagagatgctagtgaagttttatctttgtttgcagagctgaaggtcatcatgtgtcctggggctgtagtaacaaatggccacctcataggagatcaaagggataccatttgcctactgtctaggggttaggtctccaaacctcactaggctgaaaccaaagtgtcaccacggccagacttcctgatgtggtcatgccctgaagctgagttcttactcatgaactgaccaaaatccaaactagatggctaatttctgacattaaatgccaccaagagtggacaaactcaacagctggcttgctcgtattatcttcaatctgtcaatatttactattaccatttgcaactttcttgttgcccttggcttcctgtgtcaaaaacaaacacttggactgaatggtgttaattctaatctagctctaaaaacagcttggtggaatcaatggcttggcagcttatcaagaccagagccttacctcttgagcacacacatcattttatagatatacctcccaaactgccccatagcctatctgtgctcagatcccaacacctctccctaatttttggagttgttgcctccttcggagggcaagaagcaattccagcaggcctccggttggagtggaggtcatggactacttactataaggacacagaacagagcaaatgtggaacccaacagctatgctacagaatactacaaagagaagactgtggaataaatggggccccggaacttcctacttcatattcatacagtctagaaataatacagtctaggggacttgactgggttttctctgccagtttaaagaattaaaagcaagaaaaccctggaggcatcaagcagcaacaggaagtctcaagcaccacaaacagagccaacagttaaaggaaggtgtttattgagggtgaggggcacacccaggtagcaaacacacagagaaaaaaaatcctctgcaaagcaaagaggatgacactctgaaaatgaaatctcttcttggggatgggggttttaaagcctctgaagagtcttactcctctactttagagttggtcagtttgaaaaagagaatggtttgaaacatgtggcatgttctaaacactgtagctgtctgcagacaccccagaagagagcaaaagatcccattatagatggttgtgagccatcatgtggttgctgggaattgaactcaggatctctggaagagcagtcagtgctcttaactgctgagccatctctccagccccagaagtccttcttctggagcttaatttcaggctcaatttttgtggtgtgttattaaattcctgtagtataatagtgaaagaatgattactaaagaaataaaaataatactagttttggtttcagaacttaaaaactgatgtttaaatgataaccagaagacacacttgccagaaggctgcatctaatgacatgagaacaatttaagcacagggaataagatactttagtgcctcaggaaagccattagtctttctggtatcacctgaattccacctgtcttaaagcagtaaaaatgtaactttactttcactaagtttcctttcaggcacacagaactcaggttgaactagtaggatccctgtctataaagataagcaaggcagggtatggtggcttgggtttgtaataccagcacttgggaagctaaggcaagatggctgcaatgaatccatggccaacctgggccacaataataaataataatagaatattacgtgcgtatacacacattttcacttattcaacatagtcatttgcctcccaacggcctcacttgactggattcatttccactaatgcttttctatgaataacacgtatctttactcttccctgaattcttggtaattctaaacaagccttgtctttccacattttaacgtggctgttttaagtggatagtaatttggaaacaaaactttctccataataacttacaaataatgtaatggtttttccaaacttagattatatcacagaaagaatatgacagttacttaacgagcaaaaacctcgtagagtccagttactagcccattacctcccatcttctggattagtcatggacaattttgaaaaaagaaatagtaacagtagtttggtgacataatgaggagcaagcatttataacatgttcagccatctcttcctgtgggaggaacaaaagtcctgtgctcaacagataagcaacaggggaaccaagaatgttttgtttttcaagacagggtttctctgtgtagctctggctgtcctggaacttgttctgtagaacaggcactaccctcaaacttagagacccacctgcctctgcctcccaagtgccaggactaaaggtgtgtaccacctttacaggtaggaaccagtaatgttaaagacagggttgttccttcaaacaagggtatataaccttctatccacccagaaggccgagagcagatgtgactaatagcctggtgaccttttctgctgtgtggccaagaccacatcagatctttctccagacccgtatcatgagcatgtcatttacagaattgatcattatggaaggtgtctcatgtagtgaatctacagaacccatctttatggaagatgtcacgtgtactttacaaagagttttgatggagtcacaccttaaactttattgtccacatggaattgagttaattatcaccaaaaaagttttcactaaattgtgccgaccctaatatatgcatagaattgcacattggtggtgcagctatccaaatcatttctgctccttacccatattcctgtaagtaaccctaataaaactcattggttcaccaagtttgcactctgatggtatccatactttggtctgtggtaggttccctatctgaggtgagtagtgtctcactaggaaaagttttgtcccgacatacctgtcccctggacttgtgtctcctatgctgtcacagaaagtttggatatgaaatgcctgccacatacagaccctgtgaagagcttgtccttagttagtagcactgagaggtgatttaatcacaaaggcaaatacctcataaatgggttaatccgacgatgaggtcacagctggacaagcaattaggagttggcaacctacttgaggagggagatccctggatatattcccctttctctttgttggtggcaagggatttgtttttaccaaggtctcacaccataaagttctgcctacacagtcctacaggtatagggccacatggctgtagcctgaaacctcagagaccataaaccaaaattaaacctcattgtggactttctaggtaatctgtcagtgacaaaaagctatcacaatcataaaatttttgtttttgaggctttagttgagtactgggattaaaggcttgtgccaccacttcctgctctatatagcttttgtttggaagaggttttgtttcattttgaagatattatatagctcttactggcttggaatcagtctgaccctctaatcagagatccacctgtctttgtctccagagtgcccgtcccaacacactttgtaaaaatgagctgtgaaaataccttgctttggtgactaagatgtatccaaattttcagtgcgctctataggtccaaggttaagacacttttcaagaaagtaagctttaacaaaataacaattccaaccctttgtactgagtcaggagatttttctttctccctaaaggccatctcagaggattaagctggaataaaaagatcatgggaggccagaggcagaaggatcaattgtttcacggtcgacctcagcttttgggacttttagtatggatggaaaaagaccacagctctcagccaggcggtggtggcgcacgcctttaatcccagcactcgggagacaaagacaggcggatttctgagttcagggccagcctggtctacaaagtgagtttcaggacagccagaactatacagagaaactgtctcgaaaaaaacaaaaaaaccacagctctcatcttaaagggaataaatgatgggttatcctggagccattttgattgaccatggtcccggaacacagatttaggttattccaaactccatgtaagatgagagctgtgtttttctcttcattgacacagggatagttactttctctccactctgacaaaaaccatctctttaagacgagactccccagcgcaatgaaatcgcccgtgtactgtcctcgccataaacctatttttggaactagggattttccagattactgtaaacccggcgaagtgaggtcagggctaggcatgcctttctaggctacaccccgacacccacgcgcgctcggagctttccggaaaccccaggcgctcaaactgggaagctgcccggttcagagtcactttgttacactccggtgtcgccgaccgccggactgtcaccaacgcgcagaccgtgcaggggtatcggggccgactcaccaggccagagtccgggttatccggtgactaaagccattaccacccctgagccgccagcaccctgccccgccctgcccatccggacccctccgcccggtgtcaccgaccgaagcgcggaggaactcgttggcgcgcgcggggagtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgccgccgccgctgccgcctccgcctcgtccgccgccccgagcgcgggcggctccagctccggcacgaccaccacgtacgacgaccacgaccggaagggatcctgatcggcgaccgcctgtattcggaggtgtcgctcaccatcgaccactcgctgatcccgggagaagcggctctcgcctaccccgtccatgcaggacggcctggacctgcccagcgagacggatctgcgcatcttgggctgcgagctcatccaggccgccggcatcctcctccggctgccgcagtgtgagaaccccggctggttgcgggcctctccgccgcggccaggtttctccggagcctgcgccgggcggcggcggcggcgggagctcgggcgggcgagggtggggatgcgggggcgggcggcgccgcgcggcccgggcgggggaagggaagcgagcggccgcacaaaatggcggcggcgcctggtgcgggcccgcctgaccccggcgcttccgttctcctctctcgtctgcaggtggcgatggctacagggcaggtgctgttccatcggttcttctactccaagtcgttcgtcaaacacagtttcgaggtaagcgcggcggaggcggacaagaagggatttcttcatccggaagcggggaggaagggggtaggaaccagcttttccagaaagggagtggttagcttaggcctttgtacctcgttcccacccagaaggaaatggggcccgtagagcaatgtttcaagaactagaaaatggatccccagttcacgtgctctgttaaccaagaactacgttttcaagccattgcacaattctagcaagaggtagcttgattctgacccaaaattaagagcagttgagcaataaaacgtaagagctggtctaaaaatgtcagcttcgattttatttcgctaaaaagcccgttgtatcctaaagagggttctttgccggtccttggtgacccacatccttgggcaggcagatgtacatacagatggagttcctggaagccaggactacacagagaagccctatctaaaaacaaaacaaaataagggttgttagactttgttaaactgtttctagtttaacttcacttggatttttacctgggttctttcagattgttgctatggcctgtattaatcttgcgtcaaaaatcgaagaagcgccaagaagaataagagatgtgattaatgtattccaccacctccgccagttaagaggaaaaaggtaagattggcctgttgaacatagtatctcttgctgtactgtgcaccaatcatccagtcaaaacatcttctcccctccctcaagtcagtgtggatgcaaaagaaagcggacattaggtgctgaaattcacgtaggaacattgaaacttttaaaatcccctccattaaccagctatctgaagtttgtagagacagttgcattgtggacaattctagagtgctgtgaagccagtcccttggcttaagattaaacaagaaagggagtacggttggctcaagtgggagtgtattctgtaagttgtgtttcccctcccctctctggaaaactgaaggctggacatgtaagccctgtagttcaagttaatgttgtggcaaagttccgtgtaggtcgtttttctgcttggagtcccagtttcttcatcaattgaggttggcttttgttagagtacttctcaacattgaactacgatatatcgcataatgccgcatctgaaaggactggaggatgataaagtttgaagtcaaagggattgaacaggtattctgttttggtcagatgtagtctcagtgagttccttagaaaaataactcattgagttgcttcagatagggctctttattcgatcttgtaagaaaatagagtctgaaacagtatcttttaggtgtagtgataccctggtaactttatgtgggcctataaggcagtaccaaagcttgttgcagtactccaggctctacaggtgattctaggacaggctgatggatatttgtggtgtagattagtttctaaggaactgtgagcttggaaggaatttagctatgacaagataacctgttttgggagttgggtgttgcttagtcctaatgcgtattgaacataggtagtctttattgtggaagctataagttggtggtagtggaagtttgaaatgagtaacacagtcaatttttatagcatttttttctctatactattcagccccatcttttctaactatgtgcccagatacaatttcttctgtttgaaaacatttttagttctttgtgaagaaagttgagaaatgggggagtttcaaattagtgtttagtatgttctgagcttatacttgtattttagattacatggctgattttttttttcagggtgtttttacaaaacactgaaatacagaattcttatttttagtgaataaaggaacattttctagtagtatatgagttgttgagccaactataatcacatgatcgtttggtgtttttctgtgggacttcttccttcctaggtgtcagaataggatcatctttttataaaacttcaaaatttaaaataattcaatctgactggcttgtattggatataaacttcatttttgatcatcattaaagagaaattgattttgtttcaatgtttcaaatttgattatagcatgaaattcttaaagaagttaattgcatggaagccccccttttaaaagcaggatataagtgtttctatgcatattacaagtttactcagacatgtaacttgtatatgttattaacttcaactcttttttcccttgcaaccgactatacagcgaccagctacatttaccaaagcctgggtgatgtggagtggtacatagagatgaagctgtcgtcatggcaacagtgagtgaagtatcgaaatccccaaggagaagccagtgttctgagaataggtcactggaatcggggactaacaggttggccactggtgaaccatttagagaaaaacaaacaaacaaacaaaaaactcctgtttcttgttaaaagcttttgtctttgctgtccaagttattaaaactatagctttaaaaggtggtggggtttttatttatttttctttttttctttccctttttcccccccatagggcatggttagaaagtattcataaatgttttactctgatactcttattggtttgtcttgaattttagtccaatttgtgcaaattaactaggttattctatggccttgacaattacaaggggtacatagccttttctagtcatggctgctacatgtagatagtacgatcaagtgtttgaagaaaaacaaaacatttcagtcctcagtttgagataattgacttatctctcattagttttttatattttggtaattctttagaatagctgaattcaaaggaaagttaaagctatttatatccgcggtttacagataaaatttgctgtttctatgtaatgttcccagtcttctctttaaagaagttaaggtttctgttacaagaagataaacttgtaagatttaactacttttattggtggctgtttattctgttttcaatgcataaaaccttcagtttgttgacattgaaagagtgttcctatttaaaaataagctttagagatttctgtgttgagtagcagtcttgtattagccatctgtttcacagtatacttccttgaactactttcagagtatcagtccttgtaactcatgagtgagaccagccatgcttgaacactcccagtctaaatgcttgtaattcatgtgtttcaggcatactacagaaagtaactatcatataaattcttaataaccagagaccaacatttcctaaagacaaatttgttttccaataagttaatgagcaaataaagaataggtaatagagaacctttcccaggtggcgtctggtggtcttgagtgttactacctatccctgagttctctgagtacatgaggcttgtctcccttagtgtgtatgtgtagtgccgcctctgcattgttgatcaaggatgtttacctgattgggaagacagtctggcaagccttgattcaactttctgtgttgctaaagatattcctaattgatgactttgctaatataaatgctaatatagaaagcttctgctttaaatgctttttcagaatcttcacttcctgatttatggagatttttttctgggtttcatcatggtataaaatattaaggtagttgacaattttgtattcgttgagcctgccttgatttatgaggtaaaatgaattctgacaagagtatgcatttacagagctagtagtggcaagactgagtgagcttagatggttgagctttagtaagatcgttagtgggattgtttccttggcctgtttgaaagttgatgagaggtttggaaattaagactctggctgtgtcgtacagggtgtccagtaatttatgatccttgtgctgaaccccttcactcttgagattaaacaaaacctttataggttcttgcagattctgatgaggtggggaatgtgcatacggcagaggaatagtagatactttaagcagaattagtgatgaatccttatttaatttggcaccagttggtagccatagttttgaaacaagtgttctgtttgcaaattttattacaattgaaaaataatttcataatttaatgtttgaagaaaagtgagacagaactctgtttgtgaactgttcgtatatggatttttaatggtgctgtttactgtctggcttttaggaattgaattcagagccaagctctgtacagatgatacactgcagcctctttgactcccaataccagttgaaggggaaccttctaattagtctgtattgggtttgtctccaaaatttcttagaatgcatataaaacctgaaaaatcatgaacttggtgtcattggagtttttctccataaatgggttgctcccatttgagttaagtcgactttttctccaaaagtgcagtttatagctattctgataaagttgattcaaatcaggccatttcttagactttttgacgctgtaattgaaattgaacttaatgaaattttccatcatttgttattgtttataattctgccatagcttaatgcagagttacagaataactgggtcttgtttttaagtgaaaacaagaaaaatataattgggttttactcttgctagcctgctaccagggaggtagttaatgtacttcatttcagatttttttcagtcttgagttaactcaggtttgcctcagctcacctgatggagtggaggatgtccttgaactcttatctccaagtgcctctaccccaacccctgcaaagtgctgggattatgaggtgagccactactcatggctcaatattacaggttagattgttttattacttttaagtggatataaaataggttggttttctgttgttgttgttttttaaaggttgtatatttgctagtataatctcctaaaaagagtataagacttggtaacttggatgaaaatgaaatgagtatttaagaaaacattacaatgttactctgacaatatatttattgtagagtatttaataaaaatatacaccttgctgtttaaaggtaagagtatatccaaaaaaacatgataattactaaattggcgggttgtaggaaaagccagatctggttgcacttgcctctgacgggacacatgactggcttcaggatgagctccatagaaagacttcatttatatttttaaaggaaacttatacacaggatgatttgaggttttgtttttttgtttttttgtatatatgagtggttagctatccctttcttcccctacaactctggggcatccctcacaggtcacaatgtggtctgagtctctgttccttctctgtgcccttaaaatcaatctcataggaacgacattaaccaagctctctaattcactctctgacctagttgtagagatttcatttggcaactgagctgacttggttttgctggggatgagagggagtgctaactaagcacttcagtattcttggagtatttgtctatagcatggtatcccaaaagggaagtcagaataactaccttttgttttctttagcttttattttgaccaagcatttagcaaagggtttatattcagttttttaaaacctttgttcatgttagaacttgatgatcaatcttttcagaagtatattgtctttggaagcctgataaggtttgtgctgatattgaagctgtgttgtaagttcaaaaggagagttgtagatctaagagcatgtgagttttaagttgtgttagatttgtttttttttaagttgtgttaggttttagagctttgtctacttaagtatagttagcataacttggacagcataagattaatgctttaacttgttagcaggagtttaaaaagctggtttctgttgccaatagttggttggaagggaaaatggagatgccacaaataaaattttttggatgtgcaaaacagttttgattttatttcttacaaactataggactccaagccccctgatccttgatcagaactacattaacaccaaaaatcaagttatcaaggcagagaggagggtgctaaaggagttgggattttgtgttcatgtcaagcatccccataaggtgagttgtaaagtacagacattacaattcgtaagtattagggctttttctgaaattttgaattcagtgtggagagttaagttaaccggagttttcaaaagctttcttttggatgttgatatttgtttttaaaatgggattcagagcaggctttattcttctttacatgaaaatgaataatctttgtggttaaattctagtttttcctcctaacacattcttgtgggattcttgacagaaggaatgaaatgtacatatctgaggaacgtgtcacacttcagttgttgaaggtggtagctgcttactgtaaaccatgaataagagcttttccttggctttcatggtactcttctaggcagtagtcctaagaactgggaccgagatggctagctctgctgatagccagatggcactcagcattcaccatctgacatgtgatgattaatgtaggtccagaaacagctatcataaacttagtagctatgtgcacttgtgtcttgctgggaaccaaatgcaagacagtatgtcagtcattgatatatgtagcttttatttaagaaatttcagtatgctacgctgtactacagaaattacttagtgttctagaaaatactgtggccattgtgtacttaacataaagtttaccctttttggtgaataccctgagaaattagaaaacagttattaaccacttttataagcacagtttttaaaaattgagtaatatagtaaccaacattgggtctcatgcatgttttatttaggttggtgtatatttgtaaatttataagaattgtaactaacattttccagttgttttattcattgaactctgcggtgaaagaaccaccaatatgctaagtggttttcttttctcccttgtcctcagatcattgtaatgtatttacaagtcttagaatgtgaacgtaaccaaaccctggttcaaactgcctggtaagttcctcttttacattgcttctttagtcaggaaaacagaagcagaaataaagtaagtttcatttttctctttccaaaataatgaaataagtttgttttggggcattttgtggttttgtttgtttgtttttgttttttaaccaaaaggtaaataatgcttatttctgcttcctgttttcttggcttgactaattacatttgatggagaactcaatttaactttgttcttttttctactctttaattaaagggtagtccatgatggtaagtcatagaactctgccctctgcacttcagcccatgacctcaggatggcctgattggctagcctgctctccagccagtccagtgcaagctctcatccgagattcactgaagtggtccatacccatctggcagcgtcttctagttctgtcggggtgtcaaaaggatttgtatatttgcttctagaagtaactatgcatcatgcctatgtattatttcatgtatgcctgtgactatcaaaatgactatttcatttttgatagattgttgtccagccattatgaattgttttttttttgtttgttttttttttaattgggttcagttaaatttcaacttgcggtgtgtatagcatccgttctaccaaaggaggctgaggctaccttacacttgtagctttaaatgggtacccattgctgttttttaggtatctccagctgttgagctactgcaggcagtgatataagaagcaattaattttaaaaagagaagttaatgttctttaaatattttttgaccttggacctttgagaaaggctaagcgaggaaattgtggtttagtcatagatgattcatgtaactgctggtaaacaagcattaaataattctggatctttcagaaatgtgtttttatgactgccatgcttctctcggattcagtagacactgaactgtaacatttgaaaaaccacatctctttataaaatgcatgagtttttaacgtgtttatgtagcaaatacagtaatgagtaaaaggattttatagaaataatccatttaatttccagctcaggctttttagcaaattgtaaagttttctatttaagaaatttcatggggaagcttcactagagatttctaagtttatttaattgaacttaggtcattgtttttatttatccgtaattgcaaaaggtatattaaacaaggctgttgtgacgtatttattgttcacttctctacctagttttttgcaagtgtttttttgtttttgtttttttaattataagtcatttggtgggttcttactaaaaatgcctttttacccctgttgatagtatttttaaagaacttgattgacactgcttttcgttatggataaaggagagatggtcagtaactaaggcttgaagtcttgttgggagtggtgaattctgaacttgtgtcagaactgacttccaaaacattgctgtctataactgtgtgttaggaggcggctttgggagtaagatctatgtgagtaatgtagaattacttaaagtgctgtggggaagtggttagaaaatactacatggtacaatttaaagatgtgaatataaggagaagaaaaaagaatgaagtagattgagtctccaactttatgtgtacttcaggagaactggtttgcttatgaactaaacttagagctgaaatgtttttcaggaattacatgaatgacagtcttcgaaccaatgtctttgttcgctttcaaccagagactatagcatgtgcttgtatctaccttgcagctagagcacttcaagtaagtatttagcctgctgtgttttgtaaattccaagagttttgttacttctgagaaagcgtacatttgaaccattcttcttttgtttagattcccttgccaactcggccccattggtttcttctgtttggtaccacagaagaggagattcaggaaatctgcatagagacgcttagactttataccaggaaaaaggtaatctcagttactcggttggtgctgatgccattttggagattgtaactgttataaaaggaatactaactaatgtcactttcatccatcagcctaactatgaattgctggaaaaggaagtagaaaaaagaaaagtagccttacaggaagccaagttaaaagcaaagggattgaatcttgatggaactccagccctttcaactcttggtggattttctccagcctctaaaccatgtgagatacattcagaattaaataaaatgtaggcactggaagtgtatcctccttagaaagttttggcattggtcagttgcctagaaaccattaagaaattgttagtattgtgtgtgttgggtttttttgttttgttgttgcttggtttggttttgcgacaaatcagcttaaggattagaagtatagtgtatgttgtataggaaacttctcctcagctaaatcctgtttttaatatgtccttttccattaaaagcatcaccaagagaagtgaaagctgaagagaaatcaccagtctccattaatgtgaagacagtcaaaaaagaacctgaggatagacagcaggcgtcaaaaagcccttacaatgggtaagtatgtatacctcaagggcttgagcactcagtgttacacctttgtaacaggtggtacacctccggaaacaatataacaaatattgcctgcatttttttttaagtgtaagaaaagacagcaagagaagcagaaccagcagaagtgctagtagatcaaggtcaagaaccaggtcccgttccagatcacacagcccaagaagacagtaagtaaggggtcctgggtggtgcaggccttggactcttaaaattaacatgttgtttttttttttttttttcctccagaattaggaataagtatttcatgtttttgtatgttgtgttttgttttgagcaagttttagtatatagcattaatttgctaggaattacttggacttttagcatagaggaaaaaactttggggacaaacttcaaatgtatgtgtgggtcccagggactttgggcttggtagcaggcatctttacctgatgagccatttcattgactctagttgtgtgccttaatagcatttttgtttattctggtcatatatcccgaccctgtcccccatagtttcttgaaatgtccaggcaatgtgtgtgtgtaggtgttacttatgtgaaaaatgccttctatccagtttgttagaaacgtgactattccgctaatgctgtactacacaacctaagactcagtcagctgtgttaacagctttcttgtgatgtttcagcatgtgggagcgactcagtggaaaccgtgtagctttaggacacattggcgatgcactttactgaaatagggtgttttacctaacaataaagcttcaattgaggggtcaggatggggagagaggaacatggtcagtcattactcatagctaattgtttgaacttgttaatgaacaacagttattgatctgttgccagtagacactgaacctaaacttgaaatttttattgtcttaagttataataataggcgaagtcgatctggaacatacagctcaagatcaagaagcaggtctcgcagtcacagtgaaagccctcgaagacatcataatcatggttctcctcaccttaaggccaaacataccagagaagatttaaaaagctcaaatagacacggtcataagaggaaaaagtctcggtctcgatctcagagcaagactcgggatcactcagatgttaccaagaaacacaggcacgaaaggggacatcacagagacaggcgtgaacgatctcgctcctttgagaggtcccataaaggcaagcaccatggtggcagtcgctcaggacatggcaggcataggcgctgactttcatcctctgacactgcagcggttcctggtgttgcccatatgcagtgtaatgatgtgtggactcaatcgaaacataaaaaaaaaaaaactgattaggaaatgatttattaaaattgtctaggtttctagaaacactgaggacattttctttggaaaagaactatgttaaggttttttgcacattaaaatgccctagcagtatctaattgaaaaccatggtcaggttcaattgtactttattatagttgtgtattgtttattgctataagaactggagcataaattctgtaaaaatgtatcttatttttatacagatgaaacttgcagacttgttgtatttaagtggttatttgtttaaatgatggtgaatactttcctaacactggtttgtctgcatgggcaaagatttttacaaggaaataaaatacaaatcttgtttttataaactgtttcaaatatcttatttagattgccaagaagcaaaatttttatggcagataactgtttttttttgcagaggtgcagtttagaataattacaatgtcttgcctacattatgtaatggccgttgtgtatataggaaaaggaaataggaatggcctggtagtgctagcaactaaatgtaaaacctgattggaacctaatgtatcagaagataattttgaattaaaacttgtaacatgaatttaccaattgagcaaagctacagcctaatgctaagacccaattatgagacttttgaatgttttagcatgactgacattggtacagcttaaatctcagaatatcaaattcagtaatgaggtcatacggtacaagttgatcacaaagggtatctggtatgctactcagattgggttatgttgagtgtattgtatatatgaaaggtatgatcagagcatcaccttggatgtcagttctgtgggttccagtcatattagcatcaccaccaggtggcaagcacatttaccctctacataatttttatttatttttattagatatttatttacatttcaaatgttacccctttcctagtttcctttccgataacccccctattccttctatccctatcccatgctcaccaactcacccactcctgcttctggccctggcattccccaatactggggcattgagccttcacaggaccaagggcctctcctcccattgatgacagactaggccatctgctacatatgcagctagagccatgagtcccaccatgtgtttacataattttttaaaacttgtgttttttgagacattgtcactagctctcactgtcctagaactcaaaagagatacctacaaccaaccaaccaaaaagaccagctgcaaattgataagaccataaaaatgtatagcacagacttggaagataggagtgtggataaaagccatacttttaaaccattcattatccaatttttggcctttttttttttttttttttatttaaatgttcatcgatgtgcatgtatgtgtgtgtgagggttagagtcgagctgccatgtgggtgctgggatttgaacacattctctggaagcatagtcaggactcttaactgttgcgctctctctccagcctccatgcgttccacttttgttcttgtcattgttgctgtgataaccctagcatccaggtagtgctgcccatatgcttgtgggggtggggctatccaatgagggcttgcacagcctgctgacaaccatatcaccagagagtgactgcctcagcaaccacacttgagtaattctgcctaaatcttaggacctttttctaacttctctcatacaacatatccttaccacagtctcccctctctccactcttcccagctccacctcccctccccaaaatccactgctcctttttaaaaagtacaggcttctcaaagatagtaactgcatggcataaccatgaaacaaacatcaagactggatgagacaaccccgtaggaagaagaggatcccaagagcaagcagaagagtaatatcctcactcccataaaaactaagctaaggggctggagagatggctcagtggttaagagcaccgactgctcttccaaaggtcctgagttcaaatcccagcaaccacaccttatgggatctgataccctcttctggtgtgtctgaagacagctacagtgtacttacataaaataataaatctttaaaaaaaaaaattaagctaagcaaccacagcatgatatgcacaggacctgtgcagagtgaagacccatgaaggctctaattgctatagtctcttgactgcccttccagaggtcctgagttcaattcccagcaaccacatggtggctcataattgtctgagacctgatgtcctcttatttcatgcaagtgtacatgcagatagagtgctcatacatgaaggaaggaaagaagggaggaaaggaaagaaaagccatattttgattttgatcagtatgcacacagaactagctgggtgaggcttgtttgtatcaaagtctatccaagtttaagagaaccagtacctgtcatcagctctaaaagaaatgatcaatttttatctaactcttcataccgtaaaaatccattacttcacatccttattggggaaaattgcacccagagtcttatccgttttaatcaaaaaaaaaaaaaaaatttccagacagcctcatgactctggtctagtgagcagtaacatatgaccctgtcagtgcatttctttagagccctttttggctctaatcagactggattgtaagctgtgaagtttataaaattgctttcaggctatttgtgaaaggtgtctatgaagctggcctttaatttgtgagtttttgttggggggggggggggcgggagcaggggtgagaccagaatccttgtggtccccctagctggcctggaactctgtgtactagactagtctctaactagcagaaacctgccaggctccctgccacacaccactgtgccccgctgaaacagtgtttacacttagatcctaactccataatcgtactgtacacatgtacatattttaaaatatgcaaacagtcatttttttgttttgttttgttttgttttgttttacccacttccctttctccctcttgctccagccctgcgctctgggccctatccctcaggctcataggtttttaaatttgtttatttgtttctcattacagatggttgtgagccagtagttgctgggatttgaactcannnnnnnnnnnnnnnnnnnncctccccccttgtggaggctaattctcatgtatagttcaggctttgtttgtttgtttgtttgtttggttggttggttggttggttggttggttttggttttttgagacagggtttctctatgtagtcctggctgtcctggaactcactttgtagaccaggctggcctcgaactcagaaatccgagtgctgggattaaaggcgtgcaccaccactcccggctttcaggctgactttgtacttgcaatcttaccacaacctccaagtgctgaggggttaaagcaaattccagcactcctggttaacattttatttcaaagtgactttagacaatgaaaatatttcaaaaatgcacagacctcactcagattcctcaaatgttatcatcccctctctgtcttttctgatattttggaactttctctttgtctgcaagtacataaatatgtatttcatcttagaaacaaagctgttagtcacactataaccatccaagtgtgggatctgttgacctcactcaactgtattatttttcttgtaatgcctattttctggtttgggatgtaattttgaatcgttttgccttgagttctttcatggtttgcttgtaatttcctttcctttcctttcctttcctttcctttcctttcctttcctttcctttcctttcctttcctttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgatattttttaatggaaaccagttgtttgcaaaatatccttcaacttggctatatactgtgatgagatattggtttcgtgatctgggtaggaatacaatggaaatggggtcaggcagaaacatcattttagttcatgctgatttgcctcactaactgctgctgctaattaacttcagtccctgcttaaggtgctgacagtgttctttatgaaaacaaagtatttttatcattatgcattttgtggggtaaaaattttaagatcatattgtttataaatccttttacctgttggaactgtagaccagtatctgctagacatgacaggacccctgtagtcagcaacacggcagcttttgttgccttcaaaagatttgcccaggataaagccagttaacatcctggcacagaggggggaggggctcacaacacacccccatccccctctctctgaggcactattgacagaagagactcagttttgttttgtttttaaagttgtggctcctgataagtggacaaagcaccagcggatgacatcatcaaatatatagactttgtgaattagactcagaagttatgaaaaaacaggaagttgggaggcaggggtggacaggaagtggatcttggaggagtggaggttaagatgaaattctcaaaagaatttggttaataattccagcattccctctgtcatttgtgtttcatggtgcaagttcaccttcatttcttccttgtcttgttgctacagcaaaatccctgacaaaaatcactggaggagcgggagagatggctcagcagttaaggacactgacagtgggtggtggcggcacacttctttagtcccagcacttagtgtttgaggccagcctggtctacagagtgagttccaggacagccaagggctacatagagaattccagcacccacatggagttcacaacggtaactccagttccaagggatctggcaccctcacatagacacacatgcaaataccaaagcacataaaatataaataaatcttaaaaaacctagagacaaatatgcttatagttacaaaggatctagcccacgatatcagtgaagatgagggaaagagagaaggcggctagtcatactgtctgcaggactcggagagtaatgaaaacctgtgttcagtttgctttcttttctgcagttcaggattccaagtcatgaaatggtactgttcgaaataaggtgggttttcctacaccaacctaatctagataacccttcctaatcattacctgatacagatacttgtttctatggtgactgtaaatcccatcaagctgacaagattaatgccacccctacacacgtcgggtggagtgggtatatttttggtcaagtatctcagtgtggccaatattaatatattaataacagtcctttggcgggtagggatgctgggaattcaactcaggacttcatacaccgaggcaagcactgagctacaacctcagtcttgaaagagtccttgtgtttcattaataatgcactctatttttttttttctttaaacataggaaaccaagcaagttgactaatgcatgcagagcacgccatgcaggagaaagctctacagactagggctgtgagcagtggctcagtacttaggctttaccacagcattctcactaaaggacaggagggttttagagaggtgggaaaatggacatgaggtgtggccttggttttcatggatgcttccttatgaacactgagtgtggaaataagccagtggctcgtggaatcctcagctacctcatctgaattgctgagaggtcccattcagtgataaatgtctgatgttccttgcagacatgggagtggagacctctttataattttatgtcctgatatttaccttggtttggcaagccagggtttctctatggtgccttgactggctggaaacttactctgtagtccatgctgacttcgaactcctacggatccacctgcctctgctttcctcccaggtcctgggattaaaggtgatcagccgtcaccatgggccagctttatgccctgttttaaagagttttcctgactgctgcctgcaggtcaaaactattcatgttaaagagacatattttgggatgatatattccggcttccttcacaactactgaagaatttacaggcaagacacgcgaatccttttaggatacacctaatgaagaaaagccacttcacatatttgtacgttaattataaccccacagccataacagctttctgaacaactgacaagaaatcctgagctttagttcttccttcccttgaggatctgcttactcaagatgagtactgtccaacttcatattttctcctttcctttaggctcagggaaaacataagcgggctcattacacttagggtcagtagtagtgactataaatttccaattttcaccatggccttttctgctttctattccaggttgatctttatgcaagtccactggtttccacagttccattcaacctctcttcgtttggttagctgtggaaatggctttttcccccttagaatattccttcttaagatcctgtgtatttactgtcagcatttccagtccctgcttatggccgttttcatttatctcagcaagcatttgtaatacttttacaaattttttttaatgtaatactttttacatttatcttccttttctagaatgcgattttttttcctgctggtagaccagattttgatattccagaaacgtttcaaccagccttcctttaaaagatggcttttgggaacctggtttctcagagttcttgtaggcaatgcttatccctgaatctgactggagtgatctccaagactgtttcagaacccgttccagaactcgcttatgcacgttttgaagaatgcaagtttatctccactcattgtccaaaaggatcaggggatctagtgccttctccagaccagacaggaagccacagtcaccaacagcccacactgctccatagctgctaaccttggatcagatctgtggactactcctgcctctgctggcctctcagcctcatactgctgaactagcacacatttgtcacaacaccaaggtaagataacactttaaaaccttttttcacatatgtgacttttaaaaattgatgccatttgtgtgttgggaacaccagcattagctagaaagcgatggattgactttaaaggtcatgataactccttggctactattttcagatttgtcctcttcatccacgacaatccttcccaaacatgatcagtctccacatgggcaatcttcctcacgcagagcatggagattgcaatatagatctgtagtaaatacatttgccactagaggtctctgtcaggctgatcaggatggatagtctctctgggttttaatcagttgatccacaaaacctttttctgagcacatagggaactgtttacaaagaagcacaagttatcttgagagttcctacctaatcctttgctgaattcttctagctcaattaaggcatttacatttacaacccttttagtaaaagtgctttgtgtctgatgacagtcacatataacttcttatcttccttaggttattagttaactgcattgctgggaattgaacctgagaacgtaagcatgttaaacaagcactcaactagtgagctacatttccagccctttttgtgcgcctttccaaatccacaagattgtgatgtgacacctctagtaagtgacagccactgtcacacccaagtcagccatcagtatcactttggggaagtgaacatggatgttccccaggcacagggcatcctgtattctccgagggcatgtgtgttcgtgtgcacatacccacaccatatacacataaatttaaaaaacacttttaaaaacccaatttgttgcacagtcaagatacttagccagtagactatatatcagtctactgtcttcactgaagtcctgttttaatctatctttttgtttccaagtcggagtttgctgacatctttctgaagagtctttatgatgagactaaagtggtcagaggccctttggagctcagtagtagatgctgctcaccagctcagtgctacaggaaccagtccagcagacatatgcaagtgcttattcctgagtccagcctggcctttaggtgtccaggtcttgagatagcccatccagggttgggcttagatgttggagggcaccagttttccaactttagcgtctgcttcctggaatcgacgtctgcttgctttggaaacttctcaagttaaacccccaactgcctgacatggggtgatgctgatgaaggaagggatatggaagtagtgaggaagcaaaggaacacaggctctaaagttaggctgatcttccttagaagtctgcagcttctacttagtggcacagttacttagcctttctcagcccaagtttcttcacctgtggattatctaagataaagtttcccatttacaactgtggagttagcaatgtgcgcagagatgctggcacacaggagcaggtgctctgtcctgtcatcacttcctgaagtcacagcctcatttccagcaacgagaaaagagctgcccggacatcatgtgctaagcagagcgccagcgcttccttcttaaacactagcaggtgctattattccttgagtattgaaaactcattgctatcatgtcggcaagcatcatttcttatgtttgacttgattgtccaattaatctccaaccagagatgaactcttcattcctctttgtgtcccttcccttaactagagtctctaaacagcaagtactcaacgacagcctgtggatgagagagattaacagaagtcagttcccaggcattagcgtggtatgtacatgttagacagtggccctaacatgaatggaaatatagaggtgaaggaaacctcaccagagagcttctgctgccacaagaactttcttgaaaagcctgacagccgtcttactcctggggaaaaacctcctttgttaaggcaatcgaatcaagtgtcccaaacggaagattaaagtcaagcgcacagccagaagccttttcacaccgaagaacacatcacatgacatttagtgccaggccccctcggatcgtgtaggaccccagaagctgttccttgagaccaggcccgaaatcctgttcaaactagtgtgagagcccagagtgggggagacagcctgaccctgaagctcttttaccaccgggtgtcagcgcagtttgagcactgacacttgccaaggttggattcccctggtgacggatggcaatgctccagtggcccctggcgacacatggcaatgctccagtggctgtagacttgttctctggtggagaaaggagagaagatgttgaattcaccgtttgccaaaagtcgtgagttccacctatgcaagtatttttagtgcaatgaagaaagagatttgagagttttaggaaaacatccctgaagatcatgataacagaaggtatattatgcatcagcaaaagtgatactttctttttttttaagatttatttattttctgtatatgagtacaccattgctgtcttcagacacagcaggagagggcatcagatcccattacagatggttgtgagccaccatgtggttgctgggatttgaactcaggaccttcggaagagcagtcagtgctcttaaccactgagccatctctccagcccccaaaagtgatactctttaatttgcaaaaaacaaattgaaggtgtgtttccaggaaaaaaaaattggaaattaagaaaacaaaaacaacaacaacccccctaaaacagtttttagtaaattatccttcctccaaacagaaaaggttctggctcggaactggcaagcaaccgatccatgtgagcaccccataaacattcaagggtgaaggaaatgtcctcagagcataggaaccatttttgcctctgcaagaacccctttgaaatgcc

SEQ ID NO: 1910 - DNA, 2016 bp, Mus musculus
cgccgccgccgccgctgccgcctccgcctcgtccgccgccccgagcgcgggcggctccagctccggcacgaccaccacgtacgacgaccacgaccggaagggatcctgatcggcgaccgcctgtattcggaggtgtcgctcaccatcgaccactcgctgatcccgggagaagcggctctcgcctaccccgtccatgcaggacggcctggacctgcccagcgagacggatctgcgcatcttgggctgcgagctcatccaggccgccggcatcctcctccggctgccgcagtgtggcgatggctacagggcaggtgctgttccatcggttcttctactccaagtcgttcgtcaaacacagtttcgagattgttgctatggcctgtattaatcttgcgtcaaaaatcgaagaagcgccaagaagaataagagatgtgattaatgtattccaccacctccgccagttaagaggaaaaaggactccaagccccctgatccttgatcagaactacattaacaccaaaaatcaagttatcaaggcagagaggagggtgctaaaggagttgggattttgtgttcatgtcaagcatccccataagatcattgtaatgtatttacaagtcttagaatgtgaacgtaaccaaaccctggttcaaactgcctggaattacatgaatgacagtcttcgaaccaatgtctttgttcgctttcaaccagagactatagcatgtgcttgtatctaccttgcagctagagcacttcaaattcccttgccaactcggccccattggtttcttctgtttggtaccacagaagaggagattcaggaaatctgcatagagacgcttagactttataccaggaaaaagcctaactatgaattgctggaaaaggaagtagaaaaaagaaaagtagccttacaggaagccaagttaaaagcaaagggattgaatcttgatggaactccagccctttcaactcttggtggattttctccagcctctaaaccatcatcaccaagagaagtgaaagctgaagagaaatcaccagtctccattaatgtgaagacagtcaaaaaagaacctgaggatagacagcaggcgtcaaaaagcccttacaatggtgtaagaaaagacagcaagagaagcagaaccagcagaagtgctagtagatcaaggtcaagaaccaggtcccgttccagatcacacagcccaagaagacattataataataggcgaagtcgatctggaacatacagctcaagatcaagaagcaggtctcgcagtcacagtgaaagccctcgaagacatcataatcatggttctcctcaccttaaggccaaacataccagagaagatttaaaaagctcaaatagacacggtcataagaggaaaaagtctcggtctcgatctcagagcaagactcgggatcactcagatgttaccaagaaacacaggcacgaaaggggacatcacagagacaggcgtgaacgatctcgctcctttgagaggtcccataaaggcaagcaccatggtggcagtcgctcaggacatggcaggcataggcgctgactttcatcctctgacactgcagcggttcctggtgttgcccatatgcagtgtaatgatgtgtggactcaatcgaaacataaaaaaaaaaaaactgattaggaaatgatttattaaaattgtctaggtttctagaaacactgaggacattttctttggaaaagaactatgttaaggttttttgcacattaaaatgccctagcagtatctaattgaaaaccatggtcaggttcaattgtactttattatagttgtgtattgtttattgctataagaactggagcataaattctgtaaaaatgtatcttatttttatacagatgaaacttgcagacttgttgtatttaagtggttatttgtttaaatgatggtgaatactttcctaacactggtttgtctgcatgggcaaagatttttacaaggaaataaaatacaaatcttgtttttataa

SEQ ID NO: 1911 - protein, 521 aa, Mus musculus
PPPPLPPPPRPPPRARAAPAPARPPRTTTTTGRDPDRRPPVFGGVAHHRPLADPGRSGSRLPRPCRTAWTCPARRICASWAASSSRPPASSSGCRSVAMATGQVLFHRFFYSKSFVKHSFEIVAMACINLASKIEEAPRRIRDVINVFHHLRQLRGKRTPSPLILDQNYINTKNQVIKAERRVLKELGFCVHVKHPHKIIVMYLQVLECERNQTLVQTAWNYMNDSLRTNVFVRFQPETIACACIYLAARALQIPLPTRPHWFLLFGTTEEEIQEICIETLRLYTRKKPNYELLEKEVEKRKVALQEAKLKAKGLNLDGTPALSTLGGFSPASKPSSPREVKAEEKSPVSINVKTVKKEPEDRQQASKSPYNGVRKDSKRSRTSRSASRSRSRTRSRSRSHSPRRHYNNRRSRSGTYSSRSRSRSRSHSESPRRHHNHGSPHLKAKHTREDLKSSNRHGHKRKKSRSRSQSKTRDHSDVTKKHRHERGHHRDRRERSRSFERSHKGKHHGGSRSGHGRHRR

SEQ ID NO: 1912 - DNA, 32621 bp, Homo sapiens
catctctacaaaataaattaaaaattacccaggcatagtggtgcaaaccctgtagtcccagctacttgggaagctaaggtgggaggatcacttgagcccgggaggtcaaggctgctgtgagccatgatcatgccatggcactccagcctgggtgacaaagcaagaccctgtctcaaaaaaagaaaaaactaaaaatcattttactaatatctttattggatttttacagaagtatcattccacactagtttcccaaatgtgtttcttcactatagattgagaagcattgcaacagagaacttcagaaagtaaaatatgaaagcctccatcccacctacctgtgttccccaattttcaccaaaatgattttgttaccttccccaaaggcagcagcatcatatctagccttccaaatatatacatattgcttccttttttcttttttttgttaaattttgaaatgaggtctcacaatattgtccaggctggcctaaacctgtgacctcaaaagatccttcagcctcagcctcccaggtagttaagattataggcacataccaccatgcctggccagatatatacatatctctatatgatatatacataatgttatacaaaaggtatcatactatacatgttgtgttggaacttcctttggttcacttaataatatatctcagagatccaaccttttattttatttttttttttagaaacttttaaagaaacattcccaatgcctagaatagaacctggtacttagttgtcaattaataagtaagaatttaaagatgaatgaatgaagacaaactgttcacagctggcagatcaaaaatccctggccagaacaacaggcattaaccattgaccaacaccacatagggaatctgcatttccaaggactggaaaatacatgaattaatctataatcattttatgtgctaacaattttttgtggtaggtgttatcattttattggtgagtaaactgagcttaaataattgcctaaataagcaaattaatttacctcaagtcatgtagctttggatggtattttttttcccagtggaggaataaatacgcatttcttctcttcacctgcaattttcactggttgtcccacgcagaatcagagtcaggaaaactgtacgtagagaagcttttatcattttatatgttcctgtcttacaaagctccctctggcttaaggctggtggcccacatctgataacattaaaaaacataattaatatggcttatctgattttccagtgctattgagataaagatattactgaagtttacctttacttgaagaatctctaaggtcactgtatattttctagggctgctgtaacaagttacaggaagcttgatggcttaaaacaacacacatttattttcttatagttctggaggtcagatgtcctaagtcaggttcactggtctgaaatcaaggtgtcagcaaagccagattcccttgatgggtcctgtttagttatcatgctgacaagtatgatttagtcttgaattgctgactaaaaccaagactagttcgttctgacattaaataccataaagaatgaatctgtctaaagactgacttgattagattatttgcaatcagctaatatttattatctactatttgcaagtacctctttggaccttagttttcttgtgtgtaaaaaagagagactgaactgcataatattaactttagctctaaaagcaaatttgtgggtttgttgactttatagttgtttatgaaattgcctttggccatacatctccgtcacatatacccaatttccagacctatctccaaaactgtcccagagcctgcgtgtataccagacaccaaaacccttcaccatactgctttctgtgagtttctacccactccccagcccccacaatatacacaatctctttggttatggcaattccaacaggcctcttgttctgcagcccgtgcctgtatggagcagaagttatggactatttaagtagcccactgtaagaaaacaaagaacaaatgtggaaacacagctgatctgctacaaagtgctgcaaagagaacaggataaatgggggccctggaccctctattagggagagagggctgtattggtaggacagacacgtgaggatagaattagctcctgaatggaaaagaaaaggcaaaaccaggttgtctttgaaaggcactaggaaacaagtgggcaaattcagtccacgggtgctgattatgtgcttaacatacacacagtgtctaccaggtgctgtagaggatgcaaaataaatgtaaaatggtcttatttttgtccagacatacacccatgataagatcagtaataacgtttaatagtaaggaaacatgtcaaaatacataccagaggtcataaatgctaggagaggctctgagaaaggagaaaattagcataagttagattaggtgggggaaggctttcggcaaaacgtagaacatcccaagtctcaaaaaagttgctaggatttgattaacaaggaggagtagtaagaatttgcagggttgagaaatagaaggagggaaagtaaataacatgtttgttagtgagcagacaggtccaattggtcttggttcaggcagaaacacagtggggaataaggtgaggtggtaatgtcacaaggaaacagaagacaaggtaaatttagattgtggaaagcctcaactgccaaaagatatttaatctctatcctttacacttgatcttagtcaaaaggccaagaagtcacaatctctattttttatctccaaagtttttattcaaaaaagtgaggtagggaaattggtatttcaaaaagattgagagatttcccaggacaaataaggatgggagaaaatagagacaaggagaccatttgggaggctactataatggtccaaccatgatgtaacagcagatgtgtagctgtgagaatagacagaacaggggagattcaaaaacaatttccttcctagaaggaaggaccaacagaacttggtgattaacacaaaaagaagaaataagaaccaaaaatgagtctgaagttcgagatatgtttatgaccagagacaaataattttagacctgcaagggtcagactccctcactttaaagatgagaaaactatgtttgcccaaagtctcaggactaattctcaacagagtcagcagcagaatttccaggccagggctatcaggagatgtaccaggcagcgtatgcctaagtgttcattacaaatcatttacagagtgactgtatttctaatgaagagaacaaccagttcagagtgtgtgtactcatataacagagaggtcatgttttataacagtcatttaactacatgaacagctcatgcataaagtcaggtgctcctccctgccatcaatagaaatgtgattagcaacttcttaaggttataccctctccataatggcaacaagcatgacgacttatcccttctctgcctgctttttacacttgctggtcaccttaacatttgtctttctgtgtattgagtgtagctccttctagctggggacttaatttgcctaagttttggtggcaaggtattaaattcctgtggtctactggtgattgctgaagaaattaatggaatgatgccaattgtgattttaagattaaagaacctgaaatttaaataatgaaaaccatgctccccagagaggatacagagtctagtaaaatgagaactaatttaaacatcaggtgtatcattcttcagtagcctcaggtaggccactgataattccacttgtctcttcagttgtcactggaagcctgcctgtgttgaaacagtaatatgtaatgatatgtttacttatcattggatttccttttagacatgggtgaactcagggtctactattcagacctctgctgtgtgtgtacaattacagacttactattacattttttcttagagtgacaaggaattcaatcatttactttccagtagtctcatcttacttacctggattcatttctaataatgcatttatagtaggttggtgcaatagtaattgcgttgctattaaaatggcaaaaccgtaattactattgcaccaacatatacaattgaaacatgggcttggttgccgggtgcagtggctgatgcactttgggaggccaaggcaggtggatcataaggtcaggagttcaagaccagtctggccagcatggtgaaaccccatctctactaaatatacaaaaattagccagacacggtggcgtgtgcctgtagtcccagctactggggaggctgaggcaggagaattgcttggacccgggaggcggaggttgcagtgagctgagattgtgccactgcattccagcctgggcgacagagcaagactccatctcaaaaaaaaaaaaaaaaaaaaaaaaaaaaaggcgggggtggcttggccaggtgcagtgtctcacaacttgtaatcccagcactttgggacgtggaagcagcaggatcatttgagcccaggagttcaagaccagcctgggcaatgtagtgaaattctgtctgtacaaaaaataaatgtttaaaaattagctgggcttggtggcatgtgcctgtagtcccagctattggggaggctgaggtgggagagtcacttgagcctaggaggtcaaagctgtagtgagctttgatcatgtcactgcactctagcctgggcaacagagtgaggtcctgtctcagtaaataaataaataaaataaaaacaaaaaaacatgagcttcactcttccaaactttgaatcctttataattgtgactaggtcttaccctttccacttttgttttctttttctttccttttctttttttttttttttaaaggggggatggtcttactttgttgcccagactgggctcaaacttctgggctcaagcgatcctcccaccctgtcctcctaaagtgctgggattacaggtgtgagccactgcgcccagcggtctttcccaatctgcattttaatgttgatgttttgtaagtaggtacatttggaaaagcaaccttcctcaaagtaacagaaacaaggttaacacagacaagccctgtggattactcctataatcccaacactttgggaggcctaggtggacgggtctcttgagcccagaagttccagagcaactagggctgcatagtgagacccctgtctctacaaaacaatacaaaaattagtggtggtgcacatctgtagtgccagctacttgggaggctgaggtgggaggatcacctgagcccagagaggtcgaggcaacagtgagctgtgatcatgccactgcattccagcctgagtaacagagtgaaaccctgtctcaaaaaaaggtgtgtgtgtgttgggggtgggggtggggcggcggggggaggaaaagagaaagaaaagaatttccaaagtatgatttttctggaatttgaccctgaaagaataggacagagttatcattttttaaaattattttttccttccatccacagatatagactcattttttttaaaacctccatccttacaaaaccttggggagtagagccactagccccaatgccttccatcctctggattatccatgatttttttttttttgtcacctccaattagggtatgtcatagatttttaaaaaatgaaactaaagtttaaaataacatgacagtttgaagagttaatgctaagtaaatacctatataaaatattgacccaccccctccacctttgttgaagctggagggaggaacagtaaaaacaatcatgtgttgtcaataaaatgaaaggttctgtcagaaatgagtgggaaatgggcacaaaattatggaactgccctggatggctctgctctcctggaaatgactgccagatacaggaagcagagagtagaggtccactgggaacagatctcagaagtagagaggagcactgctagagagaaagggaccttcctcccaccctcatcccccagacttctccctcctatgcttgtgaacctttactggattaaccatgaatgtagtgggtaaaaatataaagtatatcaagacatcaccaagccagcttattgcagaggcatggtggaagactctaaagaggagaaaatcttctattaacatatgtcttaaaaataagttaaattggtcggcaaagcctgagttctgtcctctcaccctcctccctggacagcatgagcttcaccactcactccgccttctacaccaactaccggtcccctgggctctgtccaggcacccagctacgactcctggctggtgagcagcatggccagcgtctgtgcaggcgccgggagctctggctgccgaatctccatgtcccgctccaccagcttctggggcagcatgaggtccgggggcctgactgcggggatggccggggttctggcaggaatgggaggcatccagaccgaggagaccatgcaaaacctgacaaccacctggtctcctacctggacagagtgaggagcctggagaccgagaaccggaggctagagagcaaaatccgggagcacctggagaagcagggaccccaggtcagagactggagccattatttcaagaccattgaggacctgagggctcagatcttcacaaatattgtggacaatgcgttctgcagactgacaatgcccatcttgctgctgatgactttagagtcaagtatgagacagagctggccacgtgccagcctctgaagaacaacatccatgggaacaaaatccatgacactaatgtcactcggctgcagctggagatagattgaggctctcaaggaggagctgctcttcatgaagaagaaccacgaagaggaagtaaaaggcctacaagcccagactgccagctctgggttgactgtggaggtagatgtccccaaatctcaggacctcaccgagataatggcagacatccgggcccaatatgatgagctggcatgaagaaccaataggagctgggcaagtactggtcttaacagattgaggagagcaacacaggggtcaccacgcagtccatcgaggttggagctgctataacgctcacggagctgagacatacagtccagtccttggagatcaacctggactccatgagaaatctgaaggccagcttggagaacagcctgagggaggtggaggcctgccacgccctgcagatggagcagctcaacgggatcctgctgcacctggagtcagagctggcacaggcctgggcagagggacagtgccaggcccaggagtacgaggccctgctgaacatcagggtcaagctagaggctgagatcgccacctaccgccgcctgctggaagatggcaaggacttcaatcttggtgatgccctggacagcagcaactccatgcaaaccatccaaaagaccactatctgctggatagtggatggcaaagtggtatctgagaccaacgacacccaagttctgagacattaagccatcagaagcagggtaccctttggggagcaggaggccaataaaaagttcagaagtcaaaaaaaaagttaaattatattactctcaagtcattacaaatataggtgatgatttcattgaagtccagtgttttaatgaagtacataatcaatgagggtttttactttttatttggaaataagacatggaagttgcaaagatagactactcctatgtattcctccaactttccccaatgataatatctcacacaaccatagattatcaaaaccagaaaactgaccaggcacagtggtgtgccacttatagtcccagctactcaggtggctgaggtgggaagatcccttgagttcaggagttcaaggccagcctgggcaacacagtgagaccctggctctataaacaaaaatggaagaaaaccagaaaactggtgtcatcaattgtgtttaaggaaaccgaggctcctttaaaagtttgttataaaattatagatatctcataaatattgaggtggaaagattccctggaagcagcctagtcagaaagtgaagacagtgacatccagataggttaatacttctgccagcaccataattacactctcttggctgtacattccaatcactcgaagacaggcaaaactgaaccactggctgggcccaccttaaatcagtgacatcaacctctgcaggcaaggctcaagtatcagtacattttaaaacaactttgcccactgaaggttcacttaatcaactgataaggccgggtgcggtggctcatgcctgtaattccagcgctttggatgcctgtaatcccagcattttgggaggccgaggcgggcggatcacctgaggtcaggagttcaagaccagcctagccaacatggcaaaaccccgtctctacaaaaatacaaaaattagctggacgtggtggtgtgtgcctgtaatcccagctactggggaggctgaggtgggagaatcgcttgaaccccggaggcggaggctgcagtgagccgagatcgcgccactgcacttcagcttgggcgacagagtgagactctatctaaaaaaaaagaaaaaaaaaatcaactgataacaggcgattaacaggagaaaagggatacataacaccggggtaaaagcaggaggatgattacccagtagcttaatggagtacagaagattttatatctttttttcataggggaaagggtagatgagaaatgtagacatttattttgaggagcagcaaatgattattaggaacaatgaatggacagaaattagtaaataattttcttttgagtaatcttgtgaaaaagtccctccaggaatggctgcatttctgagtctttttgaaataggatacgagatttcagcgaggggaggaatgcgattgattcttctacaaagaggcttctctagtcaggaaaggaaatttcagagagtacctccctgcacttgggaaaagtgggagcaacaagtcaaggttgggggacctgcattatgaggcagcttctaaagcctctgtctttggggtatcgctttctgagcgtcaagagtaaaacgtgatgcattcctttccttccaacctagattctagtagtttagatcagtatcattgtttttacttcaaggttcaggaaacgctggaaattgctagctaatatcacaggaaaaaaaacaaaaaacacgaggttgacctcaccctacccgcggtaggtaaccatgtatgaatagagactcccaggcataatcaaattacctctgtcaagtcctcgccctaagactatttttggaaactagggattttccagattactgaaagccgtggcggtgtcaaaggccgggcaggagtttcgcaagcggagctatgaaagcagccactctcgcggtcattcctatgcctccgccctacttccccatactggcaaaaacacgctccccggggagctttcatttgggaaccgatagggtccacagccctgtgttcttcaaatactgtaaagcagccctctccagattccttgagggtcactttatattacacattcgtccacacaggacaacaaagtcaccacttccacccgccaaagcgcgctcaggtcggccgccacttcccttggtacacgcggaacgcaagccgcgccgaggctaaaggaagaggccggaatgcagggcgaaggggcgcagagatgctagccaatgctgccacctctattttgggtataagggatcttgtaaagctccgttattcgtgtggctatcacaaacaaggtggtttcgaccggccttggctagagaaggcctcctcagcctctgaggatcccaaggtctgtcgcagcacccaacactcccctcgcaggcccagatgccgagggcggaggcgcggcctggagggactagttggcgcgcggctgcccggcgtggtgacgtcagggcggaagcgcacgcggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtcagtgctccggccccgggccggccgggcgctcctctcctctcctccgttccctacgccgcatctcagtatcaccgtgccccgggagggtggggacggttccttcaggctttcccgttcggggcccagccgcggccagggcgtgccggggcggggggctgcggaggcggagggaggacttggcagcgggctgttcgcagcggcggcggcggcgggaggggaaggggaagcgatcggcggcacaaaatggcggcggcgcctggagcgggcccgcctgacccctgcgcttccgttctcctctcttgtctgcaggtggcgatggcaacggggcaggtgttgtttcatcgttttttctactccaaatctttcgtcaaacacagtttcgaggtaagcacagcggaggcgggtaaaagggatttcttcatccggaaatgggcagagtaggggtagtgtcagcagccagcttttccagaaagggagtggtttagtttaggcctttgtacctacttctcactcgccaggaagtggaaacctttagaatgtggttcaaaatcgatcacgagcctaagtgccctcttaacgaaaagtacagttttcaaccaaatgcagaactcctgtaagattgagtttgactctggaaccaaaattaagatgagttaaacaacaaaaagtatagtactagcatagctggtagacttacggcatagagatgtcttctctaattttactaaaggttgtcccaattgtgttctaaattttattcttcaaagtgagtttaatctaacaatggcttttgtggctcatgggttctttcagattgttgctatggcttgtattaatcttgcatcaaaaatcgaagaagcacctagaagaataagagatgtgattaatgtattccaccacctccgccagttaagaggaaaaaggtaagattggcattattgaacatagtatctcttgctactgctgtaccgtgcaccagtcatcaaatcaaaacatctttcctttcaagtgaatacggatgcaaaagaaaacggactttaatttaggtgttaaagttcatataggaacactgatacttaaaataatttgaaaaaagaaacataattaaccggttatctaaagtttgtagaggcagttgcatttatggacaatcctaacagtgctgtgaagccaggcctgtggcttaagattaaacaagaaagggagtacatttggctcaagtgtgagtgtattctgtaagttatttttcctctcccctctctggaagactgaaggctggaagtttaaacactgtagtttaagttaatattgtggcaaagttctgtgtagattatgtttttctactcgaagtcccagttaattctttatcaattgaggttggcttttgttagagtacttctcaacattgaactacgataaatcgaataataccggatctgaaaggactgcaggatgataaagtttgaagtttgaagtcaaagggattaaacaggtattttgttttggttagatacagtctcagtgagtgggttagaaaattaacaagtaagattgattgggttgcatttagatagggccatttatttgatgttgtaagaaaatacagagactgaaatagtatctcctaggtgttgtggtaacataattttatgtggacctatgtgttcctgtgaggcagtaccaaaaagtttgttgcaggacttcctgcatctacaggtgacttccagtacatgctgcagaatgatatatttggtgtagaatagtttttgcattcactctttaaggaattgtagtgatgttagacaaattgtactgagtttgaaaggaagttattaaaaggattataagttgttctgggggttgggtatgttggttagtgctgttagtattctatatgagtagtccttattggctgaatctgtaagttggcagtaatggaactattcagacaagcaaatattaaagcaactttaagatgactagtctattctgtgagtctacagacagttcttttttaaaaaaagagtatcctagtcaaaaagtctgcaacagttttcctacatactttttctcccccatcttttctcattcaccttaactgtgtccagggatagagtactttttaaattctaaaatatcttttagtttgttgatgagtccctgggaattgggaagatttcaaattggtctttggtatggtctgaggttaaatctgtatttagatacctggctgattcttcaggatgtttaaagtaatgacactaatacaaggctctatctttagtcaaaggtttctctttgcttaaaggaaatggttttctagtattctttgaaccattgagccaactattatgtaatcacatgattatcttctgtggaattttcctgtgagactagtttacttcgttgatgttagaataggtcttaactgtaaaaaccatggaatttaaaataatataatctcacctgattgttgtgtctgatgtaactttgttttttgggtcattattacagagaaactgattttgtttcaatcttagaagtctgattatagcaaaatttaaaaggagttgttaattgcatggaagcctttttttaaagcaggatgtaaaagtgtttctatgcatattacaagtttactcaagcacgtaacttgtatatgttattaacttcaactcttttttcccttgcaaccgactatacagcgaccagctacatttaccaaagcctgggtgatgtggagtggtacatagagatgaagctgtcgtcatggcaacagtgagtgaagtatcgaaaatccccaaggagaagccagtgctctgagaataggtcactggaatcggggactaacaggttggccactggtgaaccatttagaaaaactcctgtttcttgttataagcttttgtctttgctgtccaagttattagaactatagctttgtatttatttttgcataggttaatgtcattagaaagtactatcagtattatacattggttaggtaaagcatatcacttgtcttaatgatgctatttgttttaatctagtttattcataactttaaattgtagtgtgactttgacaattacagtggagatacattattcatgttgcttgtaggtcattggtctcttcagcctggctacacattgagaattagcagaggagctttttaaaaagtaccagtgcttagtccccaacctggattgtttggcctattcctccttcagttttttgtggttcgataattatcttttaagttgacaataaacagctaaatttagaggggggattgctttttcattgttctagtttccaaatatttacttttgagatgcagcgtattaaaattttcaaagactggtttaaccattctcattagtaaatacaatgtattttcagtgtatccatagataataaaagttggataggtaagaattggaagggtgttaagtgatgtcatttagtctaccacctttctacagtataattctgtggctctacaaggtggccttcagtttgtttaaatacctataaaggatgtttctacttttaagtaggcattacaaatttttgtatattgcttggcagtatgcctctttgtaaactaccaatctgttatagtctcttgaagacttggttccaatatttctcagtctttgtaacacataaatgaaactaaccatgtttggactttgtaatttttgttgttgttgagttatatgtcaattacataatcatgctaaaggaaaatagctcctctaacaaaccataataataaacttctaatgaccaaagaccaggattttctaaagctgaaaataattctcgtataaatcagaaaaattggacaatagaaacttaaagcagagattgagttagtttgtgtgttgataatgaaaattatttttgagttttctctgaatagatgaagacttcttttttaaagagattttcaaatgccacctcctcaaactttattggcaaagaaagtttacctgattggggaggaagaaattctagcaggccttaatttaatgtgcttgttgcaacagaaggtactaatgtatactttgagactttgtttactgctgattgatggagatatattttttaaatttatgatacaaagtaatctctaccaggtagttgtaaattacgtgtgcaccgttgatttgtgaggtagaaccaattctgaacaaaataaaggtatctggttttaggttatatacccacaaagttaactttgaaaattgcaggtaataaatagcaggattaagcaagaagttaagtatatattgaattatagtaaataatgggtttggttttcttaaatctattttgatgtcattgggattttgacacaaaaacaaagaaaatggcatcattaagtctgatttgggactaaatagtagctataattcaaacatatttagcttctttagtgtaattgcaagaacaaatgaattatatcaccatttgaaggcagttcttaaagcaggttatcttaagaggtatagataatttttattaacaaatggagaaaaatgagacaactatgttttcataaaattacattttactagggattttgatgataccgtcttctgtctggattgcaaggggttaagagttaaaatggtgtgtgcagctgtaacactggagctattttatctcttaatgacagttaaggagagccattagataacacagccataagttaaaaagagtctgaagttggttttacttttttccaaatttcctgtgatgataaaacctgatcatagaccttaagatctttggaatatgtttatatgtatgtatgtatgtatgtatgtatgtatgtatgtatgtatgtatgtatatatatggagagagagataggttgttttcatgagaattaagtttgacttattttccaaagagcaatttgtagcctactgtcctgataaaatggattcatcattacacgttaatattagaaagcagctcaatgaggccagctggtggcctcattcctcataggtgtgaggaatgaaaccgagggaaggccattttaagtaacagctgtcttttatcttgtcagcgctgccagtttttgtttagtaagcattccagtttctgtaataattttaaatggaagaaagtaaggaaaatgtatgataactgactttttactctgatgttaccataggggtaatgaagttcatcgcagattgttttctaaccttcggtgcatgtattgaaatagatttttgttttaaaaatatgagattacatttttctggatctggtgtgcattggggtagagaggatgactgtcttaaaaatagatcgtgtattctgcctagagcaaagactcttaagtcttttggctgaaaatgaactgagtatggacaaaaatattgaagtattctacttgtaaacttaccgtataatcagtgtcttgataaaatagtagtttttgttggttgaatctaagaatgtgttggacttgggtaaatttcagacatgaccaacaacaaaaaacaaaagcccaattccttaacctttcctgactgaaacttctcaggaagaaaccagttttgaattgtatgacataaataagattgtcttttattataagtttttaaactatgtaataaaacatttggggataacatcagttgaatgtgctacttttaaagcattaaaccactgacataagccttctgtattatagaaacttctgagttaccaaaatttagtctggtacagagcccttgaatatgttgtggttccctcattatggcccttcattcccttctgtgttaatagtaaagcatgttgcctaataactacaaccctgaccaaatttgggcctggatctcatgggtcacgtggagttttaaatacgatttttaatttacttgggtaattgagctgaatctttagttttcagattacttttttaaacagataggctcttagaacaaattattaaaaacataataccccattggaggggaatctggattaactacccactgttcccaccccccccaacttttgaaaaattttggccatatagaatgcatgaaaaatcagtatgatcttatgaggactttatagtactgtaaatcttaggagcactttagttgttttgtttgtttgtttgttttaccagtcaaatagcagtgggagattgtataccaactttagtgacactgatattagtaagttctgataacccactaccatcggaccagcctggagcacattactttggccagtggaaagtctcttggagagactttgaggtttgtgatgacaaatcatgctatcgttaaagttaaatacatatatatacacacctagaatataagcagaatggaaaagttggcagggatgaattcaagaacattagagtgaatttttttcattacagaattgttagttcctttaggaacttagtctcgtagatgtatatatttaattagcataacttggacagcacaagattaatgctttaacttgtttgcaggagtttaaaaagctggtttctgttgccaatagttggttggaagggaaaatggagatgccacaaataaaattttttggatgtgcaaaacagttttgattttatttcttacaaactataggactccaagccccctgatccttgatcagaactacattaacaccaaaaatcaagttatcaaagcagagaggagggtgctaaaggagttgggattttgtgttcatgtcaagcatcctcataaggtgagttgtagagtacagaaattgggttcgtaagtattaggacttttctaaaaattttattttatatgaatttatgtttctatctgagtgttaaccttggttttaaaaagcattcttttaaaggttcaggcttcatcgaaaaacattcttttggatgttgagatttatcagtaaaatgacagtcaaaaatgtaggttcaaatcttaaatcttaattgtgtgctcatagagaagttatttttgtttctgtggttaaagtcccagtttttccacctagaaaacagagatgtaaagttcctcattccaaggaataaatgtgtagctacaaaagtatctggcacacttatcatcatagtagaatgttctaagtgtgttggctgctcactgttaccattattggaaatttgtttctcccaacatctcttagctttcattatcaatataagccatagagtgagttacccgggtcaggactacctgggttagaaatgtaccttgggaaattaggtgaaataatctagcacggtgcccatcacatagtaaagtgccaatgaaaaatattcttttaattgccttttttcctgtacaattttgaaatatgcttctaaacataatttatataaaatctagtcatgtagcagttcacattagaatcttatgtacatttaaattggtctgtattatcgatgcacaattagaacttgagtctaacattttcaattacttttttcattgaactctactccgaaagaactaccagtatactgaattgagtttttttcccttgtccttcagatcattgttatgtatttacaagtcttagaatgtgaacgtaatcaaaccctggttcaaactgcctggtaagtcacttttttagatttctttcctagccaggaaaacagaagcagaaataaagtaagtttcgttttccctttccaaaataatgagataagtttgtttggggcttttcgttgtttttttgttttgtttttttaaccaaaaggtaaataatgcttatttctgcttcctgttttcttggcttgactaattacttttaatggagaactcaatttaactttgttcttttttctactctttaattaaagggtagtccatgatggtaagtcatagaactctgccctctgcacttcagcccatgacctcaggatggcctgattggctaccctgctctccagccaatccagtgcaagctctcatccgagattcactgaagtggtccatatccatctggcagcatcttctagttctgtcggggtgtcaaaaggatttgtatatttgcttctagaagtaactatttgacatgcctatgtatttaatgtatacttgtaactatcaaaatgaatagttcatttttgatagatttgttgtgcagccattatgaattaaatggtttattaggagtttgactaaatttttatttttagtgtgtatagcatgaatactaccaaaggagacgacaaacttgcagcttaaaatgggcaccagttcccacactggcttaatttatataactgcttggctgtattgcgggtaataatattagaagcaagaagcacttcatttttaaaagagatgttactataatattgcttaaatgctttagcacttggacttcttgagatgcagatgtgtgatttggagtgctggcttatttaaaggtcaagccaaggagtttgtggttcagccacaactactgtttcctaagactattgatgtgaaggacttagtgaagtaatttttatattctgggcttcccagcaagatgtcctttttatgactgccatgcttcttttggactcagtaaatatttgtaatgttagaaaagtctcattatttttataaaatgcatgacattttaagtatgtgttgcataaaatggattatagcagttctcatggtttaggatttttaagaaatagtccatttaatttcagcttaaccttttaaatgatctgtaaaatttctttgatagtttaggaatgttgtggggagggttcattaataaaagttcagcaattttttaactgaaatagtttatctcttttacctagtcacaaaaaaggtatgtaaacaaggccattatatgtgtttattgctctttatttccctatctagattttctaagtatcttagctttcttaatataagtttaacttggtacttactgaaaatgcctttttacccctgttaacggtattttgagcttttgaaaagaacttggttgacactgcttttattgtggataaaggagagatggtcagtaattaatggcttgaagtattattggagtggtttatcatttctgaaactaatcgtgtcagaattgactttgaaaagcattgctttttacagaaatatattaactttttaggagtaatttctagtttggattgtaatatgaaataatttaaaagggcttcgctcatatataggaaaatcgcatatggtcctagtattaaattcttattgcttactgatttttttgagttaagagttgttatatgctagaatatgaggatgtgaatataaataagagaagaaaaaagaataaagtagattgagtctccaattttatgtaagcttcagaagaactggtttgtttacatgcaagcttatagttgaaatatttttcaggaattacatgaatgacagtcttcgaaccaatgtgtttgttcgatttcaaccagagactatagcatgtgcttgcatctaccttgcagctagagcacttcaggtaggtgtatatttcccattttgttctgtaggataaatcacacaaattttcggtggttccaatacagatttagcaaaaatttaatttaaaacattctgttcttatggtttagattccgttgccaactcgtccccattggtttcttctttttggtactacagaagaggaaatccaggaaatctgcatagaaacacttaggctttataccagaaaaaaggtattctctatttactcgtttgtgccaacatgctaagagtccaagctactctaaggaagaaatactaacttttttttcctccaacagccaaactatgaattactggaaaaagaagtagaaaaaagaaaagtagccttacaagaaagccaaattaaaagcaaagggattgaatccggatggaactccagccctttcaaccctgggtggattttctccagcctccaagccatgtaagatgtatttagaattaaaatgacttgggggcactgaaagtgtgtctttattagagagcttttacatttgaaagttgcatagagaaaaatgatgttaggaaactgctgctatgttctctcatggcagtcaaccaacatggaagcggaagcatggtactttgagttacatttagaaacaacttttggccctctgttaaatccagtagttaacatgttgttattatatcttttaaaagcatcaccaagagaagtaaaagctgaagagaaatcaccaatctccattaatgtgaagacagtcaaaaaagaacctgaggatagacaacaggcttccaaaagcccttacaatgggtgagtatacttgggctggaaaactggcttgaggaatcttttatgtgtttactttttaacacactaagtttgtaactaatatgtcatgattttttgaagtgtaagaaaagacagcaagagaagtagaaatagcagaagtgcaagtcgatcgaggtcaagaacacgatcacgttctagatcacatactccaagaagacagtaagtaaatgttttcttagggaagcagtcttatttggagtttttaaaggttattgctttttctttaaaaattgaacatagattattttcaaagttaggttagaattaggcttttagtatgaggcaaattatgagaaatgagtttggagatgttctggacatacagtatcttaatggcattctgttatattttctcccatgttttttggagaagtgtaggagctacccacaaagtgcttgagggccatagtattgttcataatgtgaaaacttctttttttttttttaatttcagttagaaaatgtgtttcattaaccccttattaataaccaataatcaaattaaccagtcaatgaatcttctttagttaggcctgtaattagattgttagctcttcgtggctcttcaatgtcttttgaacatgtgggagatacttaataaaaagcatagctctaggacactataaaaattgctaattactccccttggaataaagacataagaacatttgcttaagatttaatatgttatatataggcttgggcatacagcagtgaggggtggggagattttgaaaagttctggtttgtcatttatgtagctggtagttttgttttgaacctgttatgagcaaccaccggaataatctgttccccatagaaactgaacctaaacttcaaatttttattatctaagctataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttctaaactgcttcaaataccttatttaaataaattattaaaaaggaaaattttaatagcaaaatggctgtactggttttctgacaaacttattctttcctccattagatggtagtttgagattattaaaatgcaattcttaactgcattgtgagctattgtaagtcttcactgtatatatggaaaaagtaaatgggagtcgcccaacaatgtgacattaaatgttatattttagcactaaaccaaaaaacctgatttgcttttgaatggtgtcataaggtaattttgagtcagatttaagtactatttctgaaatgaggtaccctattgaatgaaccaaaacttagtaactattgagctttaacagttctgtataatttaggcatttaatgttacgatttttacgtaggctaggagaaaatgtgaggcccctgaacttgagtggttgatagaatacaagctgatcacaaagaagtgaagttttgatgaaaaagccggaatttctatccagatgaatgttttcaagttactcacatttactatttttttcaacattttggaaatcagtttacagagtcaaaatgttgcatcgctttataattacactaaggtctccattacatttattttacctactttaattgtccactagacttggctccaagtgatttgttgctgtttcaagaaataaaatacacccacaaagaggaagatgtattactgctaaggatatttttaaaaataaagttacagcttctgaagaggagattccaaagacttaaaatgtgttcaccaatggcaggtggtggaggctggaaaaaatagcttcacaaggcaactactttgaaggagattaagattcattaggatataaaagtgttgggtgtgctacttaaatcagttatagttctaactataaagactaaccagaaactaacaagacccagcaaaagttagccacttcatgcttgaaagagggtagatagttcattaagacttctttctgcctgatttgtaatacacattgctgaattataaattgatatttctgaaaagctaactgcttctaaatgctgaacagtttgcttcccctacaagatagacattgaagaaaggcaaaggcaaatgtcagcaaaggccctgttagcaaattaatgttgatttttttttttaactttttttttttttttttttagagacgaggtcttgctacgttgcccaggtcggtcacgaactcctggcctcaagtgatcctcccacctcagcctcccaagtattaaattcttaatagtgttgaaattacttatgtccctaatctttgcttggaaataggagtgctgtgggtgagggttgtttgtgaagatggggagttgtggaggatacacctgcatgtggaatgaggtttgtatgttaaaggtgtttttagaggtggctttgtgggctaggcaaagatctttttcagggtcttgatttttatcttattgtctgttactgaatccgttttctaagttgtcaggatgttaacctcatgccactctatggctatttaaacactttctctagaagtaatactcattttcaaacttattttgagaaacaaagttgtgcaataccaataatacctgtttattaactccaaaatagcaaaacttaatctgtaccccaccagttcaccactccacctcccacccttgctattgggaagaaaatcccatacaagtaaagtttgttcccaagtgtctcagtccacaaggttgaggatttttaaaacataaccatatagctttattgtaagagttaaaagtaatgccatactacccctgtcagtatccagagagccctcatctctaatttgttttaactgatttgttcaaagtccaaatatgttgcatcggctttaaccacaggcctctccatatttcttacttgaagaaattgggtcatgtcctgaagaattttttgtctcctgggtttgttcattgtaactctgtgctgtcactgaacacatttttctgtccactgtgtggtaaagtggtagatcttgaggcttgatcagatttaggtttaatttttttacttgtctggaattagaagcctggacacccagactgttattttagaactgaaaactaggttgctgcctcatccaccaggtattttactgagttctcagttcttatccattggtgcttgtacctcactggcttttgtatctgtttttccctctgttctctgtctcatgttttggttggcccattacagcaatgaaaatgttatttgtcctaatgatcctgatactttttttctttaaatgacccacaaattaaatcccgttttggtttttttttttttttttttttttttttgagatgaagtctcgctctgtctcccaggctggagtgcagtggcacgatctcgggttactgcaagctcccactcccaggttcatgccattctcctgcctcagcctcctgagtagctgggaatacaggcgcctgccaccacgccctggctaatttttttgtgtttttagtagagacggggtttcacctatgttagccaggatggcctcgatctccttaccttgtgatccacctgccttgcctcccaaagggctgggattacaggcatgagccaccgcgcccggcaaaatcctgatttttagtacaagtcctttcatgttatagaacattacatttgtcctttgcagctggtatctttagtttaaagaccagtgaaattcttaaccatgttcccattttaaaacaaagcgaacataaaaatgactaattcttagaactgaagttctaggttttgctttaatagcttttaagtattgccacttataaccccattattaacaccacagtctgcatcaaaagcttacttaaaacatttagttttcatgagagtttccaaaaataatatcataacaatcatttgttctaagagccatttcttaactcatcatgaactgtaatagattatgaagataagtttcaaaatttacataccagattttttaaaatgaagttaaaagcatggacatattgagggtcttatgcatgggcatactgaagggtttggagagacagaatgtgcatgaggtttgagaaggggagcatcacttccctatgtggaaataggaacggagcagcgttcattgtgtgggccttgagcccctcatccctttcactctaaggctggaagccacagcctgatgttctaaccatttgaacacttaacatttgttcaaagcctggctttgtaatcatttgaacattccattacatggaaggaacatggacttcatgtcagctctgcattttaaatcattcctccacagtgacttgacaagttattttacctcttgtctactggcccttacaacattttgtgtagtatatgtgttgggcaaataggatttatttttaccattgcaatccagacttcatattggaacgcactcaaatattcagaagtttgaattctaccactctcaaacacagttcaaaagatagctgtttgagaatgcttcttaactaatactagtacaatatcttcaataatgtatgtaccttatagaaaatcttgaacagtacaagattttcataattaaggcatgcaaaactgcttgggctctttgattccaggtgtcctcttctcccttctgcttttgccatctatgttcaatataattctaacccagtctaagtatggagaaaattcctaccctgcctgcttttatagctcatcaaatttccctgtatcagctatcacttttctggtaggtgtagtctgatttctgtctgtcatgcctttgccacaatcctttctttgaagagtaggtaaaatgatctatttaaagtgttaatcacattgctctaatatataaagcctccagtggtttcccatatcactctgtaaaatgccccttgccagcctctcccatcaacctcgctttttctgttcttgtatatgcacatctcttcctgagcctttattgccatcctcatgtggggatgtttctgtctcagagatagtctttattcaggtcccactctgcagtcctctccagaggggctgctttcaccaccccttctaagtaagcctctctaaacacctctatcatattctatcccttagccagcactaattttttcataatgcttaccactaactgaaatttactttatcatttaatctcttcctcattagaatgtaagctcgtaagggaggggcagctctgtagtttattcattattgtatgtccctcacctaatcctatgagtgtctggcccatattagggtatgtaataaatattacttgaggaatgaatgaatttaacatactaccaattctctgagtgactctttttaaagccttcatcatcattcacactttcttgtctttcatatgggcatgtccaatcacccttccatgaatatctgtacctgttacaaagagaggactaggttcctggagttcatagatgtaaacaacatcctaggggtagcaaactggtgggccctgagccaaatcctggcctgcacatgtattttgtttgagttgtacaatgtttgttataaatgaactggctgataatattttttaattggaaatgtttacattaaaaacctagacttctagctgctcttaaaaaataaaaatacggctgggcactgtggcttatgcctgtaatcctaacactttgggaggctgaggtgggcggatcacttgaggtcaggagttccaaactagcctggtcaacatggcgaaacctcatctctactaaaaataccaaaaaattagccaggcatggtggcgggtgcctataatcccagctactcaggaggctgaggcaggagaattgcttgaacccaggaggtggaggttgcagtaagccgagatcgtgccactgcactccagtctgggtgacagagcaagactgttgaaaaaaaaaaaaaaagccgggcgtggtggcacatgcctgtaatcccagctactcgggaggctgagtcaggagaatcacttgaacccaggaggcggaggttgcatagagccaagatcgtgccattgcacttcaacttgggctacagagcgagacttaaaacaacaacaacaacaacaacaaaaaaaacatgagatccacaatactccaggccacagttaactagcatccagtagccatccgggtgaggctgcatgctgcagtgcgtgacgattccctccaccccctgttaattgtgtaacactgaagccaggtgcaggtgtcagttggcaggtatcagtgtgctgatgctattttcttgaattctgcccttttgctcattgatgttacttacttggctcttgacacctgatatctcacggaatattccaagacaatgtgaatcaccaaatctgtgaatgtggcattgtttgactaggctcctgggtcagttaaatcagattgttttctgtgccccaaatcagtagtgaaccaccatatagctaaaccttttcaaacgaatttctcacttcagtgacttttacactgctaagagcacatgacacatcatatctttgtacagagggcccggcacataaatctcactgtgaggctcagttttccaccctaaattacaaaatttaatttcttgcccaaaatgattttctgccccagatgtgttattttcatggacctttcaaaccaaattttagtcatttaacaaaaattaatacaacatagaccaacaatgaacaaataaagccacatttaaattgattagccgggctctcagcccctagctgacttcttttacacacgcaattgaaatcaagagtctcagataaacttccaacttatttgaaaacagtcaaattgcaaatgtcaagcatctacttgcatataatctgatgaggactataatgataggtttctacctagagaaataagggtaggtgaagtctcaatgcttagatacgtggcacatacctgcatgtaattaatattcagttggaggcaaagacaatgttttaaaaagccaaatgacatccagaataatcctcagtatattttagagccaagcaacagtacaatgagtgccaagtttaaagaagaaagatggaccactgtggcctagaaggccctggaaaatttttagaggacagggaatgtgggctgcactttggatgggagaaggttttaaaggacaaagaggaagcctggcatagtggtgcacctgtagacccaactacttgggaggctgatacaggaggatcgcttgagcccgggagttcgagactgtagtatgctatgattgttccactgcattccaacctgggcaacagcagcaagaccctgtttcagggtaaaagaaaaaaagaaagacaaagaggaagaggcccaggagatggtgttcaatgctgacatcctctattagctgtgcaatcttacacatcttacttaaccactctaagcttccatgttcccttctgtaatgagttagtaattaagcctagtgtattcagatatgaaggttaaaggaaataatgtatataatgcacttaacacagtgttaggtgtgtaaatgtcccaataaacgttatcattattagcattcttcagacacttgaggatgccagactatggcgtccttgtagaccagagcgccattgttttaaaagtgggtgactgtaattcctagggtttcctagggctgctgtcacaaattaccacaaacttggtagcttaaaacaacaaataattactccttcacatttctggaatctagaagtctgaaatccagatgacagcagggccatgctttctctaagtccacccttgtttctttgtagtttctggtggttcccggcaatccttggttttctttggcctgtagctgcatcacttgtctctgcctccatcttcacatggcctttttctctgtatgtgtatgtcttctaaggataccagggcctgccctaacccagtatgtcctcatcttaacaaagtacatctgcaaagaccctatttccaaataagattacattctgaggttctaggtggacatcaattttggggagacactagtcaacccttttcagtgacataagaaaaataataaagaacctgaagtggacttttaaagaaattttcattttgaaataatttcagatttacaaaaaagttgcaaaaattgtgtgaagaaattttatatatccttcacccagattcaccaaatgttaacatttcaccacacttgctttttcactctttgtggtgtcttttctgctctgcttgagagtaagttgcagtcattgtttctttacctgtaagtacttcagtatatattacttaaaaacaaggacgttatcttacatatccacaatataattaccaaagtcagagaatttaacatattgaccaatactgtaatctatcgaccagacattgccaatattgcaaatattgatctattgatcaaatattgccaattttcctactagtgccctattttctggtccagaatccaacctagaatcatacattgtctttagtcgtaatctttttagtctcttttcattgtaattgttcctcagtctgtctttgctttcataaccttgacatttttaaagagtgaaaaccaaacttgcccaatccacggcccatgggtcgcatgcagcccaggatggctttgaatgtggcccaacacaaattcgcaaactttcttaaaacatgatacttttttgcgatttttcttttcttttcttttttttgctcatcagctattgttagtattagtgtattttatgtgtggcccaagacaatccttccaatgtggcccagggaagccagaagattggacacccctgttgtaaactgatggttctgtcgaatattttttaatttgagtttgccctatttttttttttttgtgattagatttgggttctgtgtttttggcaggagaaatacaacagaagccaggttgtgtcctcagtgcctcattaggaggcacagtgttaatttgccccagtaaccaatggtgttaactatgatcattggttaaggtgctgtctgccagtgttctctattaaaaagttactattttacactttgtaattaacaagtagcttttgggggagatactttagatcatataaatattggttcttttgttttttatttatttttttgagacagagtcttgctccatctcccaggctggagtgcagtggcatgatctgggctcactgcaacctctacctcctgggttcaagtgattctcctgcctcagcctcccaagtagctgggattacacacgcctgccaccacacccagctttttttttttttttttttttgtatttttagtggagatgggatttcgccatgttggccaggctggcctcaaactcctgaactcaggtgatccacccaccttggcctcccagagtgctgggattataggcgggagccactgcactcagcctagataatatcaatagtgcttcttaattaacttctgcctactaattctagcatccattgatgatttttacctgaaataactattgaaaatgatttttaaatttcagcattcgctcgacatttattagttggaatgccactgtaagaaagagctttcttttctccttcatttattcatttgtttatatgtttcagtatggactcattctatgaagttataatccattactatcattatttcgttactcaaattccgatgtggccaatggaaacccctttaagatagttcctgtgtcctttattatttatttatttatttagatggagtcttgctctgtcaccaggctggagtgcagtggcgcgatcttggctcactgcaacctccacctcctgggttcaagtgattctcctgcctcggcctcccgagtagctgggactacaggtgcgcaccaccacgcccagctaatttttgtatttttagtagagacggggtttcaccatgttggccaggatggtctcaatatcttgatctcgtgatttgcccgccctggactcccaaagtgctgggattacaggcatgagccaccacactcggcctcctgtgacctttaagatgaatattttaaagactttttcccacatgtgtacctttccagaaggttcacaccatttgtgctttctctagacctgtataaccagaagctcttgggaacatgagttcttgagaatatcagcactggcgtcagaggggatgaaataactttcaaagatcaggataactaccttgccaatgtatagggcttctcatggctgcagtttccagaacaacttttcttttggtccaggacgatcttccccattgctgtggtttggatatggtttgtttggccctgccaagtctcatgttaacatttgatacccaacatgttggtggcagggcctggtggaaggtgtttgggccatggggtggatccctcatggcttggtgccatgctcaaggtagtaagtgagttctcgctctattagttcctgtgagagctacttgttaaaaagagactggcacctcctcctgtcttcttgcttttgctcttgccatgtgatctctgtacacactgattcccctttgccttctgccatgagtggaagattcctgaggccctcatcagaagcagatgatgggtaccatgcttcttgtatagcctgaagaaccgtgaaccaaataaacctctttttctttataaattacctagctttggggccgggtgtggtggctcacgcctgtaatcacagcactctgggaggccaaggcgggccattcacgaagttaggagatggagaccatcctggctaacacagggaaaccccgtctctactaaaaatacaaaaaaattagctgggcgtggtggcaggcgcctgtagtcccagctagtcgagaggctgaggcaggagaatggtgtgaacccaggaggcggagcttgcagtgagctgagatcgcgccactgcactccagcttgggtgacagagcaagactccgtctcaaaaataaaataaaataaaaattacccagcttcatgtattcctttatagttacacaaacggacaaagacacccatgcacgatcggtttccatagtcctacaatctgtggttccttgaacgcctttcagtttgcatagtcagtaataagaacctacgccactagaggtcactctttggctgtctgtgatacaagatcttgctctaagttttacttcagctgactggcaagccttat

SEQ ID NO: 1913 - DNA, 2336 bp, Homo sapiens
cgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttctaaactgcttcaaataccttatttaaataaattattaaaaaggaaaattttaatagcaaaatggctgtactggttttctgacaaacttattctttcctccattagatggtagtttgagattattaaaatgcaattcttaactgcattgtgagctattgtaagtcttcactgtatatatggaaaaagtaaatgggagtcgcccaacaatgtgacattaaatgttatattttagcactaaaccaaaaa

SEQ ID NO: 1914 - protein, 348 aa, Homo sapiens
MASGPHSTATAAAAASSAAPSAGGSSSGTTTTTTTTTGGILIGDRLYSEVSLTIDHSLIPEERLSPTPSMQDGLDLPSETDLRILGCELIQAAGILLRLPQVAMATGQVLFHRFFYSKSFVKHSFEIVAMACINLASKIEEAPRRIRDVINVFHHLRQLRGKRTPSPLILDQNYINTKNQVIKAERRVLKELGFCVHVKHPHKIIVMYLQVLECERNQTLVQTAWNYMNDSLRTNVFVRFQPETIACACIYLAARALQIPLPTRPHWFLLFGTTEEEIQEICIETLRLYTRKKPNYELLEKEVEKRKVALQESQIKSKGIESGWNSSPFNPGWIFSSLQAIITKRSKS

SEQ ID NO: 1915 - DNA, 34455 bp, Mus musculus
  misc_feature (1)...(34455): n = A,T,C or G
accagctagctgaattacagcaaaggccaccatactgggcacacttgatctcacagggcttgctgtcctttgatcagcatgtaaatccttcaaggtcaaggacttcactgtttggttccctgctctctctctctctctctctgctctctttgccctatgtttctctctctgtctctctctttttgtctgactctctgtttttctctctctgccccctctctgtttctccttctctctgctctctatctttttgtctgtctctctctttctgtctttttgtctgtctctctctggttttgtctgtctgtctttttgtttttgtctctgtcttttttgtctgttttttcctctgtctctctgtctctctgtctctgtctctgtctcttcccccccccccccgtctctctctctctcctctctgctctctgctctctgctctctcttattcctggaacactgtactgcacagactgggcactgaatgagtgtttggtgatgggagagatggatgcatctctgtagaaaaagtcttattaactgaatccatcactccagatgactcaacacctaagtgagctggccttttttcacacttgagaaataagggtaacaatatccatttttcaaaaattatttgtcaagagtaaatggtaagtagccttgccttgtgccacataattattgatggcgttttatgatatcactgagactcacaaggacaggagaggcatgggtgccagagccttgggttgtcacccaccttgcctaccagaaatcgctggtgttttccaccaagagccaaacaaagactgtcctggtggtgctgaggtttttacacttccttcctccagtagcaaaaatacgggttgctgactatagtccactaggtggacaggaccccctttcaaagaactttacagttacctagatgatatgtaatttccaagaatcaagaagcattccacagacttaataattctgaaatgaaaaaaatttgcatgtcacagtgaaatcattgacctagttacataagtgccctcctgcctccacctttgctacctccagtttgcagcgctgaaaacagaacacttgtggtaaggtatctaccccaggagggtgaagaacaagccacacactgctttggggagcccagcttggagcagaatagcaagaacagacacggtgctagtaacctgcagttcgaagtcatcactttcagtcccctgtgaccagggccagggtctccacacctgtgagaggaagcaaagatctaaggaatctgaaatttgagagagaaactgcagctgccagtttgtgggttggaacattattggtaagttttgtttcagcttggactttgggaaaacactaggtttctgctgttgtaaatggcaggctttaaaagaagaataatattgccgtggtcacatcaccaagtcctgggtgcttagagacttgggttccttcaatcccgtttagatgaaagccaggtgctcactttggtagtcttttgagtgccgtgagtattttattctatgggacttagaacatcaactgttgctccaactatgtctagggttggaaaggagtcatgcccttgggtgctgcaggaaagaagtctgagtctcctgagtttttcaggtgttagggtctctgccctttctactccataaggagatagaatatgatgtatttttgtttggttatatttttagacaaggtctcatatatcccaggctggccttgaccttgcaattagccaaggataagcctgatcctctgctaccatctcctgaatgctgagattactggcatgtaccactgtaccaggttttctgagctgctgggaactgaacctagtcttccatgtacaccatgcaagagcttgccttgcctctccctccctctccttccttccttccttcctttcctcctcctcctnnnnnnnnnnnnnnnnnnnnttcctcctcctcctccttctcctccttcttcttcttctccttctcctcctcctcctcctcctcctcctccttcttcttcttcttctccttcttctccttcttctccttcttcttctctccctttctttctttctttctttctttctttctttctttcttccttcacttttcaagacagggtttctttgtgtagctctctgcctctgcctctgcctctgcctctgcctctgcctctgcctctgcctctgcctctgcctctgtctcccaagtgctggaattaaaggcatgcaccaccaccacctgacctgaattcagtttttaatcatccactactgagctctgaatgacttactgagagcttgctatattgccttcaggctgggtgcttctctcaggggagatgctcaggtgtgcctaggcacagttatgataaatgagcctgtctgatttctcagcctagaacttctagaagcaaagagtttgtgggaatgccagccaatgaggcaagatagaccttgagttactggcaaaggctgacagaaaccgctaacacaggcacgcctagaacacaacacctaagtcatcacaggcagccctcctctaaggcagtcagcatttgacaaagaggcacggaaccatttgcaattcgagagacccctctggagaagcactgtctgtaataaggacaggaagtgcagattctacaaacccaaactctggtgcccttgttactcagggctgtcctgggagcagggtgagtcacaggatggtcccctaaagtggatgaagctcagcagagggtatggaccagagaggaggaaagggttgaggcagagggacaaggtcaggacagagaaggagcctctgccttgtgctgagagagaaagcagcgggtgatcccagagcccaccaagtagaatgcacaaatctacccaacacttctgcgaaattctcaggagaactcaggatggcgtgactggtcggaagacattcttccgataacatcaatgtccaagtgaaagtgacaaacttgcgggtttctcggtgctctgggttattgagtgtcatttaaagatgctgttgtgctttgactaggacagcatcggacgtccacgctttcccctgctgcactaagtgccttgggcttcctgagtcctggcttctatctaataatatcttctaagccagttccagaaagaggaaatgagcagaaaaagaggccatagccaaaatagatacagcaggcccctgccgtcagcctgggtgcttctcccaggggagacgctcaggtgtgtcttcatatatactgactattttaggcacagttctgataaatagggctgtctgctttctcagcctggaacttctagaagcaaagcgtccgtgggaatgccaatcaatgaggcaagatagaccttgagttactggcaaaggctgacagaaaccgctaacacaggcacgccaactccatacactcccacggccacggagtcagactcacagtcctgtgagcttcaagcttcttcatttgctgcaaagaggatgctcacctgtcctcagcagagactatgagcaaaggccaaggaaggcaagacaaagctagaagaaactgcatcgggtgtcatgttacagcatggctttccctcgtggggtttcacggtcagtgtgtaagatgctcacatgggtaactgtcactgacagtgaggtaggactagatgtcttcaggtcccagcagtcatctctgctgttgctgaatataatacagcaagtttccagtgagtctttcagagctcagtggttgatggtaagaaactgaattcaggccaacaggggtgggtggtgcacgcctttaatctaagcactggggaagcagaggcagtgcgagctccaggacagacagagctacacaaaccctgtcttgaaaaatcaagaaagaaagggaagaacagaaagaatgaaaagaagggagggaggcagggaagggagagggagagattgcattcacaatctaaggaagggctgagcataggcactgggttctgtccccagaactgcacaaaactggatttggtaacaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttaaaatgtttctatttgacaaggcgtaaaaaccctacgggtgacaagccgagtagggaaaaccaagaagaaaggcaggtgaaagaagaggtttatatctcaaaaaccaaggagaaatttagggatggcgttccaagacgttcatgggtaggacagaatagccagccaggaccaggcagactcaccacagcaaagagctgcactgctaaaaacggcttcccacagcgctggggacaagggaacctagtatttagtgtgggttacccctgtggcttcttctgtatttccttccagcttgttccttccttggggctcagaaacaggcctcacgtttgctctgcgccccacacctgactctgaggccctaggccaggagctctgtcttcaggagttagtagggcatttgataactgtgaccttgtgcttaagtgggcctgccacctagctcaacagggctagagggagtaagggtggaagagcaggcatgggcggttcctgcctctctctgggccttctagctctgcatgtgtacattttggtgccatcaccatagaaatgcatcccatcaccatagaaatgcatcccatcaccatagaaatgcatcccatcaccatagaaatgcatcctgggggcacatccgggtagctagccctccctggtggaaaattctcagcccacaaggtctgtggtgtttgggagctgccagggcagctgctgtcacatttttgccttgggatactgaagtggaggagacccatctctgtaagtcagtgtggacctttccggcaagaaaaacggagttgaaggccctaaatctgggccagtgagccctgcagtaaaccagtggggtcccaggccgtttgctcggctaactttcctatgtggtgaacacgggtggtctcgtactgtctctagcagtgggtgtcggtgactacaaacttaggcatttcactgttctgatgccagctcactgtgtgactgacaagtctcatccagggacacccaggaagtaaaggtgtaagacaccaagctgctcttaagtgcctagacactatcagcatagtcctctgcgcttatgcctggcctggcggctgtccttctgggtgtggcttatcagtttcgacatttatttatatgcttcaataagaatcaagctgtatgcttgaccctacagccagtgtagtttcatttcaggacctcagtgttttcaaaggctacatgatcaaatcaaaatgtcctattcaataaagagcaagcaactattggtttgatggagatcatacttgggaaataatgaccagataggacccacccggagcaggacatcagccacaagcacggtgtttctctcggtttttagaacagccccacagaagggaagctgtcaaaggtattcagaagaaaggatgctaaacttcctgcctacactggtaccacagcccagcccctcccccacagttagcccctcccccacagctggcctccagcactttaattttcaggtctatttaccttccctcggaacacaggtccacagggccttcctctccagctattgagtggatggcagttagcaggagaaaggggtaccctccacttctgggtgtcaggtgatgtgccttttcccatctgaaggcactggcccatgctttcccatggtacaatgggggaactggatcgttctccacatacaggacagttgcactcatctgtggtcaccttgtatggagtctgacttcctggtatccctcactcctcccctgagtgtatcctcacctgcagaggagcagagggcctgaatcccagccctcaacaccaacatctctgtgaggcctcagggacccccttcccagctaggttttaccactgagctttacatagcccaggaaatcccaggagaaccagagggtgttagccactctgaggccagcttccagaaagagagcctgaggggcaggtggtcaggaagagctgagccatttcttactggttaacggttgagtcctattggatgagagatggccatcagggtaagatagtaagtcctttagctgtccccatggactctatgtgttcattctccaaggtctcttcagctcctccccccactgtctctgcatcaccctccccccactgtctctgcatcaccctccccccactgtctctgcatcaccctccccaactgtctctgcattgccctccccatggtctctttgtctttgtcccctgcagtctcctctagagtctgtgtgccccagtcccccatggtctcataagctctgcatctctgttcccggtgtctctgtgtctttatttttctgggcagtgtctacatccccatcccctgcagctgtgactgaagccagagggggattgggagaccttatgaaaagtgagagaccgtgcaaagcgtgagaggtggtgtggcagcatgacactgaagagtgactgtgctgtgcgaatcttttgtgctcactgccgtcttaagtcactctcctgttggagtcttcgctgccgtcggcatctttggcgttcattgcctccctgaagtagagcctcctcccgcacactcagaccgagaggtggttctcaggctgctgggcctgggctgttagacacacagttgctttgcctgagaaactccacgtcacagatgtccctttaatggcttttcctcctgccttccccagtctcccgcactgggttttaagaagcctggacttctgaatagtactttggtctctctctctctctctctctctctctctctctctctctctctctctctctctctctctctctctcccctctcttcctgtagcccctcatgggactcagtcataacttcaaagctgtgtcaagtaagatgtcaggcttactttgcccatgcagaggccgacgtaagacactaccaatgtctttgggagcctagtgtgtcaggagtgcccaagactctgctggcccacagtccttgatttcctccacccgaaaccttaggtgacactcgagtcctctcctgcctagtgacctgtcagtccacccagcggtctctggactttgctccaaatgaaactttcacgttgacggcatcccgttcagactggaaagttgtactatgaattgtactgccgctgacagagggacttactttcagtgtaccatagagtagccccgcagaggggctgtgacatttcacatttgtgagtgaagcttggcttggggaattcccagataaaaacaaacgcactcagggcaatgtacagtgtggatttttctttgagatgtggaagaactactgagctagagaatacacaaggcaccgcttgagagaccacggctccgtaccatctacagaggccagggaacagtgaccatttgaacggaagccatctggtgtggactgagagccctggaaagctgggtaaaggtgggggaagtaggagctgtgggggtggggagcagtgttctgtggttcactttaccctcttgggcggagaagggaggtcagaaaagtccccgttttcagagaaagatgtggcttcatagtagttgtcccacattactttagcccaaaatgcaggatttctgtttggtccttaacaaagttaaatctgttttattggattttatttctttcaggtaagtcttttttttgggggggggttctagaagagatttactttctagctgggtgcagtttttaaaaaagttcaaccaggtgtagggttcacacctttgatcctagcactcaggaggcagaggcaggcagatctctgctctccacaaggaattccaagacagtcggggctacatagtgagatcctgtctcgtcttcatgacaaatgaggtcgtgaaaagagtctggaggacttgggggtgggggaggggggagacagaccaggcatacatatccccaaagcatcctaggagcctggcttcttccttgtgcagccagtgaattccctagggggcactcctatcagcttctactccagaagggagcagatgccccagagatgctggagcagagcgaagaatgaggccaggagggaagggttttcagcttttttccctagggggaggagtggtgtgtgatagttctagttgaaaggatacgggtacagcacatgattcccacaggcaataggctcaggccacttggaatactattccctggctctggcagaggacagggacaactgtggtcacaaggtgtgcagacccctcacctcccatggagagccaagggcaggcaagcagagccaagaagtcttcaatgggaaggcttgtcagtgtaggtaatgagcaggactctgggtggacaaagatgcccattgtgacagccagttccttggagaaactgagcagggcaggttctagttttcctctcacattcaaggtcggggacaagctgagttcagggttctgtagtgcggaaaggtgtaaagtgtatccagactgagccagtccgggccctgggttgcgaggccacatggtcagcacctctaggaagtgagagtgggggtctgtcagccctgctcgctgaaactgaccgctgtgtctcccctgtgctgtgtttagcatttcctgggacttgcttcctggccaccgaggtgtgaacaacttcacagttctgtgagtctatgcttctctcgtatttaaactactggagacatgaagaaaaatctctttaccctatggagctggagagatagctcagcggttaagagcacttgttcttgcagaggacccctgggtttcggtccccggtgcccacatggcagttcgcatccgtccataccttgacttgcagggggtcttcagatgcgctcttctaacctctaagagcaccagatgcacatgcggtacatagacacgcagacaaggagagcactctcacacacaaaaataagctttttaaaaggagggctatgtgactcaaaggtggctgtatcctgggacctcccctgtggcactgatggccttgtagctcccagcctggagtctcctcccttcagccattgtcactgtgcacataaccttggagagggcccctacggatcttgtaaatttcaggagtctccttgactgtaaactctgtttactttttgaatccaggagggagtgtctcaattcagaggagctagctacacagcaaacacttacatctgaaagtgagtttcctaagtggatcctcacctcttgcttctcaagatctggctaaggacagggcagtcatgggaactctcaccaggcatttcctggatccttattttcaatctcactgcatggaaatggaagctagcatcactaaagactgtttctccatctctgtcctgtgcaaacccctcattctctccagtgcttgaggtggggaccactactatgggagctggctgcagtttggggcagcatcttgcttgtggctgtaggactgctggggcacagcagggcacaagacaggctctaaaacctgtcttcaacctctctgaaccctgcaaatgctgacactgcctccaggaatctccagcatcctcagtcccaggagactttgatatggacccaccccaacacctcatgtagaaaacagcacaaaggctctcttccttgagaaaccacaaaaccaaattcttctctcctctttttttgcactggtttgactccaagtcaggtgatggtgatgatggtggtggtgatagtgatggtgatggtatttaataattccttttcaactttcaggctgtacatggttaaccatttgcatccaggcagataggcgttgcttttaaataggaagtggtgagttggtgacttttttctggcaattctagcatctcactacccgtctctcaatgagcactgctggttgtgtctgtcaacagaatagtcctcacattcttaggactggagcctggataaccactgaggcaggagtacctggccagtctactttggagctcagcattttctggggtgagcatgcatcctttcccaatgttttttgcagacatgtcttagcttctcggacattctcacctatggaaaggacactttcctatgggacgtgggcacaccaagcttccacatagtaggtccctatggttatgtcacgtggttttaagagaagagcatgttctccagaaactggctctttctctatggcttgctgagaagtttattctcactgcctcacatcggagctttggtgatgctgatttctttaggaagtatctgagagacatcagtctggagaggaagggtgtgtatgtgtgtgtgtgtgtgtgtgtgtgtgtgtgtgtgttatgtgatgtgtatgggtgtggggtgtgtgtgtgtgtgtgtgtgtgtgtgtgtggtgtgcatgtatggtttgtatatggtgtgtgtgtgtgtgtggtgtgtgggtatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacagcaaaggcccaccaggcccagcttattgttttttgtcctgctgggagggaagcatagacctcagggatgttagaggatggccctaccctagctgcatattgtcctagcaatgtaatgttttccttaagacctgttatctagtttttgttctgtgtatatgcaggcatggacatgaacgcattagtgtaatgtccatagaagccaaaggcatgggatcccacaggggctggaactgcaggtcgtcaggatctgcccaagctgtgctgggaatggagctctactcctctgcaagagcagtgcttgctcttagtaatgaagtcatctctctagagccctacaaatacaattctttgtttaactcagtgcacagagagattagaaaccaaaccctaggacaaagaggcagtaggagctttacgaagcgctcggctgtgcatgggacattgtggagaccagcatttcataaaggaaatattagctgtgcttagagcaccaacctgttctcccagaattcaggagataaaagcaaaggattgtgggtccaactccaccctgggttaaactttgcctcaaaagacaaggcaaacaaatatacagtctaaaagtaggttgccagacaagacagcaaatcactggaaaataccttctgggttcctcctgaccagctagaaagcagaaggaagtagtgtagagtttcagctgcactgaggtgggcagagcagagcagagcagagaagccagcatgcctgtgatttcagtgaacttttaacatacacaccaaacacccagcattgtagtaagaaagcttatgatggaaggaaggtcttgtaggaactgcatggcaaagtgacccaggtggtgggtgacagggtgacgggggtgggggtgggggttaaacagttaannnnnnnnnnnnnnnnnnnnggtgacgggggtgggggtgggggttaaacagttaatagtctcagatgggctgtgacctatctgctgggacactaccatgctgcctgtctgaaggaactccttaaggttgcaggagcaacagatggaaagcactgatctctacaccccacatatgcctggaacttgaattacagcctgcactcagctgaacacacacacacacacacacacacacacacacacacacaccttggctatgtatactcctctgcacacttctgcataggtactcattcatacatacctagggcagtatattacatacatgcatatacacatatgcacacacatgcacctatccatacataccattagaaatgctcatgtatagacaacacatataggtctgtagacacatgcatgtagatttgtgcatgcatacagaagtatccatgcctacatacctatacatgtgaacatcaatgcagctacatatatgcacatgtacacataaacagacatgtgcacacatatagatctgggcacatgcataaacatactccctccatacccctctttctatccttccctctccccctttcctcttcttcctcctctttctgggctgccagatggtctctgtcccgtctccaagccagccataaccattctctcaggattctcatccattctctggtaccatctgaggttctaactgccctgagagtgggatgcatgtcacctttagaaacagtttcttggcacagaatccataatgaaaacggctctagggaaccatattacagcacattagagattagttttagactgtgctgaaagtattactagtattgaatttccccttgagtatcgaggggaaatttttctatgagattaagagagttgcctctgaagtgttagaacctggaagcagaagcagggtcggtccagaccgtaagcacgaactccactttggctccctgacactgctcctttcattggaaagtggaagaggtgggcctatgtggtttcaaaccttaaatgtgaaagccatgagctaacctaatcatttgggcactgggatgagagagagaaggcagagagaagaaagagggaggggaaagagagagcagagatgagagagggtgaacagagagagagagagagagaaagagagacagagagagacagagagaggagaaggtgcctctgaaggagctgaaaagccatgcgaatccgtgctgtccccaagggctggtttctgattctagggtcaatccataagaatctgtttaaggctaaggctgggcttaaacatcaacaaaaacaacggaaagcacacatagacatggaagctgaacaacgctctatctactcaatgataacttggtcaaggaagattaaaggctttttagagtttaatgaaaatgaagacacatcataccaaaacttatgggatacaacaaaagcagtagtaagaggaaaactcatagttctaagtaccttcaaaaagaaataaaagaaagcatacactagtagcttcacagcacacctgaaagctctagaacaaaaagaagcaaattcacccaagaggaatagacggcaggaaataatcaaactcagggctgaaatcaacaaaatagaaacaaaaaaactacacgaagaatcaacaaaaccaggagctggttctttgagaaaatcaacaagatagataaacccttagccagactaaccagaaggcatagacacagtatccaaattaataaaatcagtaatgaaaagggagacataacaatgaaatatatcttaaaataattattttgtttgttgaatattaacagttgaaaatattaaaatcatgttctacaaacatcatggaaatattattgataatttttctcactgtgcttgaaattagcattttttaatgtttaacttcaaagagtttatttttattttgaaaaatttaaaacatacttactgataaaataatttctcctagaaacactgataatctttttaagtaaactgattgttagacaatgtacacagatatataatgcattttaaatcctctctcactatatcaggtggtatcatataagggctcttgaatatatttcttaatgattcacttttatattatatactcttttatttatgcttaactcccaagaatattttctacgttttgaaacatttagtattcaacattagatataggatcctcagttatggatagtgttaaatattcattaatgataccagtagggtatgaaaggatatgaatataaaagttgaacaattttttatgtattatttgattctcaaaatactcgatattattaatatgtttgatgtataagatgcatttaaataataaaaaaaatttaagaaaaaaaagaagaagctagtcaacacagcttgagtcgaggttgatctttccagttctgagaaacaggttcacttgggtgtaacaggggtcggcaggccaaagagaggagggaggtccctgtggcttgtgaagctctcctttccgaatccgggggaacagcactgcagagatggttagccactgcagtccagcacagcatggcccaggaacgggctctggggagcccctgtgcctgcctttttgaggtcagcattttccaaagactcctccagagaacactgactcaaaaggtcccataggcaggaaatttgttggtagtaaggggacagagacacagcttcccggtgtcaccctcagcagcctgaggagtgactgtaatcttctaggcacctcgacagatgccaaatcaagttttatgggtttgacacagaaaagaacttcaggcatagctagtctgaagcagatatggagattttattaaagttatcttaatatatacacaggggctagggggaagaaaggtacttgggggtcctgggtggaagatcttctatgaatcacagagagtaagatagccaagtgtgcgtgcttaagtgtcagggcattagccatatgtgccatttggtggccctcaatgtatatcctaaaatattgctaagatacatcctctgacctcttcttttggcataggaggttatggggtgacactgaagatgtcttggatggagttatcatatggagttaagccaggaacaactagggatgcacagagttgagcacacgttcttctcgtgtgactctctggtggagatgcctagaaaactaaggctttgtagcttgacagggaggaaacatgcatccagaggacccgcgggcctcacctgacagcaggctttccagtaaccttcaggcacaagtgggcacttagcaaaggaagccatccttttccagagcagggccaacccccccttaccctcaccccgcacagctgactaggaatgaacatggtttcagagtaatgaaaggtaccctgtgttatcccctgtcctcaccagataggagatgcccctggaactacaccccccgtctccaagaacccttgctcagatcacccataaaccccagacacatatgcaataagaagtccaggctcatggggtactctgcatctgtagataggactcctgggtctcacaggacctttagctatacttcatgctcatcacctgcagtgtccgttctctcaagctcctggtccaagaagtccagcccatcccgtgttcaacttatccactcaaactggggggcagggtcggggctgtcaccatatctcaaggagcctgtgttgctattgttaaactgcctgaaattgttcctgtcactcatgttgtctctaatcccgggcagagtcctgcttttgggtggagtagaagcccctcattccagtcacgatctctcaaactatgacagatatcctttctagccgacccgccacttctgaagctaaagaacactttatcatgcttgttcaatcagcaaggatcccccacgctcctccctcaacccctaatcaccgtgtaaatctggccagagccaggtgcagatccggcaccgacctcgttctgagcctggcggtttcagtggtttctgcctaaaagttaaacaagcattcatcttgctgagctaggagtctcctatcactgccactgagttggcagttcacacggctgagttccttttcggttctgcagccagggatccgataccaacctctgtcgtggggcaggtgggcatgttctcttctgggctcctaatggaggatctgtgcctctgacccatcctgttgttgggcaggcctcagttcctttcacaacagttgtgggagagggagggcccctgccggcctctccaggaaacccgcttggcttgtggctttatttctgccttcaccataagcagcagagatgcttccctctcttctgtctcaggtgagatgagagtcttgcggcccaagtaccctcagttctctctgtcctgtgtgcatactcacttaggcttagtcacgtctgcaaagtccccttggcatttaacctgacatgctcacaggttccgaggctaaggagtagactcttccgatctgtgagcacagcgttactggtatgtcaagaacactggctctgcgcagctgggtgttaagtctgaagtgcaaggagacactgtaatacatccaatttaagcacatgcttgactagcttaaaagcgaatgagatatggttcttttacttgactttgacaattactggggggtagtccctaattttcttttctaacttctggactggctatctccctagtggtgtaccccaaatacttgctgtttctcctggccatgtgctcatagttctcctctctccagctcattctctctccttctccttccccttctcctcctttctgccccacgcaaccagataactcaaaaaaacgcctacctctaatccctccgctaattgactgtagccattttttatttaaccaatagttttaaattaaggcacaaagcttacacaacaaaaattcacttgtaggcctagtccagagtttagcattaaaatacacagcagcagaacaaacctcaccaggacatagatggtgtgatgagtcagtcagctgtgcctgctgggatggactcagcaggcttgctgggcttcctatcaaataaatgctaatattctgctcttgcaaaacttgggcttttcagagctgttgacttttcaaacgcaactgcagggggcaggagaggtggctcagccacagagtcttctgtttcctccacaactgaattgtacattttagatccgaggcactgtttgcttctgtccatattagttgtacgttgattttgatcatccaccttattagctttttagattcttgatattttcagacacaacaaagttgccacctctcttcactcttacccttgatgtgaccgatgagagaagctctcagctgaagacttggatgggtaccacgtcagtcaaggtctgccccagggtgcctgggaacaggctccacacagattatcaccacacccccagagcagtgacccatcccactgcccaactggcagcccatccatctctctgtgccagcacaccaactatgcttccttctcctgatcattttcaaatttcagatttagtcacagatttgcaaagtctgtcacacttccctttatctgttgtcttgtgaccatgactacccaaggcttaggaccagattgatggctacatgtcagccaacatgtgataacccaccaagtctgtgtctggtgcctcggactccttcatgatattcttgagtgagtgcggactccgtacctcagtggtgacactcaccttttctgtacctacagataaattgtaaagcttttatcttattttttcacatgtattgtgtggaacatgtacacacgtatgttcatatgtgtgggcacatgtgtgttcaggcccaagcctgatgtcatgaatcttcttcagccgctattccatctcactcttttaaggcagggtctcttgaacctggagcatggttagtctcactagccagttgctctggggaatccaatctctcccctggaggctgaagctataggtaagcttccataagcttccatacatacctacctggcactcacaggggatctggggatcctaactcttgtccacgtgcttcatggtgaagccgcctcctaagccttgagttttgaagcttttgacagcagtcgagccttccctgacatctcacggagtaggcagcctgagaaccatcttctctgagtgtctgtgggatgattttaaagagcagacagaagaagacgcgatctgagaaatgtccatgttttgaagatataatgaacttcaccgagacacactggtgatgaggaagaatctttaggtgttaagcacttttatattttcctgatacacactgtcgggccatgctggccacactgtccccgaagggggaaaaggccaacaaggggcagtcagagtgtggtgaacagtgacactttactcaaggtggctggcagcaggcaaggtgctgtgacttctaacggtgccctcactgaacccccaaggtttctctccaaaagataacatggggcagtttttcatagattcctttaaaatcaatctgttctttagactatttctatacatagttgtttgagaactgctggcttaggaacatttaaacaccaaagacacccatatcacaatgtatgttatgtgtagtttgcatgtggtaagaccccgtgagtggacatgtgtgaaacctgagaaacaacccagaaaggtatcttgctgtaggcagcttggctacggttgcttgtaggttcacagaaaggctctggacctccagcctctctcttcttgctatcttgacagtctattttgctctcaacttttccattttatttatttatttatttatttatttatttatttatttatttatttttggttttttgagacagggtgtgcagccctggctcactcctgaaactcactctgtatacgaggctggccttgaactcagaaatccacctgcctctgactctcaagtgctgggattaaaggcatgtaccaccactgcctggcgctctcaactttttaaaggacagaaagaaacattgagttaagaattcaccaacatctttatcatcaaacacaaattctcctaacagaaaacagactggctgcatctccagggagcacagcactgctcaggctgcatctccagggagcacagcactgctcaggctgcatctccagggagcacagcactgctcaggctgcatctccagggagcacagcactgctcagattgggtggattatgatcaggactctctacctcttgtggtggcccagataccaatctgcgaccagtgcgatttcctagcaacaacatgtgccattcttgtggtaacactagtggcttgacaggctgattcatttccaggtactgtgagtgtctgccattcaagtaagcatgacagtgaccttctctccgagagctctgattgccaatctcaccgtgctgagatcagcgttctgcagagttccagggtgctggcccagcacatcatagcattgtgcagagacaggggcaacttacaaatcctgggtctttcggacttggttcgccactctaatcagtaagagtaagttaagacaccctctcttgaatataatatgcatccatatgattgtctgcctctgctactgatgcccttgggcctggcctgagaaccagccacatacccagaaccttccaaccatgaggaactgcatggccatcgctggccattccttcagcaggagctgtcagaagctgtacagacctgaactacattgtttaagggggtcgtgtttgcctggtaccttcctgactgccaggctcaccatcttacactaggtcagtgcctagcctcaggagacttttttttttgttttttgtttttttcgagacagggtttctctgtgtagccctggctgtcctggaactcactttgtagaccaggctgacctcaaactcagaaatccgcctgcctctgcctcccaagtgttgggattaaaggcgtgtgccaccatctcccggcttcaggagactttttaaagcttccattcaagtggttatacttgaattcaaaaactgtgactcatcatagtgcagataaatatatgtcttacatggagaatctagctggtattggtatacagtgcggttggctgaccctcgtagtctttaattccaaccgttttccccaccaacacaatgtacatgggggaaaatcaccatgtcccatctcggcccaaccccctccagctaaggagccatcctgaccactcccctgctttggtctcactaatgatacacaatggtccccaacgccccttgatcacctctgcactaccctgaactgtcacacctcctactgtgctttcctccacctgtagcctcttcccctccccaaatctataccaatcccgcccttcagggccacctcagtcctactggctcatgcactttctgtagccgtcctttgatcttctctatcactacctgtcagtggaaggacatttgtgtaaaagaacatttggcagttttcaaggtagcgttactgggcataatcacacacagttattgaagccaaccattcacaggttttgacatacatgtagccacgcatcaacgattctgctgtgtgggaacacgaggcactcgggatccccctgggcatttacattcttcccagtttagagctgttttagaaggaccttctctaaaaattcaagttagttagagtttttgcctcttgcctgggtgaatgctagcagccagttactggttcacacagccagtgcacagccagtgttacatgaggcgcacactctttggtctacatgctcgtgtgacctcctgttcccccacagccagccagtacatctgcagctgtcccaggtctttgcagataccctggccttccctgatcatctttgtgttcatccattcacacatatgtcaggtatgtggtatgtcaggggggttgtgacttagcctccccaacaatggacagtggtcaacatcttgtgtgcatattgaccatcccatattttctcgagtgtctttcaggtgtggactagttgggattcttcgtaaggtctggatgtgaccagatattagcttgcaaatgttattttccaattcaaatatttttttcatttctatgtattttgcaaacagcagattaaatacaagttatcattattactttacaatatatgctctccccactttttaaaataattcatattttatgtgcattgatgttttgcctgcatgtatgtctgagtgagggtgtcagatcccctggaactggggttatagacagttgtgtgctgtggtgtggatgctgggaattgaactggggtcctctggaagagtaaccagtgctcttaaccactgagccatctctccagaccctgtttttcacaatttatgtaagaaaattcttctgttccttgggttaccaaggttgtcttatgttttcctttaaatgttgtctgtctctgatcttgcatttagagctacaaccagtttgagttcatttttcttgtggtgggggggggggaggataaggcacagctttttcacataaaatccagctgtatcagtaccattatttcaagacagtttttccaccatggactttccttggcactttgttcaaaactcagctatttatatatggctcatttctgggctttgtgttggtcccatggatgctggctcttgccttctccttcatcagcatcccctgacctgacactgaggcatcctgattttcacaaggaggctgtgtgaatcctccaactctgtttcctctcttgaattcattgtagaatgagaatcagttagccagctgctctatgtaaaaacccccagggctttgacttagtttgtggtatgcttacataaacatttgtggagaaatgtgtctgtccaatgctagacatctctctcctgaataccttctctcagctattaagatttttcagcatataaatcttatttacaaatgtgttatggttctttttaatctctccctccacccctccccctctctccctgttctccctccctctctctactgccctccctccccctctttcctcctcttgcccttttcttctagcctccctcacttctgccctccttccctcccttcctccctctctcttcttcttcctcctgttctctctcccttgctcccttctgccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctccctctctccctcctctcttcctttcttccttctatccttccctgtctccctccttctctttctctctctccctccctccctcctgctgtcttcttttccttcaggatcttaatttatcttttgctatttattttgatttttcaagacagcctcactatatatcccaactggttttgaactcactatcctcctgcctcagtctcctgagtgctaaggttacatgcatgcctcaccacactttgcttctagctttcagtttctatattgtcttgctagggcagaatcattatggcttcatgctcgaggcctgtgtctgttcaggatgttcatcctagtaagcttataccacacgcatgcaggtgccttcagaggccagaatagggcattgcatcccctggaactggagttatcactatgagtcccctgacatggtactgtgtggtttctgggaatcaaacccaggtcctccagaagagcagcgggttttcttaacctctgagccatctctccagtctttgaatcatgggctttaatccacatctagatagctagcgcagatagatttttgttctgtgagattttctcatatacaattaactggaattttgggtgaagacctatgcagatcattttttttcttgatatgacttttcttaggccaaagattacaaactggcaattaactgtcaatgctaaccagttcatttacgtgttccttatggccatttccgagtcaccgaagccagactgtcactgagaaagagcccccagtgtttgctctcaggctcagaagtgaccaggaaagcccgtgacgtgggtattttcacattgagcgccatgcattgcagtgtgttctgatggggtagaatgttccagaacacagcatgactggggcacactttgccttttctttcccccagcttcacctctgctctcccaacatctgcactagtgagagtgtggctgaactgcccacttccctttctacaccagatctggctctcccatccacatagagaaccacgcctgcctggggtgagaatctactttatcttggcagggactctggcatggctaggtgtggttgcttgaaatcacactgtcacgatttctattttcattatcattcaggaatgaattccacagagtcctactttggaacggatgattatgacaacacagagtattattctattcctccagaccatgggccatgctccctagaagaggtcagaaacttcaccaaggtatttgtgccaattgcctactccttaatatgtgtctttggcctcctgggcaacattatggtggtgatgacctttgccttctacaagaaagccagatccatgactgacgtctacctgttgaacatggccatcacagacatactctttgtcctcaccctaccgttctgggcagttactcatgccaccaacacttgggttttcagcgatgcactgtgtaaactgatgaaaggcacatatgcggtcaactttaactgtgggatgctgctcctggcctgtatcagcatggaccggtacattgccatcgtccaggcaaccaaatctttccgggtacgctccagaacactgacgcacagtaaggtcatctgtgtggcagtgtggttcatctccatcatcatctcaagccctacatttatcttcaacaagaaatacgagctgcaggatcgtgatgtctgtgagccacggtacaggtctgtctcagagcccatcacgtggaagctgctgggtatgggactggagctgttctttgggttcttcacccctttgctgtttatggtgttctgctatctgttcattatcaagaccttggtgcaggcccagaactccaagaggcacagagccatccgagtcgtgatcgctgtggttctcgtgttcctggcttgtcagatccctcacaacatggtcctcctcgtgactgcggtcaacacgggcaaagtgggccggagctgcagcaccgagaaagtcctcgcctacaccaggaacgtggccgaggtcctggctttcctgcattgctgcctcaaccccgtgttgtatgcgtttattggacagaaattcagaaactacttcatgaagatcatgaaggatgtgtggtgtatgagaaggaagaataagatgcctggcttcctctgtgcccgggtttactcggaaagctacatctccaggcagaccagtgagaccgtcgaaaatgataatgcatcgtcctttaccatgtaacacgagagcacaaagcaacattgccccaaaagccttggtgaaacttgctattacatatgaaaaaagaaaaaaaaagccatgcccaaatatgtacagtaactatggaaattcagcaaagacttcctgcaagttcagaaacagccatgaggtggcactatcagccaaattcttccaggtgtggttgacaagaaacattgtagctcctcccaggttggttctacaaaataagatgggaatgccagattactgggtagtgcttatgaacataaacatattcagaaacgttcatgaaggggtcacagacctagtgacccctaacacccatagcacaaaacaaggatgtagcttgagaaaccaacaaaagcccccctgtaactcatgtgaagcagatggcaagtcaaagatcccatacccagctcccttttatcttctcagcaagcaggaggctatggaggaggaaggcaagagcatccataaactggaacatcaacctgggtggagagaggcgggaaccaagtaggaagtcgggtgcctgggtttgctactggcatgtgagcttgcttccacaaatggaaggagttcttggtgattcccttttcccctctccagtgggtggagccaaaggaagcaagctgggatactgttccaggctgggctctgggtttagcagactccagcacagtttaatattcatccctcggatggtaaacttggcttgtctgtagctgaaagtgctttccttccagatctggaacggaggtgaagatcctggtcaccgagagtttcgtgttagcctctcaacagtggccagcatgctggcctctgagaccaaggggactttttttgtccatttaaattggacattgaatctagggtttcacataatgttcggcaattgtgctaccactgtgctatactccaaagcctttctgtatctttcatttagagagagggacccactaaggtgttcaggcaggccttgaacttgacaatcccagagcctcaactctacaaatagttaagattacaggcctgtgccattatgcctggttctcagactggtcttaaggtagctctatccaaagccatagttagatataaaaacaggtttcagtgagtctcttctgcctcgttagaagctcatagtactctagttcttaaagggctgcttaagcagatggcaaatgtgtctggagatggggaaacacaaatctcattacaagaattgctggtgtgaatgtcaagaaactgacatgttctattctgatacatggtttggaagctaaatggttagtgagctgttgcaatgcctttgttgccatctatagtgagtgtgtgcattcgtgtgtgtgtgtgtgtgtgtgtgtgtgtgtgtgtgtgtttgctcaagttttgaggccagaggataggatagcttccagtatattcctcaggctgtggggttttttatttgggggggggggttgggttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaagaaggaaggaaggaaggaaggaaggaaggaaggaaggaaggaggaaggaaagaaagaaagaaagaaagaaagaaagaaagaaagaaagaaagaaagaaagaggggaacagactgtgcactccgttttcatggagtcctggtttaatttatgttgatgtaataaaactcccagagggacaagcagcagctttgggaagaagaggcctgtctcagtttgcgattttaggtcccacccattattgtggtgctgaagtcagtgaaggagaatcagcctcagccgggagcagaggaagagggatgcacacagccctgccgctcacggctttcttagttttttttttttttttaatacaatttggccagttcataaaatgctaccacccacattcagaacaggtcttcacacctaactaacaagacacccccacctacacacaccctcaggtcacccccatctagataactcctcattaaagctctgccccagtgatcctaggctctgttgagactacagttcaaattaacaggcacacatggtatccctagagcgatgttagtattttctcaatggaaaacgctttgttccaaggctaaaatgactttgaaatcattttggttttaggtattaattattctgtttctcgttagataactagaaaagaaagtggatcaatcttaggtgacagattccaccattctgtaaatgagcagaggtccttaaatcctccactggcctctcgaacatggatccctctgccagctgcccactgcatgcagcccgggatttgtttgtttcaagtctaagtgttggcgatggccgagaaggacagactgtcttgctgagattctagcatccagagtgagagggagaggggggcagccagcagggaggggcggggagcagagggagctgctggcattggggcagaggaggaagcagagcacaaaccatgcctggtcctgcccctccaacagctgactcagcacctttatcctcttatccatctgaccccctttcatggccagaaacccatgatctaagaggaaagaacgagagtgagagagagagagagagagagagagagagaggaagaaagaacagatgtggaggatactggcacctgcccttagtcccagcaacttgtaagcaatgatagaacaatgcccaaggcagtgcccaagtgtcttagtcaggttgtctattcctgcacaaacatcatgaccaagaagcacttggggaggaaagggtttattcagcttactcttccacattgctgttcatcaccaaaggaagtcaggactggaactcaaacaggtcaggaagcaggagctgatgcagaggccatggagggatgttctttacaggcttgctcagcctgctctcttatggaaccaagactaccagcccagagatggtcccacccacaaggggacctccccccttgatcactaattgagaaaatgccttacagctggatctcatggaggcatttcccaactgaagctcctttctttgtgataactccagcctatgtcaagttgacacaaaactagccagtataattgaccccttgtctacttgacacacaaacacatcactattaagcctcagctgttagtttcttattcatccccttttaaataactttaaggcagatggcgggaatggatctggtggctgagttgccgcgtcccccgggtgctgcgcgctgggccgaggttatggctcgctttgcggccaggctgggcgagcagggccggcgggtggtgctgatcacatctgggggcaccaaggtcccactggaagcgcgagccgtgcgctttctggacaacttcagtagcgggcaacagggagccgcgtcggcggaggtcttcctggctgccggctatggagtcctgttcttgttcggagggcactcggccttcccctatgcccatcgcttcccgccccaggcctggctgccagccctccggccttctggcccagcccagtcgggcaagctgagtctggaggcctaagagaatgcgctcccgggctttgctacagcattgcagagcttccaagagactggtaccttcctggctgtagagtttaccactttggcggattacctgcatctgctgcaggctgctgccatggctctcggtccattaggctcttctgcgatgttttacctggccgccgcagtgtcagatttctatattcctgtctccgaaatgcctgaacacaagatccactcatctggtggcccactgcaggtgatggactcttctcttccagagatctgaccccctctaaccaatcttgggttactttcctcttgatctggatggcttttcagccttctgcatgagctaggtactgggaatacagagatgaacaagacactgccctcaaggatctcacagtctagcgagggcctggacaccagccataatcacagatcagaatgataaatgctgtagtggagataacaatgaagatggtgccaaagatgctttctcctctggtcaaacactgggctcctaaagcatttgtagtttcctttaagctggagacagacccggacatcataatcagtcgggctcggaatgctttggaagtttaccagcatcaagtggtggtggccaacatcctggagtcaataaagtcctttgtgattattgtaaccaaagactcggagacagagttactgctgtccgaggaggaggtggcaaaaggcttggtgatagaagagaagatagtagatgaccttcagtctcgacacacagcttttatacgtgacaaaaactgaaggaaatgctcctctaggatcaaacaccagagctcttaccactgataggaactaagattgatcctctgttaaggatcaacccagtgaagaaatagtaaacgcggtgtgcaggcaagcgcctgctgggacttcagttctgagagtgaaacactggacgctctcctggatctggaaagtgaacaggagttcacaaagaggactgtgggattgcgtggtctgcagagcagacgggccaggagccgctgcgtgttggcctactgtaaggtcatggtgcgtgaatggtcatgctctgaagaagtatttatcaagtgcctaccatgtgccagggcctttgtgagctgtgagggtctgaaagatgaacgagcacatctcatttgggaactggatgtacaaaaatttatgtgcaataaagtatgtgcccacaaagggacacttggaaaataaataaataactttaaaagtcccacagtctttgcaaattcttaaaatttcaatctctcttaaaatccaaagtctttacagttagaagtctcttcactgagggttccactaaaatacttcctccaagagggaaaagcatcagggcacagtcacaatgaaaagcaaaatcaaactccaactgtccaatgtctgggatacaactcactatcttctgggctcctccaagagctcgggtcacttctccagccatgccttttgtagcacacgcgtcgtcctctaggctccagatgcctgtactccactgctgctgctgctcttgatggtcatctcatggtactggcatctccaaaacactgctgacttccgctctaactaggcttcaccaacagcctctcataggctctcttcatggtgctaagcttcaactcctttgcatgaccccttctgtcctgggccatcaattgcaactgaggctgccccttcaccaatggccttccacggcctatcacagtgccaagcctcagctgctatgcatgacccaccccttcatgccttcaaaaccagtaccacctgggtgactcttacacattaccaagccctgctgctgcacgaggtacaactttagctatctctggaacacagcttctttgtgctctcagaagcacttcccagaaagatgtcacctcaatgatgctggcctcttcttcatcaccactaatttcttagctccagctaaccagcatcaatagtcccactaatgcaaaagtttcactttagtagttctggtatcttgttaatcacagctgattcttcagccccagctaaccagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggcatatgcaatagtgtttgggtttggtggttgtttatgggatggatcccagggctatttttaataaattaaaattttgtttattctgaaagtatattttctctctgttttttttttggggggaggggttcgagacagggcttctctgtgtagtgctggctgtcctggaactcactttgtagaccagactgtcttcaaactcagaaatccacctgcctctgcccccccaaccccctcgtgatcactaattgagaaaatgccttacagctggatctcatggaggcatttcccctactgaagttcctttctttgtgataactcccagcctgtgtcaagttgacacacaaaaccagccagtacacccaaggcaatgcccaaggcaatgctccctcctgaggctgaggcagttggccggtgctcccacctgaggcctttctctccgtggatgtgcactgtgcttcttgtcccctctgtgggctttttgttgttgttgttgttgtaagatttatttattttatgtatgtgagtccactgtcacagtcttcagacacaccagaagagggcaccagattccattacagatggttgtgagctataatgtggttatcagggaattgaactccagacctctcagacctatctctcagcccttctgtgggcatttttgtagcatgataaaccctgctggaaatggcctgtcttctagacagtctcaaggactcaatgtcttccacgccctttgctgcttgctgggtttccctctcccagacagcctggctcaggacaggactggttataggaactagagtctactttcaacaagttttaatcgcttgtgatagtttcccaatataacttacattacagcagcaagcttgaccctgtggctctgtccttggtcatcctaggaacacacatgttcatgtttcccgcagaaactcacaggagttaactcacaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatactgtgagaagttcttaggtgcatctctctccatgaagtgaagaccagctaagaccgagaagttgcaaggcattgcaatgcaagagcatccttcaaggactagaaagatgggtcagtggttaagaacattgactgttcttccagacaatctgggtttaactcccaggacccacatgacagcttacaattatctataattccagttccaggagatatgatgccctcacacagacatatatgcaggcaaaacaccaatacatatgaaataaaaataaattattaaaaaaaaaagagctctctcagaagggcactgtgcctgacagagcccctaggggacactgccgccagcttttgcttctggttccttctgcagcctggacaggcgactgctagccctgagttctgagcagaacatggggtttgttctctgatggtccacactggcagaagctgagaatcacaaatgtcacgatagacctgcacaggttaaaagcattgagatgatcagtgtgtggcttcgttggaacccaaggtgttaacgctggttgttcctccagtgggagggtttagaggccttcttacctagtgagctgctacggaaggacttcagggaagtttgggaggtgagttgtttttgttttgttttgtttcttgttttttgttgttgaaacggggtctccactcaggctagcttgaacctctgcctcaggttcctgagccctaaattagaggcatttgccaagccctgtaataaatacatttacttttaaaaacaaacaaaagagtatttttaagtgtgtgtgtcacacgcttgtgtcaaggtcaaccaattctccttcagccttgtttttgaggcaggatctatcttgtttctgctgcagttccgagtatgtgattctggcggattcttctgtctccaccttccaccttggtaggcatgccaggatttctaatgggtgctgccacatagagatttttatgcgggttccaaggatcacaccaggccatcaggcttgctggtgggcatcttgactgctgtgccatctcctctccctggtataacactacccccaccaaggtctgatcattaatttgttactctttttgttttttgaggcagggtttctgtgcaccaccactgccaggttgcgactcaggacctctgaaccacccgccttatttgttactcttaaagttctgacttagactggactcagaagtagaagctctctcggcgaagacagcctacatctcttggcaatctgttcatggcattttctttggcttccctcagtgtcttggccaaaagtttagcatacccacagccacttaatgcattgtttcttc

SEQ ID NO: 1916 - DNA, 1280 bp, Mus musculus
aatgagcactgctggttgtgtctgtcaacagaatagtcctcacattcttaggactggagcctggataaccactgaggcaggagtacctggccagtctactttggagctcagcattttctggggaatgaattccacagagtcctactttggaacggatgattatgacaacacagagtattattctattcctccagaccatgggccatgctccctagaagaggtcagaaacttcaccaaggtatttgtgccaattgcctactccttaatatgtgtctttggcctcctgggcaacattatggtggtgatgacctttgccttctacaagaaagccagatccatgactgacgtctacctgttgaacatggccatcacagacatactctttgtcctcaccctaccgttctgggcagttactcatgccaccaacacttgggttttcagcgatgcactgtgtaaactgatgaaaggcacatatgcggtcaactttaactgtgggatgctgctcctggcctgtatcagcatggaccggtacattgccatcgtccaggcaaccaaatctttccgggtacgctccagaacactgacgcacagtaaggtcatctgtgtggcagtgtggttcatctccatcatcatctcaagccctacatttatcttcaacaagaaatacgagctgcaggatcgtgatgtctgtgagccacggtacaggtctgtctcagagcccatcacgtggaagctgctgggtatgggactggagctgttctttgggttcttcacccctttgctgtttatggtgttctgctatctgttcattatcaagaccttggtgcaggcccagaactccaagaggcacagagccatccgagtcgtgatcgctgtggttctcgtgttcctggcttgtcagatccctcacaacatggtcctcctcgtgactgcggtcaacacgggcaaagtgggccggagctgcagcaccgagaaagtcctcgcctacaccaggaacgtggccgaggtcctggctttcctgcattgctgcctcaaccccgtgttgtatgcgtttattggacagaaattcagaaactacttcatgaagatcatgaaggatgtgtggtgtatgagaaggaagaataagatgcctggcttcctctgtgcccgggtttactcggaaagctacatctccaggcagaccagtgagaccgtcgaaaatgataatgcatcgtcctttaccatgtaacacgagagcacaaagcaacattgccccaaaagccttggtgaaacttgctatt

SEQ ID NO: 1917 - protein, 408 aa, Mus musculus
MSTAGCVCQQNSPHILRTGAWITTEAGVPGQSTLELSIFWGMNSTESYFGTDDYDNTEYYSIPPDHGPCSLEEVRNFTKVFVPIAYSLICVFGLLGNIMVVMTFAFYKKARSMTDVYLLNMAITDILFVLTLPFWAVTHATNTWVFSDALCKLMKGTYAVNFNCGMLLLACISMDRYIAIVQATKSFRVRSRTLTHSKVICVAVWFISIIISSPTFIFNKKYELQDRDVCEPRYRSVSEPITWKLLGMGLELFFGFFTPLLFMVFCYLFIIKTLVQAQNSKRHRAIRVVIAVVLVFLACQIPHNMVLLVTAVNTGKVGRSCSTEKVLAYTRNVAEVLAFLHCCLNPVLYAFIGQKFRNYFMKIMKDVWCMRRKNKMPGFLCARVYSESYISRQTSETVENDNASSFTM

SEQ ID NO: 1918 - DNA, 36176 bp, Homo sapiens
gaggtgggggagacacagagaagcccagagccagcctcgtggaatacacagatgtgtctggaacgtgtgtctctggatacactgatgggtctgcttcaagagaattcttgatgctgcaatgcatcagaaggagttctagtgatagcattgtctcccaagtgaaagtgataaaccagtgacaatcagtttcactgtgttgtgggtgaatgcatttatgtcatttaacaatactgcgattccatttgtataacaatctcggatgcacttgttgtaattttgcattatgtcttctctaattaaacatctgaaccctctgaggcctgacttacctggagctctcttatctaataatatcaacctctaaggcagcctgagaaagaggaaatgaacccaaagagactctgcaccaaaatagataccacgaagcctgtacccaaacttggtgtgtttttctcccaggggagaccctcaggtgcacattcagatacactggctcttattttaggcacagttctgataagggggggctgtttggtttcccagcccagagcttattggaagcagcacattcagtgggaatgtcacctgctggagtcaggcacgctggaagtgatgaggaatggcagacagccaggtgcagtcaagaggtgggctggaagaaccccaaaacacagagagggcaactcagtagacctcacatgggcccatttaatgcggaagcagatactgtagttccaagtattggaaggatctcagtgtggaatttggtgtgctgctgcagatgagaaagcacacgtccccagcggctccacgaatggggcccaggcagggttggacgacgcccagctcccctggagacagccagaaatctcatcacatgtcttagcaatattttcacccatcagatcccaagttttaaatgtttaaaatgattagttgaaaattaatttggaataggcttccccaagaccaaaatgttggttggacattgctgtgttgctgagtaaaatacagtaaatatgcagcgcatccttcagcgttcagatgactgcgttagagaggatggggcatctaggcaagacatgcattcctctttactttttaaagcactcctattttggggggtagaatgagaagatggatagatgaagaaagggaaaatggaacaaagaaaggaaaaagggcagggcaaggaagaggttccaggataaaatagacatgagatcttatgagcagagatcgttagggcagggtgggtggaccaggtcacacaaccgtgacagacacggctctgggctctgacaaccgcatcgcagcagacaggatcaagatgcaaagcagggcccttcggcagccggcgcatgacctagagctgggtgtaggaggactctccggcagcttctgcctctccctcctcaccttcccttgatcgggcttatgtcatgaggacgtcatcctccctgtgctgtccccacctcctgccacacaagctgcctgaaatcctaggggctggtggagatggtggtttgatgggttataaatcacgtgacttagctgagacggtctagctccctcctgctcccaggtggtcttctgagcagtggtagacctcgagaggagttcagaatcacaggaccgcaggacccagccctggtctatccacccagaacctacatttgaaccccaaggagaggcaattcataatcacagtgcacttggaaacccttcttccaggcataggaaaccccagtccagaggcatcacttcatatttcggaggggttactgccattgagtggcctaaatttcaaaccctggcacggagatgagcagggcccccttctctatgcagagccccctggccgaggcctgctgtgacggctgctgtaaccagcctgtggctctgacgtcaccgtgcacacgtcaccctttttcatttctgtagcagtttataagtcagtgaggctgttcccggcagacagaaatggaaattagcactctgaatctgggtcaccgagcagtgctgtaaatcccaggggaggccccgtccttagctctgcatccagtgaggacctgaggtgaggatgtcttcacagatccaagggaggaggttttagacacataaatctgtgtgattatccaatggcaagatcatttgataggagatccccaacctaaaaagaatgtggctttcagatctctttctggtagacaaacagatgttttagtaaatcaaaaaatcagccttgtgagtgtaattaaatgactacgtaataaaatcagtcattttcctttggtctttttgtcagaatgagtcttcaggttctgtaaagaatctgtctcctccgacatacatcgccaagacagcggcgggctaatgggggctgtgctgcccactcctcagacactggatgggggtctcactggtccaccccgcagttggctgctgggtcagagagtgtgccagccagaccccagcgcccagcgccctctagatgttgcagaagggcgagagaggctttctgtggtcctcattctgtgagcagacctgtcctttctggcagtcaattatgcctttgcggaatatgattgggagatttttaagtaagtcagaggaaaactgattctgctggaagtcggttttagagctgctgagagctatttcattcatcataaaaatcttgttggttcaacaatacctctttttccacattcctggtgtttaagcagggtgccttgtccaaaaacctagtgtcttttccccattttctgtatctgacttgaagcaaaatagtattgtccactgttctggaaactaacacagaaagaaattgtgactatggcagcactcacacaacagtttatctggaaacgtctagaaggtgttatttttccagcagtgaaaattagtgatatccataatagtcactataattagtccttttgcttttcttagaaattctgtttcattatgcaaccaacttattttgttattaaatgaaagtacaaagagaattttttaataattacatttcttatatttctacctccttatacaaacaccattatgattttcatgtctcttctcatacttgtgtcagtttctcacttttattgctaaaattttgcaaaactgaggctgtatctataatgtcatggtcagggttggaagtttaaatttgagacctcaaagaagatttttcaaaggggatgctatgaaaagctccccattttcctcctagttcaaagatccgcaggcgttataaagcgaatgactactggttaggtggaattcatttctgaagccgtggctgccgccaggagggagcacaccagcaggcgtggatgggcgttattgttgtgtcttctttcttgaaaagctccagggtccaactgcaagaagagatcacgagagagaatgcggaactcctggctctgtctctggagaacattccagaggttgtgctggagccagaaggagcgctttcttatgctgctgtctccttcccgaactctccagagcctctggagtctttcaccggggcctccccgccctcgctccctcttgggaattctctctctccagcacccccgacgctttctgttttagatcaaattgacctttctggcttgacaccctttccagcacaggaggcagctgggcctttctctgaggccctcctctcagcccacagcgcggcagatccctgcggggaaatgtgtcctcccttctcccagcccaagccacctcctcccacctgcatggcttttggccaaagttttccttttgcttcaactgagagtagagctgctctttctccctgcaggcacccttcacatactgacggcagccgccccctcggccttccgctgcaccccgcccctcatttccagtggccctcttgctttctcaggtgtcagggcttcccgcctatgccaccccctagcagagaggcacccaggggtaccctaaccattgcagaggagaagggcgaccgcctcccagtcccggacgcctgcacatccgttaggcccagagtggctgctcttcctgctgtggcagcactgtcctgattttagcacagacgtttctactttccgggaagtctctggaaaactgggagggttggccccctaatcctgggagtccaacaggaagagccaggaagataatgctgcaggagatgacccgtcccgtgggtgagggttccctcccctcccgcggtgggtggagggtgagtcctgtcgtcctcctgtggcgggagagctgtccatcatccatcactgattcctctccacttctgcgctgttcctgagggctgagcacaaagcctccttagaaaaccagagttcagggtgcttagatggaaagtgtccaagaatactgctgcgtctgcgaccacctcagcctctttatccctccccaccaccgtccccgcatccctccctaccaccgtccccgtccccgcatccctccctaccacagcctctgcatcctgcctaccacagctgcatcttatgtcagaagagtgttcgagggatctgggctgagggaatggaaggtgttacctgcttgttttcagttaaggaaataacctgtctcctgggtttgctgcttaccggaactctattttctttttttttttctttttttttttttttttttgagacggagtttcgctctgtcgcccaggctggagcgcagtggcacgatctcgactcactgcaagctccgcctcccgggttcacgccattctcctgcctcagcctcccgagtagctgggactacaggcgcgcgccaccacgcccggctaatttttgtatttttagtagagatggggtttcaccgtgtcagccaggatggtctcgatctcctgacctcgtgatccgcccgtctcagcctcccaaagtgctgggattacaggcgtgagccaccgcgcccggcctctattttcttttttgagtctccctgtcagtccttaatgttttccacccctgtggtctctattccctcaatgtattcttccttcttaaaccctttagttaagctctcacttggacattcttaaagaaattttgtctcaaagagcactgagaacagtagtgatgaaacgcgcaggtcgcttttcagtgctcaaattcttcactctgcaggtttcctataagcacttttctgtttttttttttttttttctttaaagacactgtactaatattttaggacctatcctctggccacttctgaagtgtcacttttccagcttcagtctgtccttctgctttgtaaacatgagcccaacatcccagcagttccatcggcgtctctgggtttaattacaacctctccatgcaagaccgttcctgcatctcttgctaagccccctctttatgactcaatagtggtaacttccacccccatctctaccaccacgacaacaatcataattacaaagctgccactgtgcacctaatgctgtgtgaggcatgaactttgtcttcgatcttcacatgaatcatttacaaatctaaaatcctcgtgtattgattaggagacagacatctagaggttaacttgaaaagtgactttcgattcttgacatgagtctaaagtcatgtcaagaatctccaagaattttcagttacacgagacatcaatctcttcacattccaggtacttcaatgacatccattttcttccctcttagaccggtttctataactgttcttctacgtagaaataaattagtaaataaaaagtaagctttcagtttgatttccctatttctgtcccgatgtaaaatttggcatcatcttgattccccttttgcttgttccttactgatattttccaaaacatctccccacatcattttctcttcacatgtatcccagaaaggtatgaacttttggatcagatgacatggttttgagattggctcttcaacttattggtgtatgaacttgaggaagttgcgtttttcctctgagtttcagttttctcatctgtcacttgaggaggactatgacaaccccagggcccctgggcctttagtgaggattaatgaaaatgaatgggtgaaatggcgagggtcagccccacatgctggacgcccttggtcccggctcccttctctactctgtgatgtcaggcagggctgccgccaggaggagggtgcacctgccctgtgacctgctcttctccctaccgtaaactcgctccctgtccctccacggcccacagacgtctgtgtctttgtattgctgccagccttccggtcctgcagccaccctccccagctccccactgagggctggtgcccccacctgtccttactgctctccacctcggtgcctttctgcctccccacccaggctcatgctgtttgtccccaaattgccttcctccccctgcctacctggtcagatctgagtcgccttcctggctgagtcccagcctttcacgaagagcctgaagtccaggatgctggaggtggaggagctcctctgtgctccctcctgtgaactggacgctcgcagtggcatttcttcactgatccgtcacacgtaggctctctgcatatcacatgtggcttgtattgtcatgtatttaggcctcaactttccaactatatgagttcccaaaaggtgggaagtaaatggcatacttttaactatttctgtagcttgtgtgctgtacatagtaactatctgaaaaaatgattcgtatctgaaaaataatttataacaggtgttctcctggctatttgggagagtaattttcaggccagctactttatggggtagaataacacagagtgactccccatgcccaaatgtattagcatatacagtgagcattgaaggatacaccatttgacatcttcgtaaactccaaaattcaaggtgtcagcacagcttgtacttcctcctataaaatgtgtttttgtccctactagagaatttgctgatgtaatttgttaagtagccttttttaacttttttatgaagaaaaagatatagatccaaaccacataacacagatccaagcactgctgggctcggtagtctatgtttttgcaatgggtgtgagcctgtggctgcctgccagctgtcattgttgtaggtttcttcttcctgtccctccactctcagcacctgtgctaactctaggctttcctggggagggttttgtaaaaaccaacaaatgacgcttttattttaatttgttttgttttttaaaaacatgttcattacttcagaagttttgtgcgcacaatgagagtagaaaactgccccagttatctaccaccttgagtcatggtggctttaacagtgatttatttacaatctcttgtggctctgggggtcaactgggctcggctgagtgcttctcagttggggcctccactgcaggtaccatcagagagtgggtgggagccatgtcatccgaaggctcgattgggctgggggactcccacatgtggccggcaggtggtgcactgctgctgcctggtatctcagcaagaattcccaaccagctcaccatattgacttcctcaaagtttatacagagtgttactttaggggttaacaaagcatttactatcttttcaactttgctgataatttcaaaagatgactgacacccagatgaccaatgtccacaaagtggtgtgccatggcctccagtgtgtgtgctatggcctccagtgtgtgcagagcctgtttgtgaattaaaggcaatcacaaggagaaacggtcatggtgacccattctgagctgtacacagtgtcctctgtaggattgtagccagaggcagatggctttcctagaaatgcctcaatgttgagttttaaagcaactccttatgactgttatctgaatttaccaaactgtccctggcttttcttaggaatgaacttctgatgttgctgtggaattttctgcctggaaacttattgttatgaaacatgtgactgtaagccacattcctcgccttttatgcacctcacagtgtctatgcaaatgaacagtgtgattttaaatttgaggaagtttcaataagagtgagatctaagaggatctttaatataggggcatttttagagagctaaaaaccaaataggtctcagctttctcagggtgacatataatttagatttgacttggaactacagaaggaatatggggcaaaggacatgagaaacattgcagaggtcagtgccatatggagcttccacctcagctctcgaagtaaaggcaaccagcccaggctgggagccagtcagcagcagggtctcaatctccatccactaccttcccctctggggcagggagggtgttgcagggaggaggccactcttggagacctccagatccctgcctctgtgcagtctaacagaaggggcccccacagtggccatgaatctctttgttctgcaaggaagggggtgtcattgggcctcctgggtccctcagcatctgcgtggccacacaacgcggttttgttcaacacgttacatttctgcttaattaatgttcatttttggtccccagcaaagtccaatctgtttttcgttttctttcttttctttccaggcaggcattgccagggctaatcatctataaaagggcttactttcttaccttcacgctaagcaagaccatccaagggcagtgttagagggcacctgagaacgcaggaggggtgtgttacctggtggcctgtttcttcctcctatgggcagcccttctacaggaagcagaagcctcaggggcgatggtagaaatgaggaggaggggatggagctgaggtagcaggggaggggtcgtaagagcagaggggagggtcttgctttgttcgccatccaataatcagcaggtttcgggttggggtgaactactggggaggagcgccccagggcttctctcagatggaggagggacaggtcacccagagtgaaggaagttgtgagctctgttagaggaaaacagccaggacttagtcaggagaggctttgtttggaaggattgttgtaaggcagggagaggaatgatggcagcaagaggaccccgtgaccataggtctgcaagcacttcaaacagaaaaggcccttcttttatccagtaagggggagccactggggccagcagagtctttggaggggaccctggacaaacccgggaaaatggccagtggggttgagcaggacacaggtcctgctgtgtctagctggttccccagagagatgataaggggtgcgctccagcttctcaggctcactcaggcgtgaggacgtggagctcagggctctgcaggaaggagcgacccaggtgaggtgtggtcaagatagagcagagctgggcagcgggcagtggagcctcgtgggcagcctgggggtggggaggcacagtgcactgggaagtggagaaagtgtgagtccatcaggctggctgagaattgatcacgaacctattgtctgtaaaacttttgttatttcctgagacgtggttcacagcaacccaggtgcgaacagccttgtgattctagggttcttttctattttttaagcacttgcatctacaaataaatttctgagtgacttgtcgtcagctgctttccttgatatgtctaaagacagggcagtgacccgcatcgtcacccagagattctgtctctgtgccacatgaagattaggtgcccgcttttgattgaggagctcctctgttgctctcaaagtatcttgtaataatagctgagatgcatggagaaccacctctccttcaggcgctgctcctcggcttccgtggacgggcatggctatttctcggaaccctctgaggttagagctgtcatggtctttcttctgaaagaggaaaccgaggcttgctggggctcagtggcccttctgtggctgcacagctttcggggtggggccaggactgactgactccacacaaaagtgctcccggcccatgtctttaactcacacggcctcttgcaaacgttcccaaatcttcccagtcggcttgcagagactccttgctcccaggagataaccaggtaaaggagtatgaaagtttgggtacaaactcattgctgcaaattgaaaaccatgcaaaggctgtcttcctctggggagttcaatgcctctctttttcttatcactttaccattggttggactttgattccagggatcctacgattactcaataccctacaggatatacatggttaaccatttgcatttgggcaaataggcgttacttttcaataggaagtggcaatccagaacttgcttttgggcaattctagtagctcaccgcttttttcttaatgactgctagaagctgcatcttattgacagatggtcatcacattggtgagctggagtcatcagattgtggggcccggagtgaggctgaagggagtggatcagagcactgcctgaggtgagcatgccaaggcccctgagacttttctttcaaaaatgtaacttctttgatcccctagtctgacaggaatgggactgttttactcattaatcttccagaatgctggcatattgaccatgtttatgcttaacgacacagacttcctttcctgaaagcattgactttatggttttaggaagcccacttttcctctaagtgtatagtaagggatttcatactcgctccctgcactggagcttcggtgatggtctgggtacttgctcctcatacaggagatatcctcagggcatcagtctggagaggaatgtgattctttatttgatcaaatacactgaaagattttggaaaacaaaaaaattaagctaagaaatattttggaggcagtaagtcatttatgcaatgaaggctgatgagtgggcatcccggacagcctaagattgagcaggaaggagcttgtgagggggagttaagagaaattgacaaggtggaaatttcaacaagtctcagttgcaaagctctcatgagggctgccaatgccactgtgattatgaaggcagtatcttatgaccagaaaataatacacaatgatattaaagggagccaggctaggtgcagtggctcatacctgtaatctcagcactttgggagaccaagctgggtgtatcagctgaggtcaggagttcgagaccagcctggccaacatggtaaaatcccgtctctactaaaaatacaaaaattagccaggcattgtggcatgtgcctgtaatcccagctacttgggaggctgaggcaggagaatcactggaacttgggaggcggaggttgcagtgagccgagatcacgctactgcactccagccggagatcagctccaaagtccacttagcagcaggacatagatattgtagagatcagctttataaagaaaaacaaaaatgcaaggccataactaaagctattctttaaatggttaaagatgtaatttctgcaaataaaacagaaaacataaaagcaaacttccaaagaaattaaaggaactgaaaaaaaaaaaaaaccaacccacagaagcttaataaacaaatcaccgggggaaaacaaaaaaaaaatcaaacctcctggtctcctccttagccactctcattcaaaagcagaaggaagccagcctagagtttcagctccactgatgcttatctaaaaaggtataaaatatggtgggcccatgattcaaataaacttagagaacataaatgtattgaacacctaccattatagtatgcaaaactctgatatcaataagatgttttaaaataaatatattatttaagatcttgtgggaattctatggcatttcactaagacctgctggtggcaaggtgaattagaacggcgagtaagagacagtaatgggagtctcaccagtactcacagtcctagatgagctacactcgctatctgtaaaatgggtatgatgtctaccttaaagggttttgtgaggttaaaagagataaacagctgtaaaccagtgattctaatgcctagcaggtaactagaacttaatttacagcatatgcgcgcacacacacacacacacatatgcgtgcatatatacatacacacacgtccatatgtacacacacacagttatacacatactgcacacacatgcatgcatacacacatgtatgtatacatgcaggcaccaatatacacccatgcacacacatgcaaatacacacatacacatgtatacacacatgtgcacacctatatacacacatgcatacacatgcatatacacatacatgatataaacaggtgtatatatgcaggcatatgcacactgcacacatgcacacatgcctagacacatacatacacacacaccgacatatgcacacacacacacatactcttatttagttcttgctccttgttttgcagggccactactatttatgaaagtaagcacaaatttaaaactgtctgacaattgtaacacattgttaagctagttattaaatgtttttaaattacaagtccacacagtttttattaccagtaatattttcataactattactaatgttttccccatattgaattttcttggacagagtctgtccttggccaaagggatgaacaatggcagtcggtctgttgcttggtccccccaacccctgctcttcttggggagccccccacccacagctctcaccggccttccctctttgctaccaccacagagccagccagtattggtctccctgagagtgtgtgctgtggctacccacctcttctggggccatttgcctgtgattagaggactcccaatgccctcaagtccaaaaacatggttttctctaaggtagaggcaccgttgaaggccggggggagatgagtgtggctgtgtttggagaactgaacacggccttaaatcctatagtgagggcagcccctccctctttcttctggttctgctttttagcagaatgtataattaggtgttcttttcatttctaaatgaattagccaattaattattactttctgagatactctattgcatattgtacctaataaaagttgtactaggaagccacattactttattgcaataaaaattgcaaaaaaaattgaacattttaaatgctatgtaagaaatattattctggaattaagtttttattaaagtaacagttttaaacatgtgtgataacaagatctttgaaatgttaaaattgaaattcagaggctaagttattacttaccatgtgcatatatttaatcttcatgagatcctagtacatttgcatttcatttaaaagagtagggtggtggcttgtagtcccagctactctagaggctgagatggtaggatagcttgaggccaggagtttgaggctgcagtgtgctattatcgtgcctgtgaatggccactgcactatagcctgggcaacatagcaagaccccatctctaaaaaaaggtagtttatttatatgatttcaagcctaaaatacatactgaagtatagcttatcattatttgcctctaagtaagggaagaaaaagccattaaaaatatcttttaatacgagtttatttctaagtctaacgtatgtccacaaagagaagagaatcaatcagacgtgaggcctgcacaacttttgtttcatgcatttgctaggggaatggaggcacttcaagtcagaggctggtgtggggaccagcacaccgtctaaagattcctcctgtgtttgccttggtggcaccccttgccacattccctgggtcaggcaatgccagccctggggggcctgtgagctgctgcagtcaggtggtgggtgcatgtagccatcttcttgtcttccctctgctgttgcctcgaatagggattggcccctaggagctgctcagacctgtctttggatgaatgaatgaagagtcctctaggttagtgatattctttggctgtgtccccatccaaatctcatcttgaattgcagttcccataatccccacgtgtggtgggagggaccaggtggagataattgaatcatggggcagtatcctgttctcgtgatagtgagtgagttctcacgggatctgatggttttacagggggcttccctcttcgctgggcactcattcttctccttcctgccatcatgtgaagaaggatgtgtttgcttccccttctgacatgattgtcagtttcctgaggcctccccagccatgctgaactgagtcaattaaacctctttcctttataaattactcagtctcaagtatgtctttattagcagtgtgagaacggactaatacagtcaacttattgatcatatggtttatataatcatacatctataattatatagattatatagtcagattatatgatttatatcatcatataaataaactaccttttttaaagagatgaggtcttgctatgttgcccaggctggagtgccgtggccattcacagacacgataatcacacactgcagcttggaactcctggcctcaaaaatttcccaaagtgtttccaaagaacaggaactgaaaaggttctgtgagtgagaaggtttgggaaatagtgagttattccagcagggctctgaagggccactgataaacaagctctaataggaataaactagggaaggatgtagttagcatcttattaatgtcttaatatactagccacagagaaatcatttcccacccctgtctgtctccctcccttctttttacccagagcatctcttggaactcacttttagatgctggatgcatgaattccctaagaagaaacagctcctaaattgaagtatgcattagaataatacagagattgtgttaatgcaaggatttgaatcttcaaagcagacatccataggatctatagatcttacctaatgtcaaactttactaatgattcaataacaaaaacactaggcagagagatgcatcccatgttggctgggctgttctcaaactcctggcctcaagtgatccacccacctcagcctcccaaggttctgcgattacaggtgtgagccactgtgcccagctattctgtgcttttagataggggttcccaggcttctttccactagtaagtactatttgcatgtttacaaggagatctggtcctcgcccaatccagtcatgggcagagttcagttctttgtgactgtaggactgagatcctcatattcacgttggctgtcagcagagggcctttttagcttctcagggcaaccacatggctcggcttgtggccccctcttctgtctgcaactccagcaacaatacattgaatctctcacctttgaatcttttcttctcccgtctccagggagaaggactcttcacctctagggactcgtgattgcagtgggtccaactagataatccagcatgatctctgcttacctccaggcccttagatctttgacttcattgcatatgcaaaatcccttttgctgtgtaaggcaacacgtacacaggttctggtgcctgtgtcagggcctgggcagggggccatgattccgctaaccacaagcgtgacatggggccatgattctgccgacaagtgctgtcccctgtgtccggtgcctccgcgctctatctattattgggttggaaagccttagtgaccacggtggagagtacccagaggtgagcagagctggctggctttccagctggctggatgtctgcgcccacatagtactgattaactagcctcttggtgagattactagcaaataaaattcttaagatttttgctgctgctgcactttcatcttatatctgtgtagttgcttatttatttttgtatttttattttttatttttgagacggagtcttgctctgtcacccaggctggagtgcagtggcacaatctcagctctctgcaaactctgtctcccaggttcaagtgattctcttgcttcagcctcttgagtagctgggattacagatgtgtgccaccacacccagctaatttttttatatttttggtagagacaaggtttcaccatgttggccatgctggtctcaaactcctgacctcaagtgatccgcctgccttggcctcccaaagtgctgggattacaggtgtgagccaatgcacgcggcctgcttatttaaagctatgtggagaagcttctattttccctactgaattttacaacattagatttacccattgcttgattctgtccagaatatttgtacattgattctgtcatccaatatattaattatctttttaggcttcttgacatcttcagatctaatgaacttgcctcctctctttttgcccctctcatcaatagaagcaatgggcaggacacagctgaaggccgaaatcagtgcagtgtccatagggccttgtgccagcctgccagcaaagtggtgtcacagagccaattgtccagacacctagcaagccacctaattgtacttgcacctggatcatggttcctcttcttgattgcttataagtttcagattttatcgtaagtgttcaatgtctgtaacacctccctgatctgcagtttattgactgttaccaccaaggcttggaaatcagtgtgacatgactgagtgttaccaaacccacgctgacccccaagggcccaccacttccgttccagacgctcctgcacttgcttcataatgccctcaacaccctgctgagaaccaacagccaacattttacctcattcggaggcattatcttctttctctctgcaaatgggttttgagcttccttacaccagctctatgctcctggacttcacaggcaccattcgctggagtcaggcaaattcactgcaacattccctgaatatttttgaaatgctttttttaaaaaagagtagagaggtgccaaacaggaatcaagaaattctgctttctcttgtcttcagaacatgtgataaagctcagtcaatgagatatgccttcctggtgaaggagatactcaggggatgagacatgatgagtctctcatttggtgtcatgccatagtgtgcccgccctacagggtaccccgggtcctgtgagaggctaacattcaggtggggggtgacaatgagttactgagacagcaacaatcgacactttacttgaggcagctgaatattggaaaagaagcctcttaactgcaaaaccgaattgagtcaaatgacatttctaaagtgtgtcattagatgactttttcttagagcccctgaaactcctcctccaaagaacagtgtgtcctacagaagctctagaagtattcctctgcccacttgtttgggaaatatctaaattccaaagacaagaaaattacactttaagaatcagttgagctgaatgtattttacatgtgatttaatgacatcaaagtgagatctggtgagaatggtggtcatagggaccacgtgtgagataggaagtgctgaacctcaaagagacagtgtgagatgtgttgcaggtggctgctttgcaagggtaggttcactggttcaccaagaactggacacagggctcagcacatttccctgcatctctcatctgccactcgtagataacagggtgtcttattctcagttcattaaagaaggaacagaaatatctactaaaaaacttcttagtgtcttcacatcaacattttcttaatagaaaatctgcagcctgtttctccaaggagctggtgactgctgcctgagatctgagatgatagagcaagttgtgaacaggattctttacacgttgaggtgatacccacgccaatctgtcaccaaaacagtttccttaaaacaattcacacagtttttcctgtgaaaacagtggcttggggaaggccgaatcattttcaatgactgtggctggcatacaggtgaacctgacaaccaccgtttttatggagaatcctgattcttaaccacagtgacattaaatttgtcattatctagaattgtacattgtttatacctaacacgtgcaaaacaccatcctaagagacatggaatttatcaattttggttcattgacttattctgagatgagaataaatgaaaggaaattaaagtagtgtcttatgaacaggacggagtaggccagcttctcatagctctgccgggaacttcctgccctgtggcctgtgtatctggttccctctgggcctccttctctcagggaccccaccctctgggcccccctccctccgggactcctccctctgggcccccctccctctgggccccctccctttgggacccctccttctgggacccccatccctctggaccccttctctctgggccccctcccaactccttctgccgacagggatccatcacacaggcgccccagtgctggccttctgttcaccaagagttactcactttctggggtgcatctcgtgatgactgctagcatggaaccgttatataattacttgtttacctggcagccttttgaagctcaagtacgcgttgagtcatcgctgcacttcagtgcctctcctccgtagacagttcataaacatttgttgaactgagttcaacttaaattcagaaaatactgtgtgtcacggtgcagttaaacaaatgcttaccttaaatgggggcccgttgggcatcgagtgcacggcgtgccgggccgtccctccctttttggcccccgctgctcttcccatcgtcatcaactcagcctccacgtgatggggaggtcactccctcccatccggtcccagccccactcacctgggaacccgtgccgctggccccaccttggcctagcatccgtccaaccctgcagcgaccgctccccacagcccctgctcccttgttctccagagccgcgcccctgctgcaggcctccccctcgctgtccccaagcccctgccttccacccacactgcccactccttcccaccgtccccgcctctgtccttatggagtcctcaaaagctcttcttgccccagaacctcccattacccctcagtgctcagcggcagatccttgctgtgactgtttatggcactaagtgtctgttccaacacatttgcgcggaagagtacgcaggtacttttaaattaactttattgaggctaatttatatgcaataaatgtcaccgattgaagggtacaattcaacaggtcttgacaagggcacccagccatgtgccacccccacaatcaggatagaggacatttctgccaccacaaaagccccttgtgtcgcccaaccccagccaatcccttcttcccgtcctgatgacaatccctgatttcattcctgccactgttattttgccttttctagaaatgttaggggtggaatggtgcagtgcatggtctcttctgcctggatttcttaccgagcgaaggttttgagtcacccccgttggagcatgcattagtcgcccgttccttttcatggttgagtagtatatgctgttgcatggatacacttcaactcgggtatctgctcaccagttcacagacatttgggtctttttcagtttgggacggttaagaataaacctgctgggaatgttccagtgttaatcctcccatgtctcttgggtagacatgtaggagtcggttgcaggttcctatggtggatgcatgttcagctgtgcaagaaaggaccccactgtctccttggagtggctgtgtgatcttgcagtcccaccaacaaagtgtgagagccccagatgcaccatgtcctctcccagcttccagccccctgtttaatcttagtccttccagtgggatctctgtgtgtgtgtctgtgtgtgtgtgtgtatgtgtgtgtgtgttttggacggagtctctctctgtcacccaggctggactgcagtggcgtaatctcagctcattgcaacctccgcctcccgggttcaactgattctcctgcctcagccccccaagtagctgggattacaggagcacgccatcacgcctggctaatttttgtatttttagtaaagatggggtttcaccatgttggccaggatggtctcgaactcctggacttaagtggtccgtctgcctcggcctcccaaattgctgggattacaggcctgagccactgttcccagccttcattgtggttttaatttgcattttcctcatgattaatggcattgagcgtcttttttgtgtgtgtatttgccatccatgtattttccttggtgaattgcctgttcacatttccccctgtttcttattgtttatgtttttgatagggagttgtaaaaattatttgtatattctggatataacctattatcagatataagctttaacatacttttttctattcaatatatatatgtttcactttcttgagtgtctttcaaagagcagaagttttacattttgtacaatcaagtacaatttatcaatttttttacagttcattctttttgcaatttatataagaagcttctttttccagggtcacaaagattttctcccatttttccttctagatgttttatgctttagctctcacatttagatttataactcatttgagttaccttttgcaaatggtgtgaggtaagcagtaaggatcgactttttgttcatgtcattccaggaccatttactgaagactgttcttttcccattgagttaccttggcacctaagttaaaaatcagtccgccatctatatgtggatctatgtctggcctctgttctgttccagtgatttatgtaactgtcctttcagaaatccaacaccgtcatggttagtgtagttccttgtcagctctgagactgggtagtgtgagtcctccattttttttttatctttttcaaaattgttttggctattttaatttccttgaatttctataaaaattttggaattgacttgtcaatttctcaaaaaaaaaaccctaccataattttgatttagtttatgttgtatctacagatcgatttggggagaaattatatcttgaaattgaatctttgataaatttgaacatgaaatgtcattgaaaattgaacatgataaatttctccattaatttaggtcttatttaatttttgccaacaatgttttgtagtttttagcatataaatctcacataaattttgttagagctatccataagtattttacattttatgatacaattgtatatataattattgatactattatatatgatatatgtgtgtatatatatatatatatatatatatatatatatatatagttttaacatccaaatggtaattccaattggtgtattttattttacatattgtatatttcacctcccatgccctccacccctgccatgctctgcagcttagaaagagtgtgtatcatttctcactgtatttgttctcctcctgccaggatccataatcctgtgatgcctagtgccgaggtctgaaaatggttgttacattttgtaggtttttctagttgtttaatgcagcagggtgcctttggtctctgttgatccaccgtggctggaagctgaagtttagcagtggtgttctgattgctgtgcttcttctgattgatacgattacctcgtcacatgcttttgcaacacaggggtctataccacgcttcttctgcatactctaaagcactcaactgtatacctgctgggattacaaaagtgcagaggtgactccataccttcctccagctttttaggcccaaagcagtgactgaggggcagtgaagaaccgatctctaagttgtgactccaggcatcagggaaggaatggggtggagtaaataatgaaatgagaatcaaaattatgtaagaaataggtttggaaaataattcagggtgaactttgtgttacatgggcttcctctccaaaaggtcagtatccacgtggactcgtaagtgaggactgatatgacacagtgtgggggcgaggagggcagttccactttctctgcctgtgcacctggggctgcacttccctagctgctcccgcttggcatggccaggcccacgtggtgcgagagcagggaaaagaggaggaagatgggcgattggctgggaagcacatccaacgtcaatatcagagcgtttcaggccatggattttactgggggacgtccagggcgtgttaataaacaggatgatggacaatgctggaaagaaggagtgagcctgagaatagcgaagggtttttctttctttttaagtttgcttcagatggtggatttcaaagcccttcgtcctcaggcgctccacaaccgctccagctcttcccggtctcctgctaaacttcttcagcctggacccatgcaccgccactgctggcgttcccagcacacggtatactccattgtttcctgacaatccagttgattcggccaggctggttgctcagctgtttcacaaacatacagggctcatgactcaggactgctcttcagcctgagacgagctggtcacctgaaggagatggcggttctctgtcaatcattggcccatagcctcaccattctccaagaaccctgatcagagcctcctcctccaggaagtctttcctaactgtgccagcctccacctttcctctggcatttggatttctgatgattaggatgcctctgccacagcagattcatgcttgtgacctggaatgtctactggaaaggtctgcggctgtggagaagcaggtgcattcctctccagcgccttcccaggctggagcagcttgttcagtgtgtcttgagaacagcactcatagtcaaactttaaattctactggagattctcacatgcccacaggggtgatcatcactgacatatattgtgaacgatttaaagcccgggactatgaattatacattttctatgcgctttcacacttctatagattttgttcagtaaaatcttgttgaatgtttttaaattttgcgtaaagatttttgtgcagatcaaaacttgtggatttctgagagcaccttatttaaccaatagatcaagggttggcaaattatagcctctagccaacggaccccggcgaggcctgttcagttatgtaattgtagatgctttcaagctccaaaggcagatttgaggagctgtgacagagaccatatggcctgaaaagccctaaaatatttactatctggccctttacagaaagaggttgctgatgcctattctcaatgaatatttgtatgtaaaatagtgtgctgtgcactctgttcacacgagatgaaatgctggtaacttaactgtctggctctccaggaatacctgtgttaactgtagtgcattttgccttctttccttcttagagtcacctctactttcctgctaccgctgcctgtgagctgaaggggctgaaccatacactcctttttctacaaccagcttgcattttttctgcccacaatgagcggggtaagatttttatttttggcaaggggtataatttgggttcactgtggctacttgaacactacactgcagctaactctatctttgtttcctttccaggaatcaatgaatttcagcgatgttttcgactccagtgaagattattttgtgtcagtcaatacttcatattactcagttgattctgagatgttactgtgctccttgcaggaggtcaggcagttctccaggctatttgtaccgattgcctactccttgatctgtgtctttggcctcctggggaatattctggtggtgatcacctttgctttttataagaaggccaggtctatgacagacgtctatctcttgaacatggccattgcagacatcctctttgttcttactctcccattctgggcagtgagtcatgccaccggtgcgtgggttttcagcaatgccacgtgcaagttgctaaaaggcatctatgccatcaactttaactgcgggatgctgctcctgacttgcattagcatggaccggtacatcgccattgtacaggcgactaagtcattccggctccgatccagaacactaccgcgcagcaaaatcatctgccttgttgtgtgggggctgtcagtcatcatctccagctcaacttttgtcttcaaccaaaaatacaacacccaaggcagcgatgtctgtgaacccaagtaccagactgtctcggagcccatcaggtggaagctgctgatgttggggcttgagctactctttggtttctttatccctttgatgttcatgatattttgttacacgttcattgtcaaaaccttggtgcaagctcagaattctaaaaggcacaaagccatccgtgtaatcatagctgtggtgcttgtgtttctggcttgtcagattcctcataacatggtcctgcttgtgacggctgcaaatttgggtaaaatgaaccgatcctgccagagcgaaaagctaattggctatacgaaaactgtcacagaagtcctggctttcctgcactgctgcctgaaccctgtgctctacgcttttattgggcagaagttcagaaactactttctgaagatcttgaaggacctgtggtgtgtgagaaggaagtacaagtcctcaggcttctcctgtgccgggaggtactcagaaaacatttctcggcagaccagtgagaccgcagataacgacaatgcgtcgtccttcactatgtgatagaaagctgagtctccctaaggcatgtgtgaaacatactcatagatgttatgcaaaaaaaagtctatggccaggtatgcatggaaaatgtgggaattaagcaaaatcaagcaagcctctctcctgcgggacttaacgtgctcatgggctgtgtgatctcttcagggtggggtggtctctgataggtagcattttccagcactttgcaaggaatgttttgtagctctagggtatatatccgcctggcatttcacaaaacagcctttgggaaatgctgaattaaagtgaattgttgacaaatgtaaacattttcagaaatattcatgaagcggtcacagatcacagtgtcttttggttacagcacaaaatgatggcagtggtttgaaaaactaaaacagaaaaaaaaatggaagccaacacatcactcattttaggcaaatgtttaaacatttttatctatcagaatgtttattgttgctggttataagcagcaggattggccggctagtgtttcctctcatttccctttgatacagtcaacaagcctgaccctgtaaaatggaggtggaaagacaagctcaagtgttcacaacctggaagtgcttcgggaagaaggggacaatggcagaacaggtgttggtgacaattgtcaccaattggataaagcagctcaggttgtagtgggccattaggaaactgtcggtttgctttgatttccctgggagctgttctctgtcgtgagtgtctcttgtctaaacgtccattaagctgagagtgctatgaagacaggatctagaataatcttgctcacagctgtgctctgagtgcctagcggagttccagcaaacaaaatggactcaagagagatttgattaatgaatcgtaatgaagttggggtttattgtacagtttaaaatgttagatgtttttaattttttaaataaatggaatactttttttttttttttaaagaaagcaactttactgagacaatgtagaaagaagttttgttccgtttctttaatgtggttgaagagcaatgtgtggctgaagacttttgttatgaggagctgcagattagctaggggacagctggaattatgctggcttctgataattattttaaaggggtctgaaatttgtgatggaatcagattttaacagctctcttcaatgacatagaaagttcatggaactcatgtttttaaagggctatgtaaatatatgaacattagaaaaatagcaacttgtgttacaaaaatacaaacacatgttaggaaggtactgtcatgggctaggcatggtggctcacacctgtaatcccagcattttgggaagctaagatgggtggatcacttgaggtcaggagtttgagaccagcctggccaacatggcgaaacccctctctactaaaaatacaaaaatttgccaggcgtggtggcgggtgcctgtaatcccagctacttgggaggctgaggcaagagaatcgcttgaacccaggaggcagaggttgcagtgagccgagatcgtgccattgcactccagcctgggtgacaaagcgagactccatctcaaaaaaaaaaaaaaaaaaaaaaggaaagaactgtcatgtaaacataccgacatgtttaaacctgacaatggtgttatttgaaactttatattgttcttgtaagctttaactatatctctctttaaaatgcaaaataatgtcttaagattcaaagtctgtatttttaaagcatggctttggctttgcaaaataaaaaatgtgttttgtacatgaagtaggaatcgtatttcagcttcaaggttcagattgaggggcccactgtttggagaggatggtattcaggctttctcatgtccttcaaatctgttagcgtttgactctagaaatcaaagcaaaggagtggttacccagacacttcttttggtgtgatcaatgcgctgatgtgatctatgaagatgattcatgcttgaaaactagcacagaaacatcttgcttatttgccaaagctgggagatgagcttctctgcataatttaaatgttcagataaatgaagctgacttatttaagcaataaccttttaaacattttagctaagatgtataaaaatgtttccaaaatataccacatactttatttcttcttaaatgtagtacattaggttacatcatttttcttgctgtcttgggcatcaaaacaggtgccatggtaacctgacactctcaggagacattaagatagaaggggctgttcttcagtggttcccattgattctccccatatctttttgctctcaggctctggccgtctcttcctgagccttaactgtgtctgccgttagtcctcctctccactcattgcaaacattattctatatgtttggtggggacatcagctatctgcgcttgtcagaattgtctattaataggggcaatgtgttagaacctccaagtattcaattatttctggatacgtgagatcttactgtatgtaaatctcaacatttaggtacttaagtattaccttgcaaactgtacgtgatttgcttctcaggacagacagactggattttaaatgaggccagaaaaacacaatattttcaaatccttttaagacttgtggtgatgtgtgcaaattacaggcattctggagatatgtgtacagagaatgtggtctcaatgaacgcagtgtacatgctatagtctgctaggacattagtttgctggggctgccctaacaaaatactacagactgagtggcttaaacaacacatttatttctcacatttttagaggctggttaaggtgttggcagggttggtttctcctgaggcctcaaatggcttttcctctgtgagctgacgcttcttataaggacactagtcagattggattacagcccaccgaaaaggcccttttaacttaatcaccggtttaaaatcccagtctctaaatatcacaactttctgagatactgagggttgggactttgacatatgaattttaaggggacaccatccagcccctaacatctatttccctgaaggtggggcatattttcctattaaagttaacctgaaacatgtgagaatttctttgtacatactttccgcctttccaataagttatgttccaaacattcattcccatttcggcttttcaggtgcagacctcacagagagatgacagagaagggttgtggtccccagtgagacaacgcctgcctatctaacctgcacagccttgagctccagcacccacccgtgcacagccttgagctccagcacccacccgtggtgcaagtttcagtatctgatcccagtggttcacctactgccctgacctctgccctgaggtgtggcatctcctcccttcccagttctctgacagggaagtggggaatttccccaagtctgagtggcctccatattcaaagcagagacatccccctctcagctgtggacctagggatggtgatctcagctgtggcagcagaaagcagctgtgatagcccaggggaggccaggccctattctgccccctatttgtataaacagagcattcaaggctcatgacttcagcggggctctctgttgtcttaatctcattcttggggcacattctcctgtaggacacagaaggaggtggcattttacatttaccattagatgatttgagtcattgcagcctcacagcacagctgccctgatgcattctacattctgctggctgctgtgtggagaacctgacatgttcatggtctttgtgctcagggatttcacggaataaagaggctgcagcattcggatgaaggccaccctcgctctggcatgtttgcagagcttggggtggtctgcattctacattccgctggctgctctgagaatctgatgcactcagtctttgtgatctcacagaataaagaggctgcagcattcggacgaaggcccctcgctctggtgtgtttgcagagctcagggtggtttgctgtgacctgatttcatgcttatgactcagtatgcacagctgcaatcttcttccttgtgttgcatttgccaatagcatgatattcctgatgccttatttaggtaaatccatataagagctaaggcaggaacgatttattttctacttcttggctgattcctctcttcattgagagtccaggtggacagtcaggaatgatgggcagagtgctgttctcctcacctcgaggctgtcctcagcacaagggagctgttgtacctccttccagcccatttccattctagacaacaagaagcaggatgcgggaagcaggtggccttaaagacacaactggaaagctgtggaaatcatttctgctcccaaggtgggagccttcacttagtcacatggttacagccaggtgaaagaaagtctgggatgctcttcagcgggtggccgtgtgtccatgtgcacgcagtaatcacaaacacaccatgtaagaagggggagagatactgagaaaaccactttcatggaggggaggcagccggactcctctctttaaccagaggggagggtctgcatctccccagctgtaggtaagcggtagccgaggcagcccactaggccaaggccactcaggagatatggctggccctgtgcagcaagtctagggtcacctgggatgcgccctgtacacaggggcctcttctcctgtagcccactaataattaccacagtgcccacagccggtccatctaaatgttcagaatactgtatttagaattagtgttaacatttgaataaggtttcatttttctgcctaacattgaaagatgaactggattcttggatgtcacataacattttggggtcccctttctgaacctagaatgtaaatagatgagctagcacttctcttcacgccagtggggagcaaatgcgattcctaaagtcctggcttcaccaggagccgagctcctgagccttccaggggtgcctctgccctggacagggcgctgctgccctctggtgcgcgagccgcctcccagcgcctgcacctgctcctggagacgctcaccttcccggctgttgccctaattctgcaacgtgtcaaaggacaaatgtcacatgtatgtcttagcggggaaactctacagtttattttggataataagtatgtgaaattaatacaatcttatactatcttcttgcacccgtggcgtaaaatcttcagaaaaatatcactgcactattgctgctgttcatttttctccttgttgcttttaacattcacaatagtagattggctctttcctttttattttattttatttttttgctatgtgaacatatacatagcagaataaatatatgtataaatcaggaaatacagcatctatatatttttatggcagataatgtagaatgacttttaggatattaagttaataaaaagaagatatgtaaaatgatgtaatctctactcaccaagaattcattatgcaagtccaaaattaaggagaaaggtaaataaacattccaggcaacctcccttttccacctttgtgaatcacggcacatctgattgtgcactaggatggcagaggagtgtgtgtgaccctgggcgagctggctttcatggtggtccttgctgcctttgggcccccaggtgtccaggtggggcaggagaggtggtgctgcctggaggcagcctctccttaggaaaagccttctcaggacccctgtccctctagtcctctgcagacctgacttgacaccatctcacacggatgcatgagaggccgtggccaggggtgccctctgagaaccagccccctggccctgtccttcagccttctgggcctccttacttacttttctccagggaatgtgatagagacaacgtggctggcggcggggctgggggtgcaaccaggggagagctcgtgctctgagatctctcccgttagctgtttgctctgctcgccgctcactctaaccagctacagagcatctattctgtggtgtgggcagctgcccaccacccttgcctcctgggtccatggctgagccaccttgtgcagcccctggggactctgtggggcatgggactgaggtctggctggagatgcctgaacacaggtgaaacgcatcatttccaggtctggtgcacaaaaccactcgctttctcctgaaggccggagggagcaggcacaggagaccttggaaacagctgctggaaacagcagaacctgaatacactgaccctccatgtgcctggtgctactgtgtgagcaagaaatgaacttctgttgggtttgagtcaacctacattgaattttgtttcatgatttactcatccgaggcatgggccatcgttctgagctgtccccaggcctgactctccatggctctggctgaggtccttccacccgccctccttcctccccactcacgtgtgcccatcagccttggtggaagctttgctcaggagatgtggtgttgcaggggctctgccatcttctgtggccagttccagggcccagggcattggctctcccccaaccctttgtcgccagtttcaaaggtggaagccaccctccccagcaaaggtggacctggcctgggctgtgcctgttgattgtcctaaactccactccctagcggtgctgcacacccacacccctgccctgggcctgccgtgggtcaagtggaagattgttcccatcaaatagtaaagaggaaagtgagatggatgcaaatcccaaaccccacttccgtattctgccctctctccacctggtcttctgcctgtttccaatgctcccattcactctggagcccctggagtttggcccctgcccccatcccaccaagctgtcttcaagaaggctgccctgtgccctatgcagccaatgcagcagacgcctctcagctgcctcctgcaggtagcacgagcccttctccagggcccgggcagtgggctttgctctcctccctctcaggtgggcagctccatctctgcctcactttggcccctccaactttatttgaccctgacatgcagtggtgctcctgacgccaggtggggtttctctttctcctctccctgcatcctctccccaggccaccctatctcccctggacttcaggacggcacacaggccgatggcaccagcatgtgcatctcaactctagatcttcctcaaggaccctgccaggcctgaccccgtgcagtcctcattgcccctctcctccatcttcttcccttcctgctgcaagtccggccccatggctgtgccccttcttccctaggtcatgtcttccctgccctgggacagccgcctctacctggcactcatctctggctcctcggcgtggatcaggtgggctcaccctgcaaggttgtacatgtggaccctcctgccaatgctgcaccctcttcttggcctccttgcttcacatacactcacctatctgcctgttcatggatttgtcctgtgcatcttactttccatagcctgtgtccccaatggaggtgaagcagagttagggatgcattgtgtcataaggagtcatgcactcaagacctacatgcagttattatgcaggtaaagaaaaggctcttagtaccacttcaagggccatgtccgtccaaccatccttgacttcttggtttgggctgcacttgtgattccattgtgctttgtaaataaataccacctagagcaattacaaatgcatcacctttatttttgtttgcatgataagaggcccctaaagtgagttctttggcagggaatagcttttcaattctgagtccctagtttgagaaacatccatcaggcatataattgtcactcagatgttttcttctgcgtaaactcttcagtccaatctacagcatgaacatcactgttccaggcttgtctcggtaagatgagtcacaggggcaggtgagatgtcctgaggttgcatcgtggaataagcagtgaatttattaagccatggttagtagtaataagctgaatgcgaggtgggtcaaagcaacatgtgctattatctgagtctgttttgatgccatatttctcggagaagcaaatgtgtaaccctctttttgggtattacttagatcttgtcttttaaatggcaggtttggcttccttaactctcgcctagagattttcagaccacgtcaatattttgcaaccaaaggagggatgctgggccggctggctgccaaccatgactaccccgaggctcctgctggctgttacagttgtcatggttcagagggcagctggggccccagagggtctcagtgagggtgggcggggctgaggggagggcgctcacctacccgccaccagcgcccagtggggccactccatctgccggctggatatgaacgggtgttgcgcctgtggtggttccagatcagtctgtgtcatcttccatccccacccctctgccacccatgaagggtggtgggtgtcctctgccccgtctgctaatgaagctattttcatcagttcccccaccccactcactccttacgtaccaagcaattcggtgatgaagtcactggtttccagtacattgcctacattttaattctttgtttcctttctttccttttttttttaaagcaggttttcatttgtgaccttcatattggcaaaagaaacaattaatgcatttttctagacagcaagctcttaaaattgtaggattctggtgttcgaaattttttgaaacacaaaatgttttgtaatacaataaaagctctaactgcttttagcctgttgtaggtaaaataatgcaatcacacgtgtgctccaggcaccgtggactcattatggaacaggattggagccttttgaaaacagatgtatgaggagggcttcagagttttagtaaatatgagaagaaggagtcattaaagacgagggtgtttcctttcccggaggaatttttctagccattcatgtgcacacagaaaccaaaaccctccgcgcaggttcttctgcgcactgcgctgctcccagcgcagaggggccgtgttccgggaacacgtttcctgctctaaaacgtccggtgtgttccggcccaagtgcctgctcaggtttaaagggggtttcttttgctagtacttaaaaaagttaaaaataatcactactattaaatagatctttagtgtgttttaaatggcaaaagcacttcactcagaattggtgattctgtttcatgcgtgtgttaagtggggataggtttgtggcaagagttggatgctgttatcttgctgaatggagaaagtataatgtaagtatatagctaatagagcaatttgagtttctgggccctgtccagaggtcaataggaaatctggtgaattttcattttttaatagcactatacaaatatacgactggtgtggtgttgcgtgagaagtgtttggtttggtgtagaacagagcccatgccacagctctgggggccgcagagcacagcaggatttagtagggccgtctgggggtcgccgtgctgtgtaatgcggggggcactgggagggaggagaggaaagccttaaagtaagaggcacaaagcacacgagggtgagagaagctgcaggtggtgaaaatggaaatgaagggttaaaaggaaaccttttgaaaatctgcaccgccagccatccccgaaatcgctgcctctggggaactggagagcacagcacattcctgtcagccgcggctctccaggaaggcagaatcacaagcggtgcatgtagattaagggatttatttaaaggcattggtgcccaagcttgagttgggcgagtctgagacccgcagggcaggctggcaggcgggaaactcaagcgcagtttgtaccttacagaatgcaggcgggaattccttctccaggaacccgcggtttttgttcttaaagccaagggattggatgaggcccacacacattgcggagggtcacctgctctactcagagtcaactgagaacaggcgctcatcacagcctccgcatacccccgcagcagcgtctagacttgcgtctgaccatcgggcaccatggcccagccaggttcacatatgagattaagcatcacacttcccaaggaagggacaccaaaattatgtttgaaacccagtgaggtgtggtccacacacatacatgcctgcagggacgaggcagggacctgaatgagagaagggtgagcacaacccacttctgggcgccagctcctcggtccagccaacgcagagcagagtgagggcccagggcttgcaaatcttctggtgttcaagaagagctgaaaatctagccttttaaaaatgcagagcctcacttgaaagtaggtgatgtaatataattttaatatattcactaactataatgtgaacgttttaaaattatttgtgagccaatcaaaatctgtcagtcagctgaatttaggccttgggcagccagttaaagggttgtgaaatgaacggtatttgagtggtcaatacacagccgccagctcgggagcttgctccccaccctagctgccaggtctgtgatgagaaagcaggtgttcttggcctaacagagagtgcatgtctcgatctaatgccttctctccttccctctcacctgcttcctcctcctccctcttctccctctgtagacagagatgcctcttgcctggaagggctgccttggcatctaggagcaaagggaaactctctggggctgatttccatcccactcttgtctccagaagctgctagagatgtaaagtgaaaatgatagaagaaatgtcacagaaggaaaactcaattcccttgttgactcaaagtggcacattaagcaaactgtcacttttgattgaagatgtggggagcattttgttctcctttccatgggctgagctgggctgacagagaggattccttcatgtgctccaagtgaccacagcctgaactggcagccacatcccaggggaggaggttgacacacacaaagttggtggtcttggcccaactcagttccttggcaaactcagtttttttgtccttgtatgacttttggaagcaggtggctgctgggaaatgcagtccctaggtttcaccagcagataggagagagggcagagccatcccctagagcctacatttggcatttgagtcctagtcttgtcccttgctggttgtgtgagtttgtgtgagttattccaactctcacatttccagtttgcttatctgtaaaatgggtattaatgatagtacttatcccatgtgtgtttaagatgaagatgggttataggcaagaaagccagggtaggcagggtggaaactggttatcatctgctaatcagccgtggaggagacccagcctcttccccaattcctacaattcctaccatgttggactcagttggcttaacttaggaaacaagaagtagtttgggcccaatattaatgctgctatcctttattggaatgttaaatacaacagaacaactgtttcatgttattgtatacttttggaataaaatctataaaagagaaatcctctagcactttttggttgctaactcttacatatgtaagtttt

SEQ ID NO: 1919 - DNA, 2981 bp, Homo sapiens
caaacgttcccaaatcttcccagtcggcttgcagagactccttgctcccaggagataaccagaagctgcatcttattgacagatggtcatcacattggtgagctggagtcatcagattgtggggcccggagtgaggctgaagggagtggatcagagcactgcctgagagtcacctctactttcctgctaccgctgcctgtgagctgaaggggctgaaccatacactcctttttctacaaccagcttgcattttttctgcccacaatgagcggggaatcaatgaatttcagcgatgttttcgactccagtgaagattattttgtgtcagtcaatacttcatattactcagttgattctgagatgttactgtgctccttgcaggaggtcaggcagttctccaggctatttgtaccgattgcctactccttgatctgtgtctttggcctcctggggaatattctggtggtgatcacctttgctttttataagaaggccaggtctatgacagacgtctatctcttgaacatggccattgcagacatcctctttgttcttactctcccattctgggcagtgagtcatgccaccggtgcgtgggttttcagcaatgccacgtgcaagttgctaaaaggcatctatgccatcaactttaactgcgggatgctgctcctgacttgcattagcatggaccggtacatcgccattgtacaggcgactaagtcattccggctccgatccagaacactaccgcgcagcaaaatcatctgccttgttgtgtgggggctgtcagtcatcatctccagctcaacttttgtcttcaaccaaaaatacaacacccaaggcagcgatgtctgtgaacccaagtaccagactgtctcggagcccatcaggtggaagctgctgatgttggggcttgagctactctttggtttctttatccctttgatgttcatgatattttgttacacgttcattgtcaaaaccttggtgcaagctcagaattctaaaaggcacaaagccatccgtgtaatcatagctgtggtgcttgtgtttctggcttgtcagattcctcataacatggtcctgcttgtgacggctgcaaatttgggtaaaatgaaccgatcctgccagagcgaaaagctaattggctatacgaaaactgtcacagaagtcctggctttcctgcactgctgcctgaaccctgtgctctacgcttttattgggcagaagttcagaaactactttctgaagatcttgaaggacctgtggtgtgtgagaaggaagtacaagtcctcaggcttctcctgtgccgggaggtactcagaaaacatttctcggcagaccagtgagaccgcagataacgacaatgcgtcgtccttcactatgtgatagaaagctgagtctccctaaggcatgtgtgaaacatactcatagatgttatgcaaaaaaaagtctatggccaggtatgcatggaaaatgtgggaattaagcaaaatcaagcaagcctctctcctgcgggacttaacgtgctcatgggctgtgtgatctcttcagggtggggtggtctctgataggtagcattttccagcactttgcaaggaatgttttgtagctctagggtatatatccgcctggcatttcacaaaacagcctttgggaaatgctgaattaaagtgaattgttgacaaatgtaaacattttcagaaatattcatgaagcggtcacagatcacagtgtcttttggttacagcacaaaatgatggcagtggtttgaaaaactaaaacagaaaaaaaaatggaagccaacacatcactcattttaggcaaatgtttaaacatttttatctatcagaatgtttattgttgctggttataagcagcaggattggccggctagtgtttcctctcatttccctttgatacagtcaacaagcctgaccctgtaaaatggaggtggaaagacaagctcaagtgttcacaacctggaagtgcttcgggaagaaggggacaatggcagaacaggtgttggtgacaattgtcaccaattggataaagcagctcaggttgtagtgggccattaggaaactgtcggtttgctttgatttccctgggagctgttctctgtcgtgagtgtctcttgtctaaacgtccattaagctgagagtgctatgaagacaggatctagaataatcttgctcacagctgtgctctgagtgcctagcggagttccagcaaacaaaatggactcaagagagatttgattaatgaatcgtaatgaagttggggtttattgtacagtttaaaatgttagatgtttttaattttttaaataaatggaatactttttttttttttttaaagaaagcaactttactgagacaatgtagaaagaagttttgttccgtttctttaatgtggttgaagagcaatgtgtggctgaagacttttgttatgaggagctgcagattagctaggggacagctggaattatgctggcttctgataattattttaaaggggtctgaaatttgtgatggaatcagattttaacagctctcttcaatgacatagaaagttcatggaactcatgtttttaaagggctatgtaaatatatgaacattagaaaaatagcaacttgtgttacaaaaatacaaacacatgttaggaaggtactgtcatgggctaggcatggtggctcacacctgtaatcccagcattttgggaagctaagatgggtggatcacttgaggtcaggagtttgagaccagcctggccaacatggcgaaacccctctctactaaaaatacaaaaatttgccaggcgtggtggcgggtgcctgtaatcccagctacttgggaggctgaggcaagagaatcgcttgaacccaggaggcagaggttgcagtgagccgagatcgtgccattgcactccagcctgggtgacaaagcgagactccatctcaaaaaaaaaaaaaaaaaaa

SEQ ID NO: 1920 - protein, 390 aa, Homo sapiens
TIHSFFYNQLAFFLPTMSGESMNFSDVFDSSEDYFVSVNTSYYSVDSEMLLCSLQEVRQFSRLFVPIAYSLICVFGLLGNILVVITFAFYKKARSMTDVYLLNMAIADILFVLTLPFWAVSHATGAWVFSNATCKLLKGIYAINFNCGMLLLTCISMDRYIAIVQATKSFRLRSRTLPRSKIICLVVWGLSVIISSSTFVFNQKYNTQGSDVCEPKYQTVSEPIRWKLLMLGLELLFGFFIPLMFMIFCYTFIVKTLVQAQNSKRHKAIRVIIAVVLVFLACQIPHNMVLLVTAANLGKMNRSCQSEKLIGYTKTVTEVLAFLHCCLNPVLYAFIGQKFRNYFLKILKDLWCVRRKYKSSGFSCAGRYSENISRQTSETADNDNASSFTM

SEQ ID NO: 1921 - DNA, 45326 bp, Mus musculus
  misc_feature (1)...(45326): n = A,T,C or G
aaaagcatgtagaggctggagatatagcttggcgggaggtcctgggttctatgcccagcccaacgagggaaaaaaaaaaaaacactcttaaagggtgaacttaacgttggccaattagctgataccattggctgcacttctctgcattgcaggagagaggtttccatccacccatttcagtgtctggtggggatctggtaaaagaggttaagagaaaagcaagacagaagcttgtatcaccatgtgccctgtggtgttcatacatcctagaaaagccatgtgacatttgacaaagtcctggcttccagggctgaaaacaagggcagaagcacacatgagatgtaatggccagtacagtttgcttcctcagtacccagttcccaggctgcagagggtctgtctgttggttactggctttcctgttgcctggtagagagaagtagacacctttgtaaatgcacatgctgctgctgggcaaacaggcagaaggcagagcgtgtttttatagaccggcttcttccaaactgccttcagctcaaaatagtccttatgccaaagtgagagaggggtgccgagggagagcccctgtggcatactgcagtcttcacgtctttgggcaggtaagacaaaacaatggaaagctctctctggtctggttctgctgcacactgctccctggcggtaaaggatgaacttgcttccccttctacagttcctttattctgcttttattttctctgctttactagtatttaattttgttttgcttaatcaaattactgctgtgtcttaaaagttcatgtgtgaacaactaaacccccaagctcctccaggaggaggctaggacaagctgagaggcagaggggtgggaccctgtgctggcattcatggctttatggggaaaagggactgagccagcagcgcacgctctcagtgcttcaccaggagccacaccttgacgctgctctctccaatctccagaaacacgagctaaataaaccctgtccttcataaattagtcagtacagccacagaagacaagctctgatagctacagcatataactctggaagaaagtaagataccgtggcaagagcagggacccagacaggcttgtggttaatctcggctgcacacattgggcaaaccacttaccttttctaggttttaggacttctctgggggcacgaagcaagtatgaaaacaagagcaatttgcgcgttgttccgttggcagttgagaaagtgaggcacagagaggctaagtgacaagctatagtcaacaacctaacagtgcattgaaacccacgcaacacaaccctagagcccatgtagaactttaaccaccatccacaacctagtgcgagactcttcatggaaataatgaactcagcactttcagtgcactctgccgagtgtcctagcaggggaagagtgatgtaccccttccccggcagccacatcacacgcacagtctgaaagcatctaaggagcctcacaggctggccacccacaacatcccgtccgttctctacctgcctgatgctccccgtctactgagaaggtgctagtgctccagtagccagactaacatccccatgatttcagacacatttttaatagtaaagaaatgacatattccagtccaagagaattcaaatggagctgggaaagcatttccttgctagatcctgtctggtcttataggaacctggttacaatatgttgaattggtttttttttttttttttttttttttgagacaagtctcatatatcccagattggcctcagatctgtatgtaaccagatctgtatgaaagcttggactcctggttctcctaaccaccaccagactacaggcaagcaccacgaagcccagccttacattggctggttttatgtgttaacttgacgggacatgggcacccagtctatgagacagtttaaattttggtaacctaactagatggaatgggacatgctcactttaaaattgtgttttcttacatttgcgggaaattttgtattctaatgttaatttgagccccccaaagttgtttgcaaacgagtgtctgcacgtggcttctgggaatcgcccacagtccatcctgatcagtaaataaagatgccagaagccaacggctggggagaagaaaggggggcggggctggcttgggaaggcaaggaagaggtaggggagccttgatgccttaggagtgtgccagacagagacaagacccatcatgaggcagaaaagaaaggagagcaccttgggctctgagccaagagaaggtctctcagagggctaattagactgaagagcagtcaagatggaacatagtaagtagtaagtcagagttattgctgggaggtagattgtaacagcatggagattaggcagttgcccagctattgtgctgtttaaggcatattaaaatataaaggctgtacatgtgtctttcattcgggagcataaaccgaggcagctagtgaccccgtgccaggatttactaaaaatattaatactacaaattttgttttttatttgtgtgggcattttgcctacacttatgtatttgcaccacatgcttgcagaggccagaggagggcaatgttctcttgggctggagttataggcagtagttggttgccatggaagttctgggaatcgagcacagatcctctaaaaaaagcagctagcactcttaacaccaagcctttttccgatccttattttatttttttaaaagatttttggtttggggagggggtcagtgggtatgagcgtatgagtacaggtgcccaagtaggtcagaggtgtcaggtcctctgaagcctgagttacgggcatttgtaagctgcccagtgtgggtgctgggagccaagcttgggtcctctgcaggagcagtatgtgctaactgctgaaccatctctccagtctcgaattttttttttaaaggacttagtctcttcaataagagagtgtgttttgctctggcctttacactgggggtgggaagaggaacatactccagggtcagcttcagtttccctgggcactgagcaggctagctcaggaacagatttccccggtctccagcttccaagtcaccctgcagacccaagcccttgtcagtctccatgtcactgtggacagattaaaatcaaactactatgtgtaggtatgtgtgtatttatatgttcatgggcatcttgctacttccatagacacagtaattttcctttgggtcctgactgcagtccgtccagttcctctggagtgccctctcttcctcgccagcaaacctcccaacacaacagccgttgagtaccatctcttggggaagccatctggctttggcagctcaggctgccatacaaaataccccagaccaggtgtcttcaacagaaacccaacttagtctctggaggaagttcaagatggtctgtgtcttcagttcctgataagagaccctttttgtgttgggagggtttgggacactggcccaccgattatgacctcacccagcccttactagtctgtggaggtctcatcttcactgcaatcacagcgaagttacagtctcggtcttcagtatccctagtctccctccaggccctccagctgcagtttccccgtcctcactcaagggctcactccaaggcttcagactgatggctgcctggctgtgggagatagttttcaacatcttcaagcctctcaatcttcaagggtctagaacaggatagccactcaatttgaaagtattgattagatgcatttcagacctttctgagtatccgatctacagatcagctaatgcctcaagcccgtcattctccacagtagtgtgtcatctgcattggaccagcctcccaacccccattcctggttccttctgccaactacaccagtgctgctttcactgcacacagacgagtttcttcctttactggagcactctccccttcatctggccctagcttgaagtttgcacactacaaggactcctcttagtttttcctgatctattaaacccatttcctttcctgtgccccgattgtaattagactgccagcatgggaagtactctttgctccctcttaaccaatgtcctcagtgttcggtgtgacccttctaaccccctaactgttctccttaaggccaggcttaaaaattaacctctcaatggttcctttcttggaagatgtaggaaaacaaacaaaaaaaccactcttctagtttctctcataaaaagcagcacagaaagcgtttaactttattcctacgtgaatatgcattcatactgcacaggccacttgcgtggttggaaatgagtccacaacccttttacagaccggtatggggaaactttgtgaagttccaagccaacacgtttgaagcttcccatgtatgaggcagcctggaatttcctctcctggccgattgctctttcaaaagaataagagcaaggttccagagacagcagaccccgccgccgagcaaaaccggcttaagctgagcgagtatacacgcacagaggcgagaatagaatgcctacttgctgctcacgcttagaaacaaccccttggaaggccccgccccgcagtttactccgcccacttggagtctccgctccgcagttcctcttgtccctccctcccagagcctctccccccgacaccgccatctaagcgggtcgagccagtaagttcagccaaagtggactcttctctcgcacaggaatggggaaattaagtgcaatttagtgaaatttctaatataattctgttaatatgccacagagcgcgtcaccagagcctgacccggtcaccagagcctgaccccgccccgtgtccatggctccgcccataaacgacacgctgagacctcgcccctcgcgtcatgaaacccaaacaccggcctgaaggccccaccccgtaggtcttcttccccgcgtgaggggcggggctgcgactgcgcgctcgcgggccgggtggcttccgcggcggccgttggccgttagcgcggcttgggtggttgtcttggagaagcaagatggcggcgactaccgccgcggtggtggccgaggaagacacggagctgcgcgacctgctggtgcagacgctggagaacagcggcgtgctgaaccgcatcaaggtgcggcggggcggccgccggggctcggggctgcgcgggacgccggcacgaggcggccacgcggccgtggggccttggcccgagttcgtgggccgggtgtggagcgcacaggcccgtcgccttccatcgctcgctgcccgcgcggccggcaccctcgtgtctgcccccgttctttcaggttgcgaaactgacttataatcttgtggttttttttttttttttgaaggctgaactcagagcggctgtgtttttagcactagaagaacaagaaaaagtagaggtaagagatccccagaccttgttcatgccgtacctcttaatgcccggtttctaataaatgaaaagccgtcctgaaatagttcagtaactaaccggggatgcttctgaacggctaaggattgggcttttaccaatactcattttctaaatcattttgcacgtttagagtggccttaaagtagcacaggaatttcgggagacagtagtagctaaggctcaggtgcaggagtcacgtgaaagcggttcgttgagttaccggaagtattactttgaaatttttataagctagtacacttcaaatgtcttggcagtaaggaatgcacactggaaccttttcccaaattctgattggttggttaaaaatctgaccattactttaaaaacatctctgatcttatccccccaccccccaaaaaagaaatctagtgagacctgaatgtttaataacttggcttttctgcctaccccaggccccagcaaccatcctgagtaaatgtcctgtaactccttgtcagtaagaatcacaggagaatcaaagtcttactgtgtgacagatctgcctccatccttccacggctgtggccctgtttaacctacctgctcttaactttctcctcttcatccttactggttggttcttggccaggctgggtcccattgtccacccttgggagtcccatgtttctttgctttctagttaaacagtaattatcatttgatccagtgaattattttcttaacctgtttctgcataagcattgccaaagaaaagtcacttagccaggtgactgtgtgagttccgtagtggtgggttgtaactgagcagggtctggggttctcccgtctggtcccctttagctttcttacctgatccttcactcacaggaacaagagaagctcctgggtcctaacttgtgccctgttgctgctatcccagtctgtcagttcaggaaggttacctgtatccgtctagctgtactcctactttcagagaagaggctcggccttgccaatataatttgtttggttttgtctgctatgtattctcatctccttagttaaatactgtgtctttgatttcttttctgctggctcttttgagcacaaaaatgtttaattgctcttaaaatcgttttactcttgattttctcctgctttaacaggcaaagtttgaactgtacatctcatgatgttttttattacgaggtatcccttgctccattaaacatttaaacacagtactgctatacccgaaacgtctcttgctacattctagaaggttcctccacttgagtatgcttcagctgtcacccagctcgcctggctgttgcaccatctaacagtgacccctctttcatttttggaaatgttttgaccttgggaacctttttctaagtgttttccttttgcctagtccttggtttcttttaagatctcctccctgcgtaccatacttcagttgtcggtgtcctgccccagtgcttagtctgcagcttccccaaggcaaccttaacaccactggtaactttgtcacgtgtctggtgcacagctcccgttccgagcttcagacctgcgtgttaggttaggccgtgtaacagactgatgtccatgagttttccaggcctgctctgcccttgctctgtcatctcctggcagtgtctgcctgcccttcttggcttagttacagcttttccagagtgacacttgctactccccatctgtcatgggtgccctcatcctatgtctcaggtcttcagctgtcctgggttggccatttgtagcacatgcctgaatctgtccttctggtctccttgagagaccagttcggttaactcagcgtcctagagtctctataccatgtacttctgtgatttttctccctctttaacttaaggtatagttgtttctgtaaatgcataccttaaaatgtcagatttgataaactttactatttatggaatgtgaggaacacaaccaagaaagaaaatctaggcacaaccctttgagtttgccttccccaaccttccccagcatctcagttagtttcaaagccatgcaaatgggaatgtgtaaaattcacttatgtctgataatcatcataatgctgtagtgtatcttattattccacttagtcctgttttcaggaatggtagattgttgcattagtcactgagtggatagttttatttgcttagccacttacgctttgataccacatttgggttgtccctgtttttcacttgtggataatgctgctgtgaatggtcatgtccagatctttgctgggatctgggatttatctttagaaaatatttgagggtggaatgactagctcacctgctggagataatattaacctaaaacctaaaaacaaacaaaccttccaactgtttccacagtacccgtgcattttgtatttccatccacaaaatgtgaggctgattaaggctgttgttacctacatatcctgtcaactgttaccacaggtttggtttgcaagaagtatattttactacgtctgttcagactgtaagccaaaagaataagttgagctatggccacaaagagtcatctcataaaccactgattaatttggaattgcagatggtagctagctaagatgataaatttcaaattgtatgtacttgaaatagaaagttaaagtaaatttagtgccacacatgtttgtaaaaagcagtgcaattataacatgttggagggcttgtgggatagacaagtgtaggggacctgcctgtcatgtgtgaggccttgagtcgtccccagcagtgtgaaaggtgctttaaaagtaagtcctatgccaagtaaatagctgtgagatggatggagaaaccacgatttcatgaatagcggtgtatgtgttctttatatctttgccaacataaacgtgattgttgacactctgctctggaggatgtttgttttctcacctaccgaccataaacttgggctatgggaaaacagagaactttaacgtgcactttttagttattttagggtaaacatatagcacttaaagtatttcttttatttttaacagaacaaaactccattggtcaatgagaacttgaaaaagtttttaaacacaaaagatggtaagatgttcttgtgtttatttgatcttacatagttgtggggagggtcgtctcactctgactcatgctggccggactctagtcctcaggggtcttcctgcctgatgcatactttacccaggagcacgccaccatgccatagtaagcattttggatagtgggaagttgttggctaaagcagacttagtatagaaagggaaacttactaaaatccgtttttcaaacactacatggtcttgaagttgcaggttgatgatccttatggaaaaatagaaacatggggatttttatgcttaaatgaattagtcacagaggaaatatgtgatttaaaaaacttagagacctcattttccccatagaatgcttcagttcacaaggactattgagaattctttgagctctgatcaccatgtctttttttccccttggtttttacaggtcgtttagtggctagtctcgtcgcagaatttcttcagttttttaatcttgacttcaccttggctgttttccatcctgaaactagcacagtaaggaaaacacaggatttcacacttaacctgtgacttctctacagagtgaatactaagtgaaaatgaagttgatcacattaggttatttttttgtgtttgctagattgtctttctaaaaagccatctgagctgcttcatgtcacatgaagctgctgagaaatgcatgttactgtagagttgatcctactaagatgttagactctatatattgcaactgtcatagtagagatcctaaaacatggctgttctatacaaaccttgcaaagttcattcacttcaaacagactctttaaatttaaagatgtctttacatgtccaaaatactccctttggtacctggctgttcttgctatattttctgcacctaaatcttacttcttttctagattcaaggtcttgaaggtcgagagaacttggcccaggatttaggcatcattgaagcagaaggtactgtgggtggacccttattattagaagtgattagacgctgtcaacagaaagaaaaaggaccggccagtgtggaagtaagtatcctgcgctactgtcttctagattctgttttggtaattgtctacttaagtcatggagatgagtacgtgcctaatgacttgaggcttgcatgaaaagagccgctcgtggtggtggtggtggtgttttgttcagtccactcttttctgttttcttttgtttttgttattgttgttcaggacagggtttctctgtgtagccttggctgtcctggaacttgctctgtagcctaggctggtctcgaactcagagatctgcctgcctaagtctcccaagtggtgggactaaaggtgtatgccatcatcacccaacactagacgctgccccttaaaacaaaaggaagtagactgtgatggtctataaatagtttagtgaaagtgaaagcctgtggctgggctcgtgtacctgctttggctgttggtcctcagagttcaggaaccaggctagagtaactcgtaaactcctcagggaccagctgctgccctgaccatgtccactttacctccatcacctccgttataaaatgacaatgagagtcggaccagccctcagcatagagagcgtcactgatggatagatagtcttgttactagttcagcgtgaaaggctgcattacacataagttttagacataaagattttttaaaaactttttgtcatatgtatgagtgttttgcctgcatgtgtatatgtaccattgtggacagtggccacagagaccgaaagagagtatcaggtctcctggaacctgttgttacagttgtaaacagccatgtaggtgctgggatttgaacccaggtttctgcaaaaacagccagtactcttaatcactaagccatttctctagcccatctaatggattttttttaaacactgagctgttgacattacttatttttaaaatgtttttaaactccaactttttttttcttttgttagattttcttctatatagttttgctatgtagtctaagtaggccttgaactcatgatcttcttgtgccttcttagtgttcagatgacaagtgtgtgctattaaactagccttgcacagatgtatgctttctcgttagcagtgacttctcttgcctgtcatctgtcttttacggagtcttgctcataagattgatgatctcacttcctgccccacacgttagctttacctacatacactgtttgcatagtcagctccttagaggctgctccactgtctgtctggatgtgctttcagtcagaaacatttagctgagaggcaggagggtcgtaaactacttgtggattctatttagagaccagtcagaacctgaaaatcacaaaagcttgtctgaataccagtttcatttaagacatagtaaatagattctctgggtaataaaagagtaggatttaagaaagtcctgcgtcttgaaagagctcatctaatcaagaagatagacttgtataaagagtttaatgtttaaatgatcacctaaggttatagagaaaggtgtgaagcaactgtttaatgttgaactcagttcaccatgtcattataaactaaaattcttccagcggaccagacagatatttgtatcttcaaaaggaaatgctttgttctccaaattgcagcactatgaaattgggggattatctctttttgttagttttttttgtctttgtagaattcattagtgggttttgggtgggagttactagggggcatttgtacagacaacacaatcgaggcgctcagcagggtctagtgtcttacttgttttcatttccataattcactgctattttactttgttactttgaaaggaaacctgtcataacgaataaaaaactggtaggttttttttgatcctaaacttaaattatggataagaaagcttgctatatgatgatactaaacttaggttgtgggtaggaaagcctgctctatgaagatcaacacatcagactcagttttgttgcctttcaccaaaactgcttttcagagtttgtattttaattattagtatctgtatgtgttcaggagacaacttgtggaagttggttctctccttccaccatatgggttcccagaagcaagttgtcaggcttgacaggaagtgcctttacccactgggccatctagacagcccctgcaactgcatttaaaagctaactgaagaatggggttgctggctctagtcccagctgtggatgattaaagacactgaatgtttgctgagtttcccagtgattgggttccctccttcctggcatctttgacaattatatcttcatctcttctagaagcatccattcctgccagtggcttctcttcagtctcttcactcatgctgaatggtttaagattctgctctacattcattgtctatttaaaactagagcgactccagcatgggatggaaagtgtagattgtgtgcagctcagaccctgcttctggaattttaggagcagaagcagtttgaaattttgagcttttgtaatttgtgatgtttccataaaccttggcatccaagcaaatccaggaagctatgatggaaaggtggactgggcccccacagtgtagatcgggtgcccactccagggtggctaagggaaacactttgcagggaattcaaatctgacagttaagtgtgtgtattcaaattagaggaaaatctagaaaagggatttatgaagaaatgtcagtatgatgttcctaaatgctaaatttctattgaagtattgttgacatagtcatgttttagtttcagtgtgtttcagttcaaattttgatttttcttagggtgcactggatctatccgatggacatcctccatcaaagtcacctgaaggaaaatcaagtgcaaactccaccccaagtaaggtgagtgcatggctggacagagatgtgggcactgggcagacacccaggtgccctgctccctcttccgacctgttgcctgtaaactccctttgtaacaagtcttcttaaagtgtctccaaggtactttcctctttttgattacatacgttttttaaaagttgcttcttttatatttaatatttgaattttgtatctcagaaaacactgaaacttggaaatatttttgtattgcactagtaagaagctttgcataaactcctagctggtgaccgtgaagttccagaatataaaatgttgtagttgagttttgtagactttttagatggacgaccagatttggaatcatggtagtatttaaatatttatgaactatatttgagacttagaggaaagtatactatggttggtgtgtgtgtgtgtgcgcgcgtgcgtgtgcgtgctcgctgttaataaaacctgatttcaggaatactagatgaaagagaaaaaaattttgaacactggaatttaagatcaaggttgtgtttttttgtttttaagcttttttttttaattttaagaactatttattttattttatgtatgtaaatatactgtagctgtcttcagacacaccagaagagggcatcagatcatattacagatggttgtgagccaccatgtggttgctaggaattgaactcaggacctctggaagagcagtcagtgctcttaaccgctgagctatctttccagctcaaagatgtatttaataatagagcattttaagtgatggtctcccaaggctgatagaatacatcctgactggttctagttggtcctgtgaaataatgggtttgggtcatatcttagtccactcaggctgctgttatacgtggcagagagtgcatcacttatgaacagcagacattgatttctcacagattgaggcactggcagatttgatgcctgatgtagtaccagttccttctatatatccttatggagggaaggagagctcaatgaaatctttaatccatgcacaagtactccacactcttgattaatcattccccaaaggccctgcttaatactctcttactgtagggattgggagtgcagcattatcagggtttttaggagggtgggtaggcatagctgcgcagcccattgcagttcattcagcattgagctctgtgactttcccatcagaatagaaagatggtgtgcagtccatcccagcacaaggcttcatgtgggttcagggtggacaggattgtatagatagaactggtgtcttaaatcaggtggccttcggagcttgtgtgtatactgccaagtacttcattgctgagtgccttgggcagcacactgggcgtacttatggcttcttccttgacaattggttccctctttaagctttgaaagccaaaaaaataccatatttgtagccagcagggttattctgttgtgtggcctttgagatgtccaggccttttcaggtaaggattatttcaagacatttctcttttgataattatggaaagctgtaaccctgattgacagactaggtcatgagtaaattttacaaaaatcctttaaatgctgagtgtcaatgcttgaagtaatgacctgcttggaaatccactttttagtaaatttttttttataaaggtaactgacaatcccatgtaaagtatatcttcaagaaaaaaaatgttattacatgttttattctctgtatattttttaatatctaagagttagttatgatatggagtgttttaggaaatgttgctgtaagttcttacagaagagcatctttctcctaggctagtatgcaggcctgtgtgtctcttggagaggggtgccaccctctgccaccttccatttcttctctcagtgaggtctcctctgttgtgagctggggttagagtggtcctttaagaaacacccaagatcttgatagctggccgggactgggatctgtttaaaatacatccttgctttgtcacttgcagtacagttccgttacatacctgaagagtttgagattctagctctccacttttccttgcctctcgatgattcctcatcagccttgtgagcccacagagtgaaagtgtgtgagggacactggaaagttgtagccaaggactggatttcgactgtcggatgggaaccagttgtgtgctcctggagaagggaacttaaagtgtgccgagccccaggagctgcttagggtctccaggccagtggagagtggtacaaagggcagtgtgaaagaagccaagcccctcctcagaagctgggggcagtagtcagtgccagttgctgcccagaaacctgctggaagctggttacaacgggcagacattctgaaagttatgaaaggaagctgtggcaaggagtattttaaattgtccaattgcagataccatctaatagccgtctttattagtttggtaatgagttagtttatttttaaagatttacattatggtaaaatgtcattttattctcatgctcagataccaaggtataaaggacaaggtaagaagaagacaatcggtcagaagcctggtgacaaggtaacatgcatgagggcagaagagcaaagccgcctgtgctgagacacgggcctcctgctggcctgggttctaagctttcttcttaaacgtgcctgccggctactatcagcccatgagagccagagctgaggcgcaggcctgtcatctgagctacctgagagggtaaagggaggacctgcaggttgaaggccaagctggacaatgtagtgagatcccgtctaaaactgcaaaggagttaagtaggctggggaaatagtcgaatggcagagcactagactagcaagcgctgagcgcagtcctcagtaatgaaaagacaagacgtagaagagtgtgagaaggcgtgctggcataaaccaaaaataacttatcagtctggtaagaaaacatcacagtaattagaactagtcacagtgatttaattttcagttctccaggatcctcagttctgtgtggagtctgatgcatagacatactcctaagtttaaaacatctcaaataaagacttaaaaaaacaaaaacaaaaaaccaactaagacttgcctgtgaactggctctagctgtagtgattgtaaggcaggttccctttgcagtcgctgcttatacactatttgataaaaagatgctccatggtccggtaagtcctgttaaacatctgcacagtgaaagtggctttgtttgaactcacagtctaactggaaaggccagacagccttgagattatgcaaggatattaacctgtagtttgagattcattgcattgtttagaattttaagttagatgcatatttcataaaattgagtttttataactttactactagcagtgtcttatgtctttaattttaaacattttgaatgaatcagtacataaaactaacgtatactaagagacatggtttttactataatgtgacagagctgtggtgacttgaaccttcatatgctctctgacttgaggggaatttagaaccttttgggcccatgtttcatagtggggactgtaagtctagctccttgtgtttcatagtgtgcttctttttttttaaaaaagatttattattattattattatacataatatacataagtacactgttgcttatttcagacataccaaaagagggcatcagatctcattacaggtggttgtgagccaccatgtggttgctgggatttgaactcaatacctttggaagagcagtcagtgctcatacccgctgagccatctcaccagcctcatattgtgcttcttgagtcaagactatctcctcagtcacttggtagtcctttctcccttttcttctctggccttgtacttttctgaactgcttttgtagccagtgtggatctgtgttgcctctttctagccttagatagctaagccctctgctctttcttcctttttgctttgccctctgcatgcagtaacttttcagtttccagaacatcgttaatgactaatcagaatgcctagtggcatgtaatggttggggatatgcccaccaggatgctaatgggagccgctgcgttggcaagtgagtgccatttccaagaggaaatgccatctccagttgtcagagcttcatccatgtgatggacagacacaaagtgtgcgtgctgtgtgtagaattcaggggccttgagcaaaaacaaggaagcccagggtattgcttcccattgagctctggcactctgagagctctgcttgtggacaactgttgagaggcccaagctcatgccgattgtgtgaatgcatttttgaattattcataagctatctcagtgtagccttgtgcatctgtaatcctagcactcaggagacagaagcagatgattgctgcaagtctgaggccggccagggttacagtacagagattgtctcaaatccaaaagcagttgtttaatatgtgtgtgtaaatataactggtgtttaaggattttttaaaacaatttcagtaaggtttcttcattttgttattaaacaatagaatggatagattgagaacacagagttaaagttaaatgggaagtaattgtttagtgagtttactttaatgatttgtgtttgtgtagtggaacatgtaccatagacacatgtgtagtggaacatgtaccatagacacatgtgtagtggaacatgtaccatagacacatgtgtagtggaacatgtaccatagacacatgtgtagtggaacatgtaccatagacacatgtgtagtggaacatgtaccatagacacatgtgtagtggaacatgtaccatagacacatgtgtagtggaacatgtaccatagacacatgtgtagtggaacatgtaccatagacacatgtgtagtggaacatgtaccatagacacatgtgtagtggaacatgtaccatagacacatgtgtagtggaacatgtaccatagacacatgtgtagtggaacatgtaccatagacacatgtgtagtggaacatgtaccatagacacatgtgtagtggaacatgtaccatagacacatgtgtagtggaacatgtaccatagacacatgtgtagtggaacatgtaccatagacacatgtgtagtggaacatgtaccatagatacatgtgtagtggaacatgtaccatagacacatgtggaggacagaggagacttgagagtgggctctctccttccgtcatctgggcctggggctgcagctcagagtgccagacttaggggcaggccctttgcctgctgaggcatctccctgcctgtgaagggtgagatgtagagctgtctgctcaggttttcaaggtagtgccgatggttatttcttttcttaccattttgtttctccaaataatgtctcagttgtctgagaaatcagtagagaaaaccccactctccagactagttggacatcagaagctggactccatgcaggcacagaagctggactccatgcaggcacagaagctggactccatgcaggcagtgggggagaagaaaactcaggaggtgaaagggagaaaatacgttcaaaataccattacaggaaattctcagagaattagcaaagaatgtttcttaaaacatagtaactataaagaactaaaacacctaggtgtagtggtgtgtgcctatacaccaacactgggaaattagacagggaggattgctgcttcaaagccattctgggcttatggactgagttctaggccagcctggactatatagtgagaccctggctcaggaactcagcagcaaagatatcacagcagactgtgcagaagccccaccctttgggtctttaccatttaactagagaaacaaagcaggacagggttatttttaatatgtagcctcagtgcattcttcctcccctactttgtgacagccctgtggggtcgggtggagcttgagggtctcaggtgccaaagcacctctgcaggtagagaatgaagttctttgtatcatgccattaaatgttgtctgagaaggcatccttcatccgtttccacactaatgtataatgaggcacgtttgcttttaattcttagtaacaggatgtaggtcattactccttttcagataaattcaactttatgttgattttggacatttggacacaatcatgttgtgtgtctctcaggctgggtttgtttgtctggagttgtcgcctcggggctttctctcattcattcctcaccctggggctgggtgcgagggaggtagggagtgggaaacacacttacctagccctgggtccctggcttctggagttgacctcttggcattatcctcagatgaatgagtctgcactgcaaagggcaagaaggctgaggggacctgtgcaggggccattctgtcttgggcttgctcccaaagaccgtggttcagcagagtgtgtatgacttagatgactgactgctggtaggaagcgggcttctctagaaatggagaggtttaaagatttgtctgggcgtctagaattctgcagtagtaaggtgagcaaataaaactctgtaagtatagtactaaatttacttgcagtatattctttcaatactttgttagtaaatattagaaatagaagtaaacttcataagtcatggatcaaaagctgccttcggcagagcagaggaggaggcggcagaggtgatagagccctgtgtggggaaaagaagtagggcaggtagatgtttataaaactgaagtattttgtctatttatgaatagtgcagattaagtttttactttggaaacccaaatcatattttcctttgtttccttcagtgctgagaattgaggcctggcaagtcctattatcactgagccacatctaagcccttttttaggttcttaaaaatattatagcaataatttgatttttggctactaaacaagttgttttttttttttttcattgtgaaacctttctctgatcttattttctatttttttaatgattgaattttttattgtgtttattggaaagttaaacctctactaaaactttgaaaaacttatttattataatttgccatatagtttgttcatcttgagctccctcaaaaggaatagttgatgaagtactgttcagtaagtcctttcatttgtattaaatggcaaaggctaagtgttgtgttacaaacagctatggctttcttcaccttctgtacctgaatagaatctggagcttgagaaataggacctggtgtttcctactctgaggaccgagcaaaaagaaaggtgtctgtcttggcttctgtagtgtgaggcaagcctgggtgatggtttttcccttactacaaatggaccattctggttgtgtctggctccagtgtcatgtatgcctctgctgagtagctccctagtggcttaggaaactttgttttcacctttattaatagaactgcaaaagtagaataaaataatcttgttactttgaagatgtgtctgtcataccatagtgtccttctctatgagactcggcttcctacaacaggacctttcatccccggtatgaatgccactgaaaccagacaggtgatgtccgtcacaagcagggatcagcatgctctgtagtcttcagtagtctgtgtgggcttgagctgatgatgtgaactccaggaggaggagagcgtggcctggagtcactgacttgtgatgctgctttgtgtctgtctcgctctgcctcttccctggtaactttctcagcaaagttttgaagaagagagtcaccatcaaagcctctgtgaatggtttagctatcctaagacttgagggcgtttagttgtagtgcctttgaaaaagccaattagtaaaacattttcaaatcaaaaattgaaactgatatgaatttaattagatatatataaacatattatacttctgtttttcacaataccaggaaaacttgaaaaaaaccgtggaagggaatttttaaagtaccttcttaaaagtttcctatatagtttaaaagtttaacttggataatttatttttccagacatcttattgtgatcattagtttattattattaatagcccacagactatacagttccatctaagtccctaaagctaatgtaagtgtgtatcctaagacatgctgtctgcacgtgggaaatcagaacagcacctgcgcggggccctgtgtgttaacctaatctatctcccggcttcttgccttgctgcttattctgacccggcctgtttgtaacttaaggtatacaaactgacctaaatttaattctggaggaaattcgtgtcttagaaacaccacatagaatggcagagttaatcacagggcaggtggtttccaggttctttatttcaaacatcaccgggctctgttacagtattatacactatagcatataaggccaggcctttggaaattgtctttttcagtccacattaaatgcaattttatataactaaacctaatgatctaatctgagtgttaagaactaacctcagctggatgtagtggcacctcttgtaatcccagcccttgggacctaagaggcaaggaggtagagttcaaggtcagctagttcaaggccacctgtgtgccacaggagaccttgtctcaaaaagggaggaaatgggtgagctaatctgctgttcattttaccattaactatcctggggtcttaacaagttacataatgcctttgtgttcttttttagaatccatacagacaacacatcctacatgtatagcctaacgattaattgaggcatagcacttagagcatttggaattctccataattgttagccactgctgttactactgcgttatttgttacagttcttattattgatgtagactgaactgttgtgagaccaaaagaggtatggccaggtgtagactaaaactatgccatggttctcagggtaaaccaaacactgtaatagttcatgctgacctgactgtgcatcagtggggtgggactagaagtgctccgccatagaactcttagctttggactaagttacaaaaaggatttatgtgcctgcttgtgtacatttcatggggtgcaggtcaggagatggctcagcaagcctgaattaaggtaattgctgtagccggggtctgcttgttgtaagtttgagcgttcaaaggttttatttggtgttgggtagaatactgttctcttttctgatgaacagtgcaacttgctttattttgtgatacagtcttcttaactttaatgttctctcctgttgcaagctgaaagtgtgttaagatagcttgtgcaacagtgacacacatgcaggatgaaaggggaaagctgttaggagtgagagttgctaagtgaggtaggcacagaagagaccttttcatttagaaaggaagggaagaagtcgtgtagccatatttccttaacattttgtcatttgaaacatacccgtgtcaggaagcctcagggtgaagtggggaaccatagggttgcactgcagtttctgatgttaaaggacacacacacacacacacacacacacacacacacacacccctatgttgactattgtttaaactatcttagaagctttatcaccaagaagagctttctctccctcttttcagaagactagcagtgagaccagtcagagtgagccaagtgtctccttgtcagagtccaagagtaaaagcagcctgcactcactggcccatgagacaagaattgcatctttcttaagcagcagcgctgtagatgccagagacagcagtgccctttgtccagatggggatgatgtggaaggagattctttctttgatgatcccattcctaaaccagaaaaaacctatggttggtgagtagactcctcttcagattacctgatcatgatttcaaaacaaagtttctaaatgctttcactttatattttaaaacgaataacctgctaattacaattattgaacccacaaatctgatgttgtgtcagtaatgcctagtatgtcataaaataattcaaggaatactgaagacaccaggcataagccattttcacgaggtgagcctgcatcaggaccctaccatgtgacaggagctgtttcgagtttcagttcatttcagggtgcaacagtgggttctgactcttgcctcggagttcaccctcagaggcagtcaagtagttagtaagactcatcttcagtggagatgctgtgtggtgggcagcagtggtgcagaggccttgtcagtttcagtagctgaccagagaaggctgtagttctcatggagtacacctgagccaacagctcagggagtgagctagccatgtggaatcaggtttgcaccactcccaagagaggaactagcaaataagaagggtctcatcagcccctcaggacatcaggaagggcagtgtggtcacaggagagggttgtgtgagttggatgtggagatggaggtcagtcacaagagtgtgacttctcgctaagattggaagcactgaagtcttgacccagcccacacagatcctcgctgctgagccaaggccatgcagtttccagagagcacactgtcgagctgtcaggactcttcaggagcaaaatgatggagtgatgggaagtaggtgctttagggacgttttaaggctaattgcaaaaggatttgcagatgagtacaagagaaccaggtgataaccagggtagctctccagggtctacacttgaatacttggaaggttaaaacccataaacagaggtggaaaaaaaaatgggaaaagctgggtcagatggcacagacgtgtggcctgagagtcccgagtgtgatgtgttaggatctagatgttggtgggcaggatgtacactggagagagcgagggagtcatcagtatatagggaatactgaagccagtacatagggagatcacaaaagtaggctgagcacacttgaggtcagtgaggagagcaggcagcataaaggagactaaggaaccatggcaggaaaggccggagacagcagctgcagtggcatctgacaatcacccactggggttagccatatggaggttagaggtgactttggctgacagttttattggactggaaatagggcagataaaagggttatagttgaccagaaaggaatgttggggaaggattaaaataacaagtcgtaaagggtacagaggatagaagtatgagaacttaggcagaatgtgggtctagatgtgtgcatacatacgtacgtgcatgtttgggtgtgcatgctagtgtaagaaaatgatacccagggcttagtataagggagcaaaagagttcctggagtgctgtttgactccagggaaagttgccagcaggatgaagagggtgtgcagtgtgggcctggatggcagtgcctggggagttaggagtgagctgaggggaaatcttggactaacacccgcaaggtcagaggctctgcccttcctgactgtgtgcatttgagaggtagagcttgtctgttggctgtgtactgtcttgtttctgggaagtggaggagggcttctgaagtgcagacttacgagagaaagcagacagctgtaaactcagggagctggagcgtcactcacaaacttaattcatggatcatggatccgtaaccacagcttgctctgcaggcttgctttatgctttgcagcctgtaaattctttttatttccagccagtgtacacaagtaaaacttctttacattgcttttttatgtttacagactaaaagactctagtgataaggtctgaaattgttatttacctgtcaattgcttcctgttaggagagctgaacctcggaagcaagtgggaggtctggcctcactgtctgacaagccccacttaaggagcggtctcagctccctggccggagccccatcgctaacagatccagagagtaagtacttgaagactctagataactgtagtgtccattgctgcgtgtgatcaaataccatgaccaaaaagaagctgaggaagaaggcgttattgcagctcctcatggagagaagagagggcagggactgaagcagaggccatggaggaaccctgcttactgctttgctccccatggactcagcttcagtctgatagaacctagctagacccacctgccaggggcagcactcactgccacatcattcatcaagaagtgccccagactcaccttttaggtcagtctcatggaagcagtttctaagttgattatttactcttcctagatgactagcttatgtcaggttgacagaaaacaaaaaactagccaatcacacgtgatgcaattactatgggattgggtgttttgttttcttttgttttacaaaatcctaattttaatcaattggacaatattttgttattttcatttcttaatgtagtcagtattcaccattttgtattctcctttgctatgcttttaaaatattttttagcaagatgcttttttaactgggttagattattggtaggtatgtgtttgtgcgtgtgtatgtgtgtgtctatatgtgtgtattgcagttacagcttgacttaaactttaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcaagtccaatgggcctctctttgcagtgatggccgactaggccatcttttgatacatatgcagctagagacaagagctccggggtactggttagttcatattgttgttccacctatagggttgcagttccctttagctccttgggtaatttctctagctcctccattgggggccgtgtgacccatccaatagctgactgtgatcatccacttctgtgtttgctaggccccggcatagtctcacaagagacagctatatctgggtcctttcagtgaaatcttgctagtgtatgcaatggtgtcagcatttggaagctgattatgggatggatccctgcatatggcaatcactagatttttacagatatgatacacattcaatactccaaatttagtcttgatttttctctggctgcaatatgcatggccttctgtgttttatcaacattgccacatgaacactagggaaggcaaataatgttctatggtactgcttgccacactgaaatttaataggttaggtatatccagtggagttttgccttataatcttggcaacttaggatgagtgttagatgctgtcccattccatgaatttttcatgaacctttaaaataacttaattttttaaagaagttatggcatagagtgatcattttaggcctcactctgctgtccggagcttgcatctgaagtgggctgtactttgagtgctgtgagtatgagatccatggagaggttgctagccccgtgtagggtagtagccagcctcctgcactgtgtcatccaatcttctcatcctatccctggggcaacgctgtgagtcttaaggatctgtgaacctcaccccatcacagtcagttcagtatttaactagcaggtcagctgaagtagatcacttggacttcacagtattgggtttcatgtatgtttttattttgataattgtgttctaacaaagaatagtaaaatctgatttctccatgcataaatcctttaccatttaccaaaaatagatacccagggaatgatagtacatgattctagcctgtgttgattataatttatgatttctgttctaggttttttcctgcgttattaggggtatagatgtcccacccaaaagagaagtggatgggcttagagaatgttgttctgagtgcctttcatgcaagtatttttccctgtccacaggtaaaaggggaagcaccgtcctgaaggatctgaaattggttggtgagaagattggatcacttgggctaggtaactagatttcagttttagtatgattgttgagatcgtcttccagaatagagtctacatagagacccttcctgctgctgttcagcaggaactggggaactggcatgtgttgagttcagccctacactaggggataactgtagcaacaagctggatagacctttgttttgtggtattcagaccatagttggggaatgcccctggcttgggctttcaggaaagaccttcagaagaggctgatctagtcagagctgtgtaacagaaggttttggttaagagtaggttaaaggatgtctctgggtgttgtgagtacaagatccagaccacagggagtcagtgtagtgcaaggctcatacttgtgagaggacagctgtgggctgctgtgttatttgagcagtgtaagtaagcagatttctgtgggagttagaggagcagtgtgcacagaaccgagttgtgggacacagggacctcaagagacccttacttctcactgacctgaaggaaatggtacagccggggcacttagccatctcctgccctctgcagactgatggggtgctaagttgctctgttgtgagagcattggactctggggggtttagaacactgcttctcgggcaggctcgggagaaagtaccatataccctgttcagtttataaccttgggtatgtcgtggggcagcgcagagtatctctcctatttctgggcaaccactctaaatagtgctcaggtgaaagaaggagagatttatgtgaagattccagctatgaccccagcttggggtaagcagtgcctttgtttcttctctgttaaatgggagcagtaacatgtaccccagtgtgaaagctgcacgggatgtccatgtgtatatgcacagcagcacacagcctggttcagggcctcgcctgctgctttcctttgtgtgtcggttgtttcctttgcagagtagatgttttctgagctgcctcacttttgttcctcacagtgccctagaggcctgctgggtaactgctgagtggccagtgctgcccttcctcggggtctcctggtccccgccttgctggctcttcttcctccccattgggtgtggtcacatctgcacggagctctttatcctaacacctcagagcatttttacccccttctttgatcatgacacctcaggtgctgctctgtcccctccttgtgacattgtgcttcaccttgtggtggttcacctggtgccaagcttttgctgggctccctctttgatcatccttgttcttttattgaagtgtggttccctgctctgctgaagacagctctgactgggctggtggagcaaatgaaatgacagtcactgcttcattttcccctccgctggctttgaagtacgtacaccttgagttgaaatggggtgttgtacagagcggcataggagggcggcatcagatcctatagaaataagtagttgtttagtgactgcagcactgtcatttgacctaggtttctgctgtaatgtggatgacaagactgcatatagctgtggtacctacacagttcaggtaggataatgtcagtgatgtgcagccctcccctaggaagaaactgcctttgttgttattcagagagacagatgctctgtcgtgcagatagtgtaagcttctggagtcttgacagtgtcacttagaaccttcagggtttcgtgtgttctccttggacatgatttaaatatcgtttcaggggaatggcatttcataggaacagttttaaaatacagcttttcaacacaatctattttactttaacaaataaaaagtaggcaaatgagctacccttgtggcacacaactttgatgttagcatttgggaggcagagacaggtagctctctgaatgtgaggctagccaggctacacaatgagaccgtattaggtagatgacccttctagagaataaagtccagcacagtgactacagttgggatagtattgtgaatacctgaagttttctaagacagtcgagcttgtttgtaccacaaaattgaagcaaaaatacattaacaaacttcactgtgctaatcattttccaagacaggctatacattacataagtatgcgtgatttatagtaaaggtagaaagaaacaaaactttacaaatggtatgtttctaaacgggcacttcttgtttacagcaagggtagtaaaccataaaatattctgtagagtagcaggtcagttttggcaagccccgtgaaatcatctctagcacatactctgtactgtttattattttatttttgttttaatatttttgggcttgaaagatggcctggtgcttaagagccctggctgctctttcagaggacctgggttcaattcccagcatttacgtggcagctcacaactgtccacatcataactctgattctaggggacctgacaccctctaaggcagcagccagacaacctgacacacctgcgagcaaaacacccagacacataaaataaagattcatttttaaaagttatacaaaatatcaaaaaaattatatttcaaaatataaaaattattctttcttacctcattggctaatattggtcagatgcaagaatgaatgcaaaagagacgagtgatagaccaggtgacggagataaaggcttagacagagttcaatagacagaaggaagaagtcagagtcactggctgtgggcagcatgtaccagcctctcatttagtatatgttctgttaaatgtactctttccagctcataacttcttgtgtgtggtagcacactagtcagtaaatatcttgagtttgaactaactacaaatgccagaaggcagataattcatttggctttccatggatccaaactgcagccccagctgccctgctatcctgacttggtttcctctatcatattgtcttaattcttggagacagagcagtcagctgtgaccattgtttgtctagtggcacttgcagaccagccaaagctgggttttgttatcagaacattttccctcttctcttcccatgaggactagacactgcctgctttctctcaagctcctgcagccccttaaacatttgtggctggagatagagacagcttccttactccagagaagaacaacctagaaatttgtccctgcctgttacttctcttcaggggctctagcaaagagtctctctcctcaccccatgccgtgcctttctcacctgccactggagccctcgccccccagttagctacagctttgctacctccccggctttctgttacctttaactttcaatcttgcctctcccacataccattctccttgtgagaaaagacatcaggtcactcttgtgttccgccagcccgtcttgctccacagtggttgttgtagacatggtcttggctgtgtctggcttcacttcccttcaggagcacatcctcctgggatctgtccccctccaccttagatttcagtgtacgctgcctccgagttctttctttcacccagcatgctacctttgctttgttgtacggtggaaagcctctctctctgtgttcattgctgtgctgtgggggagtctaagagtcaccccagggtgtgatagatgactaatcagcttctgtaagagagggctctgcccctctaggtcttggatcctcctctgatctggtcccatgttttagcagacccaggatagtataggcagcagctctgagcagttaactttccatccaggattttcctgccctacagcctcctctggcccctcagatacttcctgtgcacttcccagctgccattctttcccattggcagtggttgtcttgtttctccagcatctttccttggctgctctaaaaggcatcggaaaacaactagtttgcagttagttgtcactgagagctatagtttagctcctcagattgttgtgtatatgaggaagcttaaggtccttctgcattagtagcagctcctgtggtgactgcatttggaacctcttgtgcatcaaaccctatgaattcagaactttgtggtttgggcctggttgtgcttggacgtgatcataaaagggctcgaagcacccctttgggtgataggcccacatacacgcgctgttgcctcttcacactttctgattgtttttaaaatcttcagtgaactactgagttgaaggtcatggcagttggaaacaggatggctagagaagttgatggtaccttgctgctgtgtcactttttctgtttttgtggtgaagaggctagaggccagatccacgaacatgttgggaaagtgttctgctattaagctacccccagagccgtgcttcattaggttccaggggtgcatcatggggagtttccctatgattaagccaccttcctgaacctagaacacagacggggtattcactagttagcctatgatgcaaccacttgaacagcttttatatctgccttcattttatgtgctaaaactacaatccctgggctggcgaggcggctcagtgcttaagagtgttgctgctgcagagggctaggctcagtccacagcatccacatggtagctctgcctcctgccaggggctccaatactctctcctccttgggcaccagacacacacatggcacacatacatactatacatgcaggtagaatactcatgcatataaaataaataaatctgaaaaacagttagatactattgtggtacttatgttttcataaagtaatattcaaaaatatattgttttacaggaaacatgcttatttaaaataagtattttaaataatatttttaacatgttcctttttaaaaactgattgccaggcactggagaagatgaggactatgctgatgattttaataggtaagaaacaccttgaggtgaatatatgaatctttaaatactttctgaatacagatatggcaaaattacattgggtttatttggtgtttaattatctttttcatgttgattgaaagtacagaaagatagttactccaaaattatatgttggagtgacttcttcatctcacagtacagtacagatgagtatgtacgccgtgttggggctgggggttggaaaaaataaagaagtggctgagatgttgttagcctgtcactcaaaaccaaatcgctagcttatcctaaggcacatttttgtctttgggggtgggaatcatctgagtttgactttaagcaaaactgccttcttcaatatgacattacttaacattttgtttgaggtaactttcttgtatgaattgccttttaatgggaaaataatatttgttatagataggattagaaaattcaaatagcatgtctgggtattttgacacttttcttttgcttagagattcctgtttactactataatttattatactgtgttttagagatagcaatagcatatgacgagtggcatttgagagatcaggttttccctgtgattgcctctgcagcccttgtcagctttctcagatgttatatatgaagttgatgtttaatgttggttttgtatggtatttagagggttaagaatctctggaaagtttgagcaatagtagttgttcttcagagttctttgtcgttttcccctcttttaattagtgctagccatcgctcagaaaaaagtgagctaagtattggtgaagagattgaagaagacctttccatgggagtagaggacgggaacaccagtgataaagtaaggggccacagtctgggtgtgtctgtccacttaatgacttgtgaggcctaggaaatgtatatgactagtaaaatatggttgaaaatcacagaagttgatgacacttacatattccaagtctgaagcaaacctttaggggtctgtgagactcggctatcattagctggtacttgtgctctggcaggcctctctggacttgcttctgattaagagtggccacaagggatcaggactcgagtcagatgttgcctctcttagggtcacaggtgaggttctgtttcctgggaaaggtgggggtgggatggacttctggtcatctcaggctccccaaggcaggagagcaaaaggaaacagcctttacttgaggttaaagcccggaatccattgttaagatccacactggagcttttcacccaacagagataagctgcatcatctctgttgttcacaacttgggtgggtctgccctctcgtgtcatgagataactagaagatgcccgaggccttcaaaaaaggtgagtgtaggctgagttccgattatcacacaaggagaaggccttcaagaaagatggtattttagaagaagtaagcaaattttgagtttatgttatttttattgtattgagttcctttgttgtctggtttggattttttgagatagggtccttgaacttaatatgtagcaaaggcaagccccaaccttgaaccaagtctcttgcctccacctttcagaagctagttgtcttaggtaagcatgagtcttaacatctcagtttctttttgttggcgtggtttattttttccattgttcttgattgttttttcgttttttgttggtttgggaggtgttttttgttggttttgtttttttttttagattcagtctctgactgttctggaactcacagagatccgcctgccttttgtcttccaagtgctaccactatgcccagctttaccagtttcttttataaggtgaaaatgttagcacttaaatgacaccaggcgagagaccgtctgtaattactaccccaggatataagatgggttcttctctaacctttacaccagttaccatccagaagagtcaaacagtttgaagtcttatcaaagactatactgagcattattatttttgtgtagcatttgtaatggaattcatgttagaggtcagttgctaactcatcttcttggtgatatcacagatttcaaaacagaaacaagcaggcgagctgggcaatagagcacttaggtagcaagagtgaggcttgggtttgatccccagcagcagccagcagtaactgagaccgggaggcaagaggaagaaaaacaactactgtttttcagactttcacagcactcaacactttgaccaccatgatttagcactgtgcgggagagcctagccagagcggtcgggcgggagagagaataaacatccaaatagccaaggaagaaatcagattgacattgtttgcagcaagcttgatcagagtgcgtataaaatagaaaggagtccaccttaagctattggagctgactcacagactgagcatagagcagagtcacacaggagtcagcagcactgctgagcccagcagctcagtggagacagacgtctcctgtagatgatgacagatctttcttatttatagttccccacccaccccgctcttgtctctagtctaaaattggctttaatacagtagtcagttgtcttgcaaatacaatggattacgttaaggaattcattatttaataacaattagtaaaaagacatacagatccaaaggattctggattttgcaatgtgtgggcttttttgattttctttttaaacaatacaacaactttaaggttatgtacaatagttacaattttctttgtgacagaaagttgtataccaagactgctgtttggccataggagagaaggagggtggtttatttgaagagattctatttttaacatttcctatatccaaagaataacaaagaaagatgcaaagggccagatgagcagagttaagagagtgtcacaaagtttgcagaggagacttgttctcacctagtgtccctgttccccataagccatctctagtccagggctggcccccccaagcagactttaaaagataagttatatgtttataaatatatacgtttaaatctaacaatatacagattgattcagactttgcttatactgatttttctctttcttttggacaacaaagctcgatgacctcacacaagacctgactgtttcccagctcagtgatgttgctgactatctggaagatgttgcatagacaggaaaaggaagtattctgagcaacagaggacaaacgaatcactggctccattttcctcagtcactcttgctggaatgtccgctcctgctggtgccttgcatttcaaaaagactgcagatatttttaaaattaaacttttcggtttagtaaacatatacttcctatatgagccatttctaggagattcattcttctgaatttggtttaactgcatggctccaaggaaatcatctgtagtcaggctcactatagcaagggaaccgtgaaatatcagtgttaaagagcagaaagagggtcagtacagccatggtttgtgccactatgtgtctgtggctgctccagggagctcgcccacttagtgtgtatcaggcgggttagcccagagttggtgaactgacctggtaagtccatggtgctgaagagtatcagtacaaggtaaattgatctatgaactttattttgtatctccttccatttggaaggtttgttagaccattacggttatattcaagtactctgtactcttagttttgcttgttttaaactagaaatgattagtactcttaattcatagacttgtcaataacagttaccagttaaggtcacgttcttcctgctgtctgtaagcagctatagtcacagattacttcattacagtcgtaatttattatttttaaaaatgccttgaaacattcaataccaaaatgcatctgaaaccattaagcagtgcttttatttcagatctgtaagttgattatatttaaatccaaattggagtgaaatagtagtaatggcctaagaccatgcatattcagtttgacaaactttgtatactgtacataattgcattgtagttctttaaaaataaagccaatagtagaattcgtggcagatctaatgtacactgtttatgtagtactgcagcgatataggacagtggcgtctgtaatgttaaagtattgaaaatgtacagatagaaactcagcccagtgcatgagtcataccactaaaatttgggactgtgtgaaacttaggtgcattttatttcaattatgactattaaaagctacctttattattaaaagagaaattggacatcactgatccatggtgagtgagtgagtgagcaggtgctgtggtttgtatcagtgccactttccagtccatagtgcgtaagcacatcgacgtttatcaggcgtaagtgtagaggaagtgaaaatatagtaataaagactcgggctctctgacaacagagtctggctttttaaaacttaagtgaaactgagctataatcatcaagaggaagtaggacagaaacagaggtgtcctggaagccctgggtacttaagttcttagtctgccccatgcttgactcttcggatcagcactggatgaagatgctgtcgtcgtcttgttagataatgctgtgccctgtcatctcttcagtactgtggaagagcctggggctgctgagcatctggagtctggatcagatgtgtgccttaatatttggtaggcactccagttagtgaactggcctgcaagcatggcaggatgtggctttgtatatttgaggaagactttccaacagtcaaatgtgaaatttgagactttctattacccagtgactgaccttttggtaagtcttgagagggtggaaagaaaaagcaggcttcaactttgtggtcagcactacatgcaggtattgaatacttctaaaaatgtgaaattcaacagggaagaagtggtttctacagtattccttgcttagatattgttaacctgttaaaccttaatgtgtgaaatgaatgacaggttctgcatgtaataaatgtctctttgaacagtggattaaaatgttggccggcagtatcctccattttacagtgttggtttttttgttttgtttttgttttttaaatgctctactttgctttgtaaaatgccatttcattttgatgagcaaccatcttgcccctcgtgtactacagcagcagatggtgctcctgcctcccttgttcttcgtgccatctcaagcctctgttcactgtcctagaactgggtcctgcaggcccccaagcttctgcaccccacagcttctcaaggtgcttgtattcacctttccttgtctgaaatggcttcctcgcagccacacaagggtgattttcagtaaaaatgtcacactagactaagtactctctctccacttaggtttatccttgtgtttgatttctctgttgtgggagacatgaacaaatgtcattcacctagataggatacccaagaaaccattcaagtctggttcggtgaacttgtcggtttattggggctaattacagagcccacaccaactcatgtgactacttagatccagcatccctagagcatcctaaccaacagctcgtctgaggagtgtccttggcaactgtgcactgcatatctaaccttggagagggagtcactagacttgtagcttcctaaacttaccgagtttacaagtttctgttgcatttgtgcctgccttctccctgcaagagggagtgtttgaattggtgggaagtagtcacacagcactcattctggaatgatccatgtccctggatgttgtctgagcaccccaaaagagcaggaattgtgctaaaatctaatttaataagagcatttggaccctagtataaacttaaaaatgggttttgcaagtactgcagaatgcagggactgtttagtggccaagcagcgcctcctaagctcagggctacattttgggatagtgtccctgccagcctggagtcttcagatggggtcgttaggtgcaggtttgattctggaggttgacagctcctcaggctgaaggccaagtggacatttcccaaacatggagagctcctcatagccctggtgtcctcgttgacataaaggagcagctgtcctggagaggtgtgcagtgccagccctgagtactggactaggaccatggtgccctgcctgtgcacattaacaggccatgctgccagcccctgttgtagacaaagccttagtggggagatggagtccagaggatgaagtcacacccgtcaagctagttagatttgagttgacgacttctacctaaaacacatggctgtgaacaaaaaatgattgattttaattttccccttattttcatcttttgcatatggatactttgcctgcttatatatctatactaaatgtatgtagtgcccatagaagccagaaggtggcattggatcctctgggactagaattaaaggtgctgacgtgatgtaccatcatgtagatgcagagactttaaccaggtctcctggaagagctctaactgctgagccatcttgccagccctgtggtttgggtttgttgtgttggttggttggtttgtttttcccccttttacatggtttcctgatgtgttacttggggagaattcaatcagtacacgccagtcctttttttttttttaatttaaaaattttgattaaataaaaaggaaaaaataagaaacaattgaaaaaactatatacctacatggactttgaaaaagagcaggcagtttcctggcagagaaaatggcattaagataatactttttgacctggctactatgtgcagtgttagctgctgtgatctgtaacaggacacacatagccacagccaatggcctgtgtcacaatcatctgagctgatttaactctgaaagtacattggacatttccccaaagttggaaattcagtattcattggatcgagctaaagttcccaaattatatatcaatctgctctgtcttcattcacctgaaatgaataaatacatgctggaaaaattataaaatcactcaccctgtcaccattaggatttatttatttatttgtaatcttgactccagggttagtaattggaagttactttattaaaacaggcatctcaaaaaaagtaacttgtttaaaaattgcctcatttgcctcactgtccaatttaagaaggaaaaacaatgttgacattaatcccacattgggttaaaagtacacgccagtccagtcttaagtgcttggagctgcaagcccagaccactgtgcctgggtctcaagtgaatttgaattctaaatccaaattgggctatatattcagggctggaaggtttggactaacaagatgtatcacaaccatactcatgagcttacaggttgaattcaaagaattctatttacaaaaaggccaaacgtagaatagttgggaaacttggccaaaggccctcctataactgaggtcagcactaaggtggtcacacagaaaattccggctgggtgggaaacagatgtccctgggtaggatcctgcagaggaggtgtggttcccaggaagatggtttgtggatggagcttagatccgtaagaccattttttaaaccttaaaaagtcttgctaccagaagaacgtgggactccgggccagtgaggttgagcagtctcaccatctaaagttatactgtaatcctgcagggtagattctacttgcagaccaaggttaccttctaaggttcccagatagcttctagaaggttgtgctgtccaaatctgcctgcttgcctgcacgcctgcacagcagctgtatggattaaggtttgtttcctgcaggcctgctccccttcctgagaaacaggaaccagaatgaggaaggtcctatagctgcctgagtccatgctggcatgcggatggtgggtagacaaagacacccaagttgattttagcttgcagtgtctcagctgggagcatggttgtctcatacctggcttcaaacagcatacccgtctcactccgtattcttgctgttttaaccccatcttcctccacccccagcctctgttcccactgcaacatgcaggcggcttgcaatgtcatcatgggcccttttccttctgctcactctgaggtttctaaaatgagagagatgcctgagatgacgatcactggcaagtggtacttccacaatacctctccactctcttctcctcccctcctgtgtggtccgaggccttagtctttctgacccaggttcagagctttgacaggacagtcacttgtctctccatccagctgcgaggttcctggactgtgcttgctgctgaggtactacggctttccgggttggctccactactgtattttacccacaggaccctggcctccccatcttacgtacatttcggcattgccagtcttcccccacttcaaggctcaggttagaaccagttttctgccactgagtgtgccagattctaatggcccctaggtgtggtctgtgaagcacagaaccatgtcaccttcaggtgggaaggcagtcatcagcctccattggaagctctctgtgaaccctgaagacctagaactcctgcccattccagttcccttcaggccttgatcctattctatatcctgtgcctgaaactcagcttcctggctagctcagtctgtgatggagtgacatggtacagacaggtgtcacttgccacactgtgaagaagcttggctgagaggtgatggcaggctgcgcatggagacaagcagggaaaaagcaaacatgtaccaggaagctgcttttggattgtgtggcctgtgattgacagtgctccttggatcccatggaataaacagtgggccactccacaggggaaatgtccctaggaaggagcgtgggtgtcagcagagatgcaggaagtgaagtgacagagactgaatatagtagtagagagaatctgtgcgcatggccctgtgaaggagtggtgttgagcacatcgttcagtaccagcattcccagtttccagctgtcagaagcagctaaaacctgagattcacagtgtagaccaggctagcctcaggtttatggcccacaaggaaatgctgggattacagacatttgtttatttatttgtttgtttgtttgttttggttttttgagacagcatttctctgtatagccctggctgtcctggaactcactttgcagaccaggctggcctcgaactcagaaatccacctgcctctgcctcccgagtgctgggattaaaggagtgtgccaccatgcccggtttggattacagactttcgccaccctgcctagctgattgcttatgtccatcttgtctggtggcggtatagccattcttgtcctagtgcctgttggcatgggatgtcatttcctttcatccttttaattcaaaggatatcagagacagctatgtctttggattttatgctgtctcccgtagatgccgtgtggctgggttagtttgcttgttgtttttctttattttggatggaatgtttataattgaatatgtgtgccatgttaggtttttttaataaggctaaggctcagatccggttctttgtctcagaccatttttgtttcatatggcagatattttcatactttccaatgtaattccttaaatgttttctttatcttttaaaatgtattttcatttatctttctcagtgactggtccaggtcctacagcctacatgtcagtttatcataattttcctctaacaggatgcagggccagtcttcagtgcctctgcgctttgccttcatgttgtccctagtatacctgctccatgtataactagcccggcatctgctgggactcctgctttctataactgtattttttttaagtgcccaagattaagaagtgaaccagggaagctcctagcgacagagtgataaggaaggcagatcagatgaagttcagagggcgtcctcagctgcctccacagggatctgagcccccaggttgcacctctggagaatgagaccttcctaattttggtagccatccatgcctctgggaggatatctgtcccttgctcagtgtctgtctcccctctttccagaacacccctcccccatgacatgcatcgcgtcacttgctgtgttttctcataagtggcccgagttcagttagatgtcaagtacttagggaggaagactttcatagctgtccgtgagcgtttaaggaaccatgtgccctaccccatgacgggatgcagggtctgaggatgctgtggtgtgttctacatggcactacagtggcaggagggagtgggctcctggagatggtctccaccctccacctctcggggcgttagcccactgatggccagtggcttctgaaatggaactctttgaaagcttgaagagtgaggtctcctttgtgctccttgtctatctatggaggaaagtttacataatgaagatgagaatacacaaacggtctcaccgatcctcatgttaccttaaaacactgcttcccgtgttatctttgtgcatgcatgctcatgtgtgagggccagtatgtgcatgccagggcaggagtgtggcggtcagaggccatcctccaatgctgatcttcaccttctatcttacttgacacagtctctcgttcactgttgtgtgacccaccctcgagtttctgtgtattctgtcttcacttcataggaacactgggactgcaaatggacatggcgatgcccagctctgcatggactccagggatctgaactcagtccctcacacgcactttatccactgagccatccctccacctcccaaaacacattcctgaaagtcaaaacacgttccttagaaagtaatacagttatgctaaactttaaactgtttatgctaaacataaacagagagaggggaggggtgcatgtaccatggtgaacttgtggaagtcagaactctccctcctcctactacaggtcctgagtatcaaaatcatggcttatacagaaagcaccttatccactgagccatccctccagccctattttttctctttttttcaaggtcaaaagattcacagaactatagaaactacaaactgggtgaattttctttattgattcaacagcctatttttttaattaatgtttttatagaatatatcctgatcagtttccctgccctcatctccacgcatatcctccccaaccaccaccaaaccacccaactccacaccttctctctttctctctagaaaacaggcagaataaataaataaaaatttaaaacagcatgtgaaacacagagacactcaaacccacaaaagcacaacctacaagcttatgaagccataacatgcaagcaaaatatcaataaggttaagaaacaaaaaaccaaaccaaaccccatggcgcctgcccttaaatgtggtttatatacctattgagtctccattggagaaaactaattttttttctttgcaagcagtggtcagttggagacagttgcttagggatggatctcttgtccactttcccatctcagcactggaactctgcctggcttggaccacgcaggccgtgtgcgtgttgtcttggtctctgagtttctgtgtgtcagttctgctgtgtctgaagctttttcttggtgtcttccatcccctctggtccttacaatctttctgcctcctcttctgagaggtccacacatcctgaagggggggggggctggtaaagacattctatttaggactgggtgctccaaggcccctcatttctctgcctattgcccaggtatggatgtctgtatagctcccagctcctgcaggagaaagcttcactggggttggctcaatggaacatgatctataggcacagcagaatgtcatcaagagtcatcatgcctctgcaagctcctttagtagaacaatcggatttggttttcccctaggtccatggcctatctagtctcagtttctggccactcaagcaccagacacgggttccatctcctagaatgggccttagatcccagttagaaagtgggtggttactcccacaatgtctgtgaccctgttaactagcacatcttgcaagcaggtcaccactgtagatcaaagggtttgtagttgggttggtgtttagctttctcctctggtagcttacagagaacctttgaacactaggcagtagtggtgaaggctgtagttaggcacgagctagacctctctgtgttcaatgagaatatcatcttcagcaacagggtctcagcatcagtttttggagagcagccaatggccttgcaatagtctaagttgtttgggggaattcccttctttattcacacacacacacacacacacacacacacacacacacacacacacacacatttagtccttccttttcagtctccaccctgtgtctaactgtatattctatctctccttccttgggaaatcctcccctcacccctagtccctttctctatccttaatcatctctttggttatatggattgaagtatgcctactaaaggattaaaggctaacatccacccggaagagaacacataccatatttgtcttcgaggtccttgttatctcgctcagtatggtttttgtgccttcatccatttagctgtgaatttcatgatttataacagctgagtaatatcccattgtgtaaacgaaccacattttcattgcatatcatctataaatgaacatctaggctgtttctggctattatgagtagagtggcaatgaacatggctgcacaaatgtcctgtagtaggatgtagagccctttgattgcttgcccaagagctgtatgtcaggctcttgaggtagagctattcccagctttctgaggaactcccacacctatttccagatgcatgctctcctttcccacatccccagtaccatgagctatcatttgttttattgatcttggccactgggactggtcattctgtaagatgaaagcgcagagtagttttgatttgcatttccctgctgactacaatgctgaacatctctttaagtgcttctcaggcatttgtgcttcatatcttgagagctttgtttttagttctttacttttaaaatttggttatttgttttcttgatagccatgtgtttttgtttagttctttatatattttagctattaacccctctatcagatatgtaattagtaaagatcttttcctattatgtagcctgctgctttgtccaaatgttggtgtccttggctagccagaagcctttaagtttcacgaggtcccttttattcagtgttgtgctagcagaatcctattcagaaagtctttcttgtgccagtgatttcaagactaacccctccttttctttatcacattcagtgtatctgcctccaacctctttttaagctttaaaaattaatcaaggtagatgttaaggtgggcctgggctcaaataatcagtttatatgatagcaataaaagtacatgtcctggaggacgcagcaaacagacaacaaatgaatgctgatacggggagattaggatggggcactctctgcagtcagacagtgtctggtcctacagtgctgctcctggtagggtgagagcctaccagctgtatgtgccctagctcttagggtacctgaagactggagccagaaaagtggtattattcctccctgaggcataagagaaaacttttccctaactgactgcttggactcctaggacttctgaaatgaccagttactgccaggcaggtcaactctcaggcctcaactgggacagtgaatggcaggcagctgggacaagtggcagggcagctgggatggatgggcagcaggcagctggaacaggtggcaggcagctgggacaggtggcagggcagctgggatagacagcaggcagctgggacaggtggcaggcagctgggacaggtggcagggcagctgggatagacagcaggcagctgggacaggtggcaggcagctgggacaagtggcagggcagctgggat

SEQ ID NO: 1922 - DNA, 2017 bp, Mus musculus
tgcgcgctcgcgggccgggtggcttccgcggcggccgttggccgttagcgcggcttgggtggttgtcttggagaagcaagatggcggcgactaccgccgcggtggtggccgaggaagacacggagctgcgcgacctgctggtgcagacgctggagaacagcggcgtgctgaaccgcatcaaggctgaactcagagcggctgtgtttttagcactagaagaacaagaaaaagtagagaacaaaactccattggtcaatgagaacttgaaaaagtttttaaacacaaaagatggtcgtttagtggctagtctcgtcgcagaatttcttcagttttttaatcttgacttcaccttggctgttttccatcctgaaactagcacaattcaaggtcttgaaggtcgagagaacttggcccaggatttaggcatcattgaagcagaaggtactgtgggtggacccttattattagaagtgattagacgctgtcaacagaaagaaaaaggaccggccagtgtggaaggtgcactggatctatccgatggacatcctccatcaaagtcacctgaaggaaaatcaagtgcaaactccaccccaagtaagaagactagcagtgagaccagtcagagtgagccaagtgtctccttgtcagagtccaagagtaaaagcagcctgcactcactggcccatgagacaagaattgcatctttcttaagcagcagcgctgtagatgccagagacagcagtgccctttgtccagatggggatgatgtggaaggagattctttctttgatgatcccattcctaaaccagaaaaaacctatggttggagagctgaacctcggaagcaagtgggaggtctggcctcactgtctgacaagccccacttaaggagcggtctcagctccctggccggagccccatcgctaacagatccagagagtaaaaggggaagcaccgtcctgaaggatctgaaattggttggtgagaagattggatcacttgggctaggcactggagaagatgaggactatgctgatgattttaatagtgctagccatcgctcagaaaaaagtgagctaagtattggtgaagagattgaagaagacctttccatgggagtagaggacgggaacaccagtgataaactcagtgatgttgctgactatctggaagatgttgcatagacaggaaaaggaagtattctgagcaacagaggacaaacgaatcactggctccattttcctcagtcactcttgctggaatgtccgctcctgctggtgccttgcatttcaaaaagactgcagatatttttaaaattaaacttttcggtttagtaaacatatacttcctatatgagccatttctaggagattcattcttctgaatttggtttaactgcatggctccaaggaaatcatctgtagtcaggctcactatagcaagggaaccgtgaaatatcagtgttaaagagcagaaagagggtcagtacagccatggtttgtgccactatgtgtctgtggctgctccagggagctcgcccacttagtgtgtatcaggcgggttagcccagagttggtgaactgacctggtaagtccatggtgctgaagagtatcagtacaaggtaaattgatctatgaactttattttgtatctccttccatttggaaggtttgttagaccattacggttatattcaagtactctgtactcttagttttgcttgttttaaactagaaatgattagtactcttaattcatagacttgtcaataacagttaccagttaaggtcacgttcttcctgctgtctgtaagcagctatagtcacagattacttcattacagtcgtaatttattatttttaaaaatgccttgaaacattcaataccaaaatgcatctgaaaccattaagcagtgcttttatttcagatctgtaagttgattatatttaaatccaaattggagtgaaatagtagtaatggcctaagaccatgcatattcagtttgacaaactttgt

SEQ ID NO: 1923 - protein, 393 aa, Mus musculus
RARGPGGFRGGRWPLARLGWLSWRSKMAATTAAVVAEEDTELRDLLVQTLENSGVLNRIKAELRAAVFLALEEQEKVENKTPLVNENLKKFLNTKDGRLVASLVAEFLQFFNLDFTLAVFHPETSTIQGLEGRENLAQDLGIIEAEGTVGGPLLLEVIRRCQQKEKGPASVEGALDLSDGHPPSKSPEGKSSANSTPSKKTSSETSQSEPSVSLSESKSKSSLHSLAHETRIASFLSSSAVDARDSSALCPDGDDVEGDSFFDDPIPKPEKTYGWRAEPRKQVGGLASLSDKPHLRSGLSSLAGAPSLTDPESKRGSTVLKDLKLVGEKIGSLGLGTGEDEDYADDFNSASHRSEKSELSIGEEIEEDLSMGVEDGNTSDKLSDVADYLEDVA

SEQ ID NO: 1924 - DNA, 61197 bp, Homo sapiens
  misc_feature (1)...(61197): n = A,T,C or G
ataggccattgagaaccttatttattcaccactacctaaactatcctgatctttatgggaacagaatagatgacttcaatgagaaggcattaatattactgagtgcagactgaaagactatcttgatgattaacgacacattttcattttttttttttttttgagatggagtctcattcttattgcccaggctgcagtgcggtggcgtgatcttggctcactgcaacctccgtctcccaggtttcaagtgattctcctgcctcagcctcctgagtagttgggattataggcacgcaccaccactcccagctatttttttgtatttttagtaaagatggggtttcaccatgatggtcaggctggtctggaactcctgacgtcgtgatccacccacctcagcctcccaaagtgctgggattacaggcatgagccaccatgcccggccttcaatttttaacatttaagaaaaagtgacattccaagaatatgcaagtggaaagccagaaagcatttcccctatcctatcctgagtttattctcataagaatctagttgtttaaaaactaagttactggaacatatttgtgattaattttatgtgtcaacttgactgggccatagagtgcccagatacttgctgaaacattgtcctgggtgtgtgtatgagggtgttttgggatgagattaacatttaaatggatagcctgagtaaagcaaattgacctccctaacatatgagtgagtctcatccaatcagttagaggcctgaataaaacaaaaaaactgatcctccctgagtaagaaagaatctctcctgccttctgatcttttgactgggacatcagcttgtttcttgccttcagactcagattgaaacactgactcttcctggatttcaagcctgctagcctctggacaggaactatgccatcagttctcctgggtctccagcttgctggctcatcctgtagacttgccagcctcagtgatcttgtgagtcagttccttatatgaatctccttatatatatacccgtatacatacatatatcgtattggttctgtttctttggtaaaccctaatacaatatttatatttctttgttttttttttagacagggtctcactctatctcccaggtgggagtgcagtggcgagatcatggctcactgcagcctcaacctcccaggctcaagtgatcctcccacctcagcctcctgagtaactgggactacaggccacgccatcacgcttggctaatttttgtattttgtgtagagaggggttttgccatgttacccaggctggttttgaactcctgagttcaagcaatctgcccacctcaccctcccgaagtgctgggattacaggtgtgagccaccgccccggccaatatttatatttctcagacgcatcctcttttttccatgttcacttgtgcaattttagttgatgtccttcttctttcctggactattggaataatttccttgttccagtgtcagtacatccaattcacccatcccctccttgcttctggagtgctctttctaaatacaaataggctaatgacatactgcttttaaacttgtttagcacgctatttcacaccttcaagatgaaagtcaaattcattagattggtggataaagtccttcccaatccagtcatttcttcatctccagccacgccacactacctgccacttcttgcacagagcaatctgccttagcctcttggtcttgcactcttgtatgttcggttacttctgcctggaatgcctctttcttattcaatcaggaaactctcataacaggtgtgtgtgtctgacattaagtgtcacctccttagcatacatcttggatttacctccctgaaatccaggggtgaaggagtcgggggtctttttctattcattgccttcaactgagcatacttgcagggtgtgttaattccttggcactttaggtcttcccaaaatgcaggcagagcaggctctggtggacgaagatagctgataatgcaaataacttcaggtgccggcagttggaagttggcccaatgtgcagaatgttctgttcaggggcatgtgggcttggcctaacagatctgttatagccctaatatcatactgttgttggtttttcaatcaatgcacaaagttggaaagatatagagctgaccctgaacaacaggggtctgaaccagtgtgggtctacttatatgcaaatttttttcaatatatacagttggccctccatatcagtgggttccacaactgaaaccaagaataggtggaaaatacagtattcttgggatgccaatggtcatatccacaggttccacagggccaactgtgggatttgagtatatgtggattttggtgtatacgagaggtcctggaaccaatcccccatggataccaagggatgtctgtaattttatttacaaaaagaatgcaaattcttgacagactaaaaatgagaatgaaactaacaaaattaggagggggaggagaaaagacgagaaagtaagaatgtaccaattcctcacctctcctagtagggagccaatatacagtgtgtaaaatttataaataatgatttaggtaaacaacctaaagtcatgaaagcttctagcaaaactaaaagtaatacaattttttaaattaggagttaagaataagtttttgtccctttgaaggattttcagctggtgagtcaagatgtatatgtacagtatttaaggttataatgaaaagaaccagaagaactaaaaccagaaattgttaattgcagttgggtctaggatatggtaacagataaggtaggtgggtaggtaggtagagtagcagggagacccttacttttcttttaatatgttccccccttttgtttggatttttaacgattattatgcattatttccataacaaacaaatggaaataaagtgtagcttaactacaaaaagtaacttttagaacacccttaacaaatattttgtaggagtcaaatgaggtaggatctatacggtatgcatgaacatcaaaaaatgatcaggacttcttaagtcaagttagtaaactaaaagataataggcataggatccaaattacagagagggaggaagtatgtgtgtgtatgtaacatatctatgtacagttgacccttaagcaacatgaggttaggggcacagaccctcacagtcaaaattccatcccccaaaactgtactaacagcctactgttgatcggaagtcttaccaacaacataaacaattaacactttttttttttgagatggagtcttgctctgtcacccaggcaggagtgcagtggtgcaatctcggctcactgcaacctccgcctcctgggttcaagagattctcctgcctcagcctcccgagtaggtgcgattacaggcacgcaccatcatgtctggctaatttttatctttttaatagagacggggtttcgccatgttggccaggctggtctcaaacccctggtctcaagtgatccgtctgcctcagcctcccaaagtgttgggattacagatgtgagccaccgcactcgacaattttgtatgttacatatgttatatactgtattcttataataaagtaagctaaagaaaacgttttaaggaaatcatgaggagaaaatatatttactctccattaagtgtaagtgaatcatcataaatgtctccgtcctcataattttcaccttgataggctgagaagcgggggttggctttgctgtctcaggggtggcagaagtagaagaggtggaagaggaggcaggagagggaggcacaataagtgtaatctgatggagatacatcataatttgtctgacttttttgcttttccatttctctaaacatgtttccatttagcaccaattcttcttccaccatttgctttagattcagtgcctgtttcatagaaaagtccatgttataagagaagtcaaaagccatattgaataagtggaacccttctgccagattgtctaatgtcaatttgttttctggcactgcttcgtcttcttcctcatcgtctggcactgggttcagaaggagtcatctccatcaagtggtcttctgttaattcctctggtgtggtgtctcttagctcttgaatttctccaagatttgtatcttgaaaccttttttgccatatctgcaatctctttcatgatttccttgattggctctgtcataaatcctgtgaagtgatgcacaacatctggagtttcctccagcaggaatttgtttgggcttgatggcttttcatggttttttctgaaacaacaatggcatcttcaatggtgtaatcctttcagacgttcatgatattctctcaattggggttctcttccacagagtactgtgtgtaatgatccttaaagtccttatgactcccttatctagaggttgaattagaggtgttgtgtttaggcgcatgtagaccatttcaatgtgtttgtattgaactcatggggttctgggtggccaggggcattgtccaatatcaaaagaacattaaaggcaatcccttactggcaaggtacttcccgactttaaaaacaaagcatttatataactgatccagaaaaagagttgctgctcaagccatcttgctgtacaaccaaaagagtggcaggcagtgtttcttttcccttcaaggctcaattttatagataagggcagtcctgatcatacatctggctgcatttgcacaaaacagtacagttagcccatcccttcctgccttggatcctgatgttcacttctcttcctaataaatatcctctgtggcactattttcccccagaatagggcattttcgtttgccttaaaaacctgttcaggcagatatcttttctcctcagtgattttctctattttttttatttttattatttatttattttttttttgagagagtctcattctgtctcccaggctggagtgcagtggtgcaatctcactgtaacctctgcctcctgggttcaagcgattctcatgccttagcctcctcagtagctgggattacagatgtgcaccaccacacctggctaaattttgtatttttagaagagacagggttttgccatgttggccaggctggtctcgaactcctggcttcaagcaatccacccacctcagccttccaaagtgctgggattacaggcatgagccacaaagcctggccttttgtcctcaataatttccttaatggtgtctgggaactcgtcggctgcatctgggtcagcagaagctgcttctcctgttatcttgacattttttgaaagccaaaccactttttaaaattatcataccatccttcatcttccttttgctttgtcagataatgacttcactttttcttgaatattagattatataggtatgcctttctcatagcaatcctgcacccacaaaaagctgcgtttgcaatatgagataaaaaggtatttcccaaaaagtgcaaggttttcatgcttggtgtagctgcagcgatggcttcataaacttccttttgtttttataccacagtccttatactggattcatttatcttaaaatggcaggcgaccttagctgcagacctcaatctacaatacacagcaagcaattccgctttttctgtaatgtcattaacttttctctgattcttgggagcatttccagcaccactagcggcacttcgtaatggtcccatggtgttacgcaaggtttacagtactgcagtgaacacaacgagaaatatgtgagaacctcaagagcttaccttttactgtgatatgcaatgtactggagagatcaactgctcactcagagatgattatgttacttggaatttttagccaataccagcaacactgacgctcactgcaatagcaacaggaggtggctacaaaatcattacagtagtactctatgtactacagtgaatttgatgcagttattatttaatattgcatctttacaactgtttacacctctcttgaacctaatgggtgccatgtaactgtctgtttgtatgtgtaagttttgataaattttaactttttataacaggcttgtatatattttatgatagtaaataataaaatggcctagtatctacatatattttatgcattcatgacatatctagctttttcttttctttttttttccatatttcttggctaagcgattcatctgtgaggtttttcacaaaattgttgccatcgccaaaaatattccatttactgaaaaaaatccacatataagtgtactcacgcagttcaaactaatgttgttcaagagtcaactgtataaaaggtattaatatgtctggaaagagatatgtttccaatttaacagacactaccaatgaggagaagagttgggctaggcaggaaacttcaaattttccttttttactttatatattctattgtatctcaacttataacctgtggaccacgtttattagaagaaaatgcagattcctgaaacttcctgcagaccccatgagtgacaatctcagggagatggagttccagagtctgctttttttcatagatgtttctttgtcattcctgtgtatatctgagtttcagtagcactgctaatcaattgtttggggttctctctccttcaccagcatgttcttgcaaaactaaccaaacacatacaaagcgcaaacagtacaatagtgcactgcaccttcatgacccttacctgttccagcctcttcctacctcttccacatgtgatatgtgtgtacatacccacagacagaaacacagagacatgtttggaagccagtgtggatgccctgtgatctgtgtgtacacatgacaagtgcatacacacgcacataaaggaacccagagacgtgtttggaagccagtgtggacaccctgtgatctgtgcgtacacatttgacacctgcgtacacactcacagacagaaacacagagatgtgtttggaagccagcgtggatgccctgtgatctctgcatacacgtgacacatgcatgcacaggcccatacaggagcagagagacacatttggaagccgatgtacgccctgtgatctgtgcgtacacgtgacacatgcgtacacacccactgacaagaacacagagacgtgtttggaagccagtgtggacgccctgtaatctgtgtgtacacacgtgacacatgcgtgcacacccactgacaagaacagagacccatttggaagccagtgtgggtgcccctgtgatctgatctgtgtgtacacatgtgacacgtgcatccacacccactgacaagcacacaagagacacatttgaaagccagtgtggatgccttgtgatctgtgtgtacacatgtgacatgggcatatgcacctacagacagaaacgcagagatgcatttggaagtcactgtggataccttgtcatctgtgtgtacacatgagacacttgcatacacacccacatacaggaacacagagacacgtttggaagccagtgtggatgtcctgtgatctgtgtgcacacgttacacgtgtacacaaccactgacaagaacatggagacacatttggaagctagtgtggacgccctgtaatctgtgcatacacatgtgatacgtgtgtgcacacccactgacaagaacatggagacccatttggaaggcagtgtggatgccctgtgatctgtgtgcacacatgtgacacgtgcatgcacatccacagacagaaacacagagacacgtttggaaggcagtgtggatgccctgtgatctgtgtgtatacgtgacacatgcatgcaaacccactgacaagaacacatagatgcatttggaagccagtgtggacgccatgtgatctgtgcccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatttggaagccagtgtggacaccctgtgatctgtgcgtacacatgtgacacgtgcatgcacacccacagacaggaacacagagacacatttggaagccagtgtggacgccctgtgatctgtgcccacacacatcacacgtgcatacacacccacagacaggaacacagagacacatttggaagccagtgtggatgccctgtgatctgtgtgtacacgtgacacgtgcgtacacacccacatacaggaacacagccacatttggaagccagtgcagacgccctgtgatctgtgtgtacacatgtgacacgtgcgtgcacactcacagacaggaacacagagacgcatttggaagccagtgtggacatcctgtggtctgcgcgtacacatgtgacaggtacgtgcacgcccacatacaggaacacacagaggcctttggaagccagcatgggcagacaggccctatcccaaagcggccggcaggcgtctcctaagaatggttctcggacacacctctgaaaggaaaatacaactcggcaccgcagttgactcggccaaaggaaaaaaacttaagctgaaagctgaggcctgcccgaaggagcctttcctgtggcgcctgagccgagggcttcagggagagggccgcgcatcgcagcgcagctgcccgtcttcccgtggcttccctacggccgcggctcccgctgctcctttccgccggccacgcgggtcgcacgaccttcccctcccgcccaccctgaggcgctgaagccctcgacgccggcctcgggaaaggcgcggccaccgcccgtttcggattcccgtttccttcctccaggcgcgtccttcaccgtggccaaatcagcctctcaactgctggagcccggcctcggacacttctcggcttacgccgccatacagtggcgcaccccgaaaccccggaaccgacagctcggctggccttgcgcacccacactctccaaggcagggctcggtccgggggctggttttgccaaggcgaggggcgaggggcagcccaggcggccggatggataccaagagggcgcgtcagctccggcgggacggggcttccaggacccgggaggggtccaggactccccgccggcgcctggctgtcggcggagggccgcggggcaggagggagtggagactgcggccccagttcgggcagcgcggagcccacccaacgccctcctcggccctcggctcttcctggggccatcccgcccctgcacctcggcctggcacctttccggttagcctcggaggccgtggccgagcagggtgcgttcgcctggctggggggcctcagaacgttatttccgggtgacaacctgcagggccttccgcccctcgcgacctctcgggagtcccttccccggcgcccccccggggctgcaggggctgcaggttcggtctcggggcctccttaccgcagtccgcccggctttaggctagtgggctttaactacgtcgataatatgactccggcgatcttgtgcggcgatgggatgcggccgtgggcggtggagtccaggcggagtccgctctccacacgcgagggcgcctcctcctcaccgctcgccggcttcaaagctcgcgcctcaggcgacggcagccaacgggttgccggctggaggccccgccgacgccccgccccttgcgtgcccacccgcgccccgcagccccgcccccagcgccgaccctaagtttcggcgctcagtggtccggcgctccccaaggctcggtgtccagcgtcaaccccgaggtctctatgccccgcctcccgacgccagggggcagggccagcgcgctgcgcgtcggggcggggctttggctgcgtcggccgcgtagcccgcgcgcggagcgtaccctgctgcggccgttggccgttagcgcggcttcggcggttgtcttggagaagcaagatggcggcgacggcggccgcagtggtggccgaggaggacacggagctgcgggacctgctggtgcagacgctggagaacagcggggtcctgaaccgcatcaaggtgaggccggaggctggggccgggcctggcggatccgcagggcttgcgtggacagcgggcgtcacaacggtcgcggcgaggaggccgcctccctggcgagggaccggggccggcgggcactgggggcgcgccccggcatggcctccgtcctgcccgccccacagagggggtcggctcgttcgttcgtgtggtcccggagggcaccgcggactgggggtgcctggcccatcccctgcctcattccgtgggggcgggaccgcggggcttgggggccacacgggcggcccgcagctgggccctggagtgcggccccagcgtctcttcctcaggctcgggcatgatccgcggcgggaaagcagcgcgtccagccgaagcctgggggtcggagagcttgtgtgactgagaacgtttcggaaggcgtttctgacctttgcacctgccctcccagctcgttggcttgctcgtgtttgttgctggataaatgtgagcttgttgtgaaaattgtcttgaaattataatttcctgtttcttaacttctttttaaggctgaactccgagcagctgtgtttttagcactagaggagcaagaaaaagtagaggtatgaagtttccagattttaacatggctgtattcgttaatacttaatttcttattcattaaaaaccgtcttaaaaatagtttatagtaacatatagctagggataattttgaactgttaaggattacattactattgagagagagccaaaattattcttttttcgtgtagcttttgaatttgggggtaatcttaaggtaccacagtaactctgatactaatgcttaatctgaaacaaatggtcataggagtttcttgaagaaatggtgccattgtcaatgtgttaagtgcaggttcactcagatcctttagtaagctaatatgttattaatccctatgaaacggggtatatagtatgcaacttttcccaaaattatctgaccactcaattattttgacaatgaaaaagacagcgattattttaaaagtgcagccactactctatatttaagtgggtaatttaactttttcggagtcccaccaaccatcctgagtaaatattctggaatttgtcaacaagaatagaaccatcatcaaagccttaaactcttgctgtatgacaaatcagtctactgtcctctcacttctttagacctgtatacctaatctctaatttcatcaaaatcttcagttctttgccctttccatgtctgtgcaggcatcagtcttctcttggcagcattttgctctggaccctatgggtctggacccctaattaccttgccttaacggtcatacgtggtctggaagaaatctcagtggtcatttaacccagcaaactaactcttcccactttgcacatatgtgctcttggagaagagtcagtcaatcctgtggattgctgatgttgcaaattggcaggtaccaacctggttaggtcctgagcaggcccagcagctctcttcttcaccctagctgtgcagtagccttctatgtcacccctgcttccttctctctgaacacatggtcttgttgcttcctccacagggaaggtagaagccattagatcctaactttatgtcctcctctcctgtccctcaatctattgctcacctgtgaaaatgcttacctgtgtctatatttatctgtacctctttccttactgctttagaagaagaggctctgtcctgtccaagaataatcactctgtcttgtgtatactttcaagtctttaattatttactgtatctttgaccccttccttttctgatggcttttcttttgagcttgaaaacatgtttaaataactattaggagtaaactgttttcctttactcacattctgcttttaataccgctgtggtttttttccttcacaacctggttttgaccactccttggtttctttagcatgatctttttcctgtacacctgactgagacttatccacagttgtcattctgtactgtctcacagactgaccttattcatccagtaactccagccctgtaactttcatgcatgtttctttcccgagcttcagacctgtatgttaaactgcccactgtattatgcccttaatgggaccatcatttatctggcaagaaatctaagcgtttcttaggccttgctcttctttccacctgctcagccatcacctggctctgtgtctgtcaggtgtgtatctgaagtgtccccaagggagtgctctgctgcctcctttgtgcttgtttcttcttttccagattgccttatccccttcctacttgccagtctccgtttccgtggtgtccctcaccatctccctgaagtcctttttccacattgctcctagattggctgtttatagtacacatctgatcttgtccctccattctcttaaaatatttcagttgactcactatcttagaattccctgaaccagcctaccaactaccttgaggatctctcctctccttgtcttttattttaacaactttattgaggtaaaattgacctatagtaaagctaaagtatttaatatgtacaatttgatttttaatagttaatttatgcagctgtgaaatgatcatcacaatcaaggtactgcgcatatccttcaaacttttgaccttcaaaagttttccttgtgccccttatgtaaccctctcccccaccccaaacctttttaagaattatataaatggaatcgtatagtaggtactctttttttttggtctgtttcttcaacataatgcatttgaaattcattcatgttgtggtatgtattaataaatcatttcattaatacattgtacagatatgacagtttagccattacctgctgacagacatttaggctgtttccagtttttgagtattacaaataaggtttctgtgaacagtcacatacaagtctttgcttggatctgtgatttctcttgagaaaatatgtagaggtgaagtgactaggtcacatgctaggaatatttgtgacttttaagaaacactaccaaattgctgtccaaactcgttatgccattttgcattcccatcagcagtgtatgaggctgccactgtagcagcaattaatgtggtcttaaggaagcttaccatgtgctacctactgtagcctcttctcagcaacaatcacaggcttgatggtctagaagtattttttccatacttattcaaataaatgtataattacaaaaataagttggcctatgggccgcataagatcatctcacatttcatggataaactgggaattacaagtgtataattaaattcctgttcatagtaagtatgctataaatggtagatacctgagatgacaaaacttttatcaaacttcatgtatttgaaataataaacagttgttgacatttaattgtatttcacacaggtatttgaaaatatctagcttcaaaagcagtttataaaacatttaaaaattaaaaatacaaatcttcatatatggttttgttatattaactttgagaaattactaaatagcacaaagtaagtcctgtagtaattaacagttgtagaatggattttgtaaaaccataattttatcaatgaaaacgttaaactttatattttgtagttgtttttagggtaaacacatgacacttaaatttttttttttttaacagaacaaaactcctttagttaatgagagcctgaaaaagtttttaaataccaaagacggtaagatgttcagtttgttcttgtttatctatctctgaatttttgaatcttgataccatttgggagaaatcaggaatttcagggctttttttttgtcttcaattgttataggtcctcattttaaaataatattttattgtacaacaatcgtgttgctattacatatttttggatttgggatgttgttgcttaaagccagttttactacaaaaagccaatattaaccattaaaaagcgaaacactgaaatctatgagatgattgtcttacagttagttacagactgatgatcccagtgaaaaaatcaggagattgagattttcattacttaatcatattattcaaagaggaaatttgtaacttaaaaaatttagaaacctttcttccattaatttagtgtatctatttcataatgttaatttaaaaaattcagtttttgaagatttgcttacttacctttttcttgatctttataggtcgtttagtggctagtcttgttgcagaatttcttcagttttttaaccttgactttactttggctgtttttcaacctgaaactagcacagtaagaataatgatttttacatctatcttttgaaacctttgatacaaatgagttaatattaagctgaaagttaatagaatttgacaactgatagttttttacatttagattatttttggtagttgattatctgtttttcttaaaagccatatgagctttcagatagctggcaccagtgttgctgctttgtgttacttgaaagcttgctaataaaagtgttactatagagttaattttgatacgatgttagattgcacctgttaatggaaacgttgaaggtagaggctctgtaaaagaaataggcataattttttaaaatagacatttcattcattagtaagacagtctctttgagtttaaagatgtctttaaactctgaaaatatcttctttactccttgagaataacttctgctatttttttgtgcacttgtattttaacttcttttctagctgcaaggtctcgaaggtcgagagaatttagcccgagatttaggtataattgaagcagaaggtactgtgggtggacccttattattagaagtgatcaggcgctgtcaacagaaagaaaaagggccaaccactggggaagtaagtagaattctgtgttatctttttctattttaattattggctgcttagtttagccatgcagattagtgcatatatagtaaattaaggttttcatactagaagatattccttaaaaacaaaatgagatgcattcagattgtatcaatgcaaattttaatgaaaattaggaatgtgctgactgtgattctgtggcatatctgttctggtttttgatcctcaagagtgttgggtcatgagctaaactgtctggaacaaatcccaactcctcgttgcctcacttgatcctccattcattccatactgtgtatgaagtgggctctaccaggccctaccttggtgttctgaggcttctctgcataagccaacagaagcactcaacttgctattatttttattaaaacatcttatttaaatataaaagggctgatttataggatagttaataaatttttggacttaaaggcctctttaggcttaaaactaagctgttgattttgctttacgctgtttagaaacagttcaaacttacacttttttgatcagtagtacttttcatactcttaacctttttttagaaattgtgctaatgagattaatgatataattttattttcatacattaattttacatgaagatactctgttttatagatacaggtaacatctgtaactgttccagatatttgattaaatgtgagcttttagtcagaaatttataggtaagaatgtggagggctgtataggtttccagttattttctttggtgagtctcagaggatgttttctattagaatttttgaaaattgataaagcttgcctgagtactaattatgtgtaaggcatggtaaatagactttgtgggtactataagataaaatataagaaacttctgtgtctctgaatagcgcagagctatttaagataaaatgtgctcaaataaggaaattaacatttaaataacagtttaagattatggaggaattgtcatttaacacattatttccaaccatattatgaatagtttagaggaggaagcgattgtcacatgccaaaattttattgaagtcaattttaaagtgagagtaggatgtcagttgtggggcgaggattgggaagggctttccgagaagttggaacggtgccagccaagcgtgggagcaggagagcatagccagatcccaggctggctgggagtgaggcggctcacccagaacgcaggttgtcacttcagcttgtgcatataatttcattccttcatttatcaatatccagcaagcttttattgtgcgcttatttgatagatactgtgctgggtactgggcaatcaaaaacaaactaaagaacccagtctcctggggccagcagtctgtaggtcatgatgacctctctttattggctttcccctctcggcttctgtggccctgaagaactctcttctctttctaactgccctttcattttcttttctgtttagtagttgtgctttggctcacctcattgcagtggtgtttatgcatatttttctgtctagattgatctttcttccttaacataccactagcatggactctggaaccaggttacttgggtgaaaccccagctctgctacattctagctctgtgagcctgcagtcactcagcctccgtgtgcccaggttccttatctgcaacatggagatcacagaagtatcgcgcctacaggtctggagggggtctgaggaagcaagatgtgtgaagctttgagcacagtgcttggcacggaggactctgtgtgttactgtagtaggcatcagtggattcaattaactgcgaattgaaaatattcggataggctgagcgcggtagctcatgcctgtaatcccagcactttgggaggccgaggtgggcgaatcatgaagtcaagagatggagaccatcctggccaacatggtgaaaccccatctctactaaaaatagaaaaattagctgggcgcggtggtgtgtgcctgtagtcccagctacttgggaggctgaggcagaatcacttgaacccagtaggtggcggtggcagtgaggcgaggtcgtgccaccgcactccagcctggcgacagagcgagactccatctcaaaaaaaagaaaaaaagaaaatatttggataaaatacaacaaaagaatgcaaatatagtagaaaactatatagcatttacattgtattagatataagttagacacgatttgaagtacataagttatatgcaaatatgtcatttcacataagagacttgagcatccttggattttggtgtccacaggagagtcctacaaccagtcccctgtggatactgagggacgactgtgttagtattactgtttcttgttattgtatggatgactctttaagttcagtgtagtctgcctaagctcagctcagtcctttatcctagctccagactagaatttccagctcttcacaaaacatacctccctggataacccaatagtatattcgaatcctgtgtggaaaaacttactttcttctctttacctctaaaaagtaaaaacataaagacaaaagcaaatcccaccttactccccgcaaataaccctcttcaagttcttcttgctcacttctgtgttttgattgattctattcctgtgactccttggtttcatcccaaggagccacctcttcacatgtgctctggattcagttcttctgtcaggaaggattcactctccaccttgcaccccgtagctttggtaacaggctgtggaagaaagaataattgctggagggctttctgttctctgctagataggagtgtacctcaaaatgagacccagtagcatgcctgtgtagtgggtgtgatgtgaaaatggacacagaatcactgttcttcagtacttcattctgactcgtggatttgaggcctcccctgaagtttgccctgactttttcatagctgtgattctgtcaaatagagccaggataggaattctgtatcctcaaaaggtagttgttttactcccccaagttgctgaaccagtaagttgggcatctcatctccattttttgctagttttcccttcctaatatctggatatttaattttaatagtttgtgcatatgtatataaacaaatagataaaatatttaaaatagagacctcaaagatgtatgttttggcccttcattatttattagtgttttctattactttggaagaaaacctgttgtttataatgaaataaaaaattagagcttttattagcttttgactttgactgtagaaaactagctataggttaagctcactgaactaaattactgatgctttttaccaaaactgcattttaaccacctcaagaatcaggttgctgtgccccacccgctttaacctgacttttgtttggttttattggatgctcccaagccgtagataattaaagccctttcttgttttctgagcccctcaatggatcattttcatctccttcagcacctctaccatgtaggtccttatatctgtccaggatcatttcttcctaaaggttctcatgctttcagtctgtcattcactgttgcagaattatttttaaacttcagcccttcctctgttcctttcttctgtacgattgtagtgactgcactgccgactcaggagtcccagattcttcagcccttatgaaatgttctgtgtgatgtggccttaacctgtctttctagccttatgtgttttttttttttttaatgtggaaccttgtacttaagtcagattgaactttggacttactacttgaaagtggcttgtgttttttcgccttctcttatttcgttattctatcctccacttggaattatactctttccccttccccagctgtggaattttgtcagtcaggttttctcctcagctgcaactcttgttcttcctctctccttactggaaactgcatgtaacttagtgcctccttctgtcaaagttgtagtagtgatctgcactggttacacatggaaatttactgaggacaagggctttatcttcatatctcttacacagtctaaggcattgtgatttttttttgtttttttttgagacggagtcttgctctgttgcccaggctggagtgcagcggcaagatctcaactcactgctgcaagctccacctcccaggttcacgacattcttctgcctcagcctcccgagtagctgggactacaggcagccaccaccacacccggctaattttttttatttttttatttttagtagagacggggtttcaccgtgttagccaggatggtctcaatctctgacctcgtgatccacccgccttggcctcccaaattgctgggattacaggtgtgaaccaccgtgcccagctggcatagtgatttttaacatactgttcacagtcagtggaagcctttgaaaatttgaagaggaatacccatttagaagatttgtggaggttagattggtaaaatatggagaagttagcagactagaaagaagtgaaacacataagaaggcaaatctagacaagaatggtagcagtaagaatagaaataagtggacatacaggctagacatggtggctcacacctgtaattccagcactttgggaggccgaggcaggcggatcacttgaggccaggagtttgagaccagcctggccaacctagtgaaaccccgtctctattaaaaatataaaaattaatgttgggcgcggtggctcatgcctgtaatcccagcgctttgggaggccaaggcgggtggatcacctgaggtcaggagtacgagaccagcctggccaacatggtggaactccatctctaccaaaatacaaaaaattggccaggtgcggtggctcaaacctgtaatcccacattgggaggctgaggcgggcggatcatttgagaccagcctggccaacatagtgaaaccctctgtctactaaaaccacaaaaattagctgggcatggtggtgtgcacctgtagtcccagctactcgggagggcgaggcaggagaattgcttgaacctgggaggtggaggttgtggtgagccaagattgcgcctctgcactccacagagcgagactctgtctcaaaaaaaaaaaaaaaaaaaaaaaaaaatacaaggaattagctgggcgtggtactcgggaggttgaggcaagagaatcgcttgaacccggcagtcggaggttgcagtaagccaagatctcgccattgcactctaacctggacaacaagaatgaaactccgtctcaaaaaaaaaaaaaaaaaaaagttagttgggtgcggtggtgcattcctataatcccagctacttgagaggctgaggtgggaggatcacttgaatctgggaggcggagattgcagtgagccgagatcgcaccactgcactccagcctgggtaacagagtgagaccctgtttcaaaaaaaagaaaaataaaagaaagaaagaaatgaatagataaagatgaccttttgagaatcaacaagacttggtaaactaatattttggcatggggcaaggtcacagaaggcaataagagaaaagaaaagctctcaaaggccagtttaaggattttagcctagaagataatatcaccaacagaaatagtgggactgaagagggagaactgaagttatgaagaacagcacattttcgtatttaaaaagttacagtcagtcataaagggatttttgtaacaaacagccagtatttactatgtacagtgtcctagagcttgtgctggtagtggatgaattgtaggaagtgattttcatttaagaaacattttaaaaacctcctccttggcattaaccacagtgctcagaaccctgtggtgacagggcactgggcagcagacacagatgactcctgtggaagttgggctagaacaggtacttaccattttggaaaaaaaatgtgtgaaagtagaaaactgggagagtgaactactatttgaaggggtaaagtatttttaatgaaagttgttatttggtattttttcttgagataaaatgaagtagggaaacaaattcaaggagggcaaaaagtagatcttagagaattacaggatattatttgtctggagagtagggagaagggaagtgaggaagtaaatcctggaatggtagacctgggacagatttcagtggagaaagacagtatcctgttcaaagtgaataaatgaaatattttgcaggtaattagaatctagggatgtgtagaaggtttttgagggggtaaaattagaggaaaatctaaaaaggatggttactttaataagaaataaaataccaacattgtatagtgtttttaaatgctaaaattctattggagtgtaattggtatatttgtgttttatttttaaatgtattttaattttaaactaaaatattttagggtgcacttgatctatctgatgtacattctccaccaaagtcaccagagggaaaaacaagtgcacagacaacaccaagtaaggtgagttagctgtggaacacggaagtcatgtctggacttaactccagagtgctctgcttttctctctctagtctttcttgttacaagttgtattgttttatataaacacatgggctctttagtttcttgaaggtgctttttttccattaagtatacattaaaaaaaaagttttgctttgttggtagttgtttgacatttgtattgtagaaaggaatgtgctggtaagtaacagaatcatagaatatttggatttatttggtacttcggacattttctcctattaacaaggagatttacttacttttcatttataaattcctagcttgagaatattaagctagaaatatgtattataggatataatattgaatgaatattttagacttctagatgggtgatgagattcagaattgtaaatcatgatggtttttaatatacctgggctgttttgatacaatttctaagaaaatgtatgtactttggttacatttgtgtgtgtatgcatgtgtgcgtctgtttgtgtgtttatgagttgttaaaggtaagacttgatttcagagattaagcataatgggaaaaaaaatgagctctacactttgaatttaagatccaggatatgtaggaatggatagaaagatgattgtcaggaaatttgttttctcaagagcacagcatgaattggtagtcccaggcggtcttaccaaaggataggttggggtctgtcttagtctgttcaggctgccaagtaccatagattgggcagcttacaaacaacacatttttcctcacagttctggaggctggaagtccaagatcacggcatcactgtggttaggtctggtgaggtccctcttctaggttgcagagagctgccttctcattgtgtcctcacgtggtggaaagagggtgagagagctctctggggtcagggccctaatcccattcacaaagccttcacccgcatgatctgctcaccccgcaaaggctccaccttctgataccatcacattgagggttaggatttcaacataggagctgggggtttgtggactacacaaacctgcagtccatgacaggtcgggtttgtattctttgactgtccctttgattttcatcccataggaatagagtgatgctgtggagtccattccaaaagatgaggtcccatgtgggtttatggtggtggatcgactctcagatacagttgcatctttttaaatagatgaacttccaggacgtagtgattatactacacgatacctttcttttttaaatgtctaggcacagaacattgctgaacgattgctgttattttttgcttgttctttgatgttgttgctcctttttattgtttaagtttggaaaactaaggaattttatacttcatttctaaccaaagaaacaactattgtattgtttatagttgctccttctgagatttctagttggtgtagggaaggcctttttttaaaattttttttttcctaaatactcataggaggctataaccccagtgatagagtaaggtcatgagtaaatttttaaaatttctttaaattaattgcaaataaaacagcctatgtaagtaagctttacttttcatgaaaatacctggctttagaaaaattaaaattaatgaatattccaaaatacttatcagtacctatagcatttgactatttggaagctctttttagcaaattattactgtttttaaagcaaattagcaatcctaacctatatataatgtatgtcttcagggtaaaatattaaagtctattttacgtactcttattctccctacatacattttaagatctaagaattataatgagaatctcaatgttttaagtcagtcaggaaatgatgctgtgagtttttccagagaaggggggactgtcctgaggctgctttagagaatagcgtttgtcctaacagctgtctctgccgtcatcccgttattctagtttagtctccgtttctcagttggcctcataaacccacttcagaaataccctagatagtccttgtgtagggttgcatctgttctaaaatgaacccttattttggcacttaaaatgcaatttctctagtactaaaggacctggatttgggatccagtactttccctaccgtcttcttgctagctacctcctaccaaatcagccttgagggcccacggagaatgctagaaactctccaagagtagggtccacgcaacctttaggaaccagctttgtgtgctcctgagaaaggtcagatgaggtcaggacaagtcttcaaggaagttgcctaggaactcaagtgaggcttatttagaatgccgctaaaatgtagcatgaaagagctgattctccacccagtagaagctgagcaggtggaggctaaggtatctgtgtttgacctagtaactattggaaacagtaaacatgaggtagatcactctaggaatagttaagaaaggaccaaaaaaagcaggcctcacagaacatattaactagatgttccacttctgagacatttttcagtaggtatctttgtttggtaatgagttagtttattttttaaagatttctattttgtggtaaaatctcattttattctcatgctcagataccaaggtataaaggacaaggtaagaagaagacaagcgggcagaaggctggtgacaaggtaacatgcatgagggcagaggagaaaagcagcctgtgggcatcaggtctcgactctggggcctcctggagcgctgggctcctgtcagattgggttctcagttttcttatgaaatgtcacttgaggctgggctaggtggctcacgcctgtaatcccagcactttgggagtccaaggcgggcggatcacttgaggtcaggagttcgagaccatcctggccaacatggtgaaaccccgcctctactaaaatacaaaaattagccggccgtggtggtgtgcgcctgtaatcccagctacttgggaggctgaggcaggagaatcgctttaacccgggaagcggaggttgcagtgagctgaaatcgtgccattgcactccagcatgggtgacagagtgagactctgtctaaaaaaacaaaaaagtaacgatggcatgaaataaaaagtaaatttcactgtcagtttttatccaggtgaaaatcatactgttgaatcttaaaaccatgctctcagttttactttgaaaattcctgttgtgttggcaattagagttgaaaatacgtatttttcttttgaatggatgattatatacatattagtaacattgtgatttttatttgaggaaaatagaacatcaaactatttttttgaatacgtacctattgataaattaaaaattaaacgtatttcctccaagatgtttttgtgttctgtcatttttcagacaattgcacatttgtgatcctttattcagtgcccctgctcacagtagactgctgggggccagtgctgcatactaccaaggccttggctgctttttcatcctctcctaaagatcacaaaaattgactaatccagtagattagctgcttatgaaatttaaatattagaagttttagaaacattatcagtacagtttttacatgtacttaggataagacaaaatatttaattttcagttctgtgagattcattagtcctatgctgaactttggttatgtatagattttttcactaggttgaaaatcttcaaacttaaagctttttaaaaattccacctgttgtgttagatggctttagttctaggagtttcaaaggtaaattcctattactgtattctctttctgttcacactgttctttatgcgttattaaacaagaagttgctttaaaataatgatttagtaagttttttttaacatttacatagtgaaagttattgtgtgttaatgctttgggcaacacatttaacacagttctcacttaaggagtttatagtttaattggagagatgagacataccttaagtaagatataaaacttcttaatagattttaaaaatcagtttcttgggcttttctaaaatttaaaagcatattttatagtattaagcttttataatcttactgctattgtgggtttcaaacaacttaaacattttcaagaagtttatacatagagccaaggcatcctaagagatgtggttttcactttgtgtgatgtgaaataactgtgatgggcccagactttagctttcgcggtactttgggcagagtgtagtgtgtgccctgacttgagaggggattgaagaatctaggtgggcccatatcccaggatttagtccataatttgggtctcttctatttcattgttgtgttcctgaggccaggatgcttcctcaattacttggaaacctttttccctgtacatttctgatcttgtttctgaactgccttgtgagaagtctgtattgtaccccatgtggcctattgccagccttacttatatgggtaagcccttagctctttgttcccctgcctttctgctttgccttgtgcatgcagtgagttcccaacagccttaacattctcaacatcttcatcatccagatgctatgttgcatgtggtggttgaggttgtacacagcaagactccagatggagccatccgcatggtaggtgagtggcatctcccaaggtatgcaaagccatcatgggagccctgcctgtcctgcagacgtgaactgggcatgcgatgcaggagggcctagggtaccgctgctcccggagctctggagcactgatcaggagtgtcgcatgtgtccggttgctttcgaatgcaggaggcgacaagtactagtggctcactcagagacccttggcactttcttcagggaagctatattcatattataaataaacttaaaaaaacattcatatgtatagttagaattgatttgtagggtttttgaactgatgtaacttgggcaaaactgaagttcttatttttgttgttgctaagagacaataaagataaaaataaaataaagattaaagataaaagatttggtatacaaggagtataaatatgaaatgagagggcattttaaaaatgaattaataattttgaaatatatattaatacttgctgacttccaaagtatcatctgtgataatttatctcattgtattccatttcgttgtaccaaacatcctaattgtttggaaaaaaaaaaaagtatcagaaaattataacagacttttgataggccctactagcttaggtttttaccatttagttggaaatgttgagtaagatctatatttttttgtttttaatatttagaattagttgctctttatcattatattaaatgtaatatgaaagatcatcctttcttcttacaaatagttttcaggtgtctgtttctttttagagacaaggtctcactctgtcacctaggctggagtgcagtggtgtgatcatggctcacaccacttgtcctcctggggtcaagtgcccacttcagcctcttgggtagctaggacaacaggtgcatgccagcacagctggctaattttttaaaaaatgttttcatgtagaggcaggggtctcactatggttgtccattctgatcctcaactgtggggctcaagtgatcctcctgcctcggcctcccaaagtgctgggattacaggcatgagccaccgtgcctggcccagttttcaggtattttaaaactaacatgtattgagatgctttttcacattacgtgtaggttttggggcatatgtttttgtatctttggcagtcacctgaggattttccaaaccaggcgttaccattccctgtcacactctcacaccatcctgaatgaatggatacatggatgcatgaatgttcccacacttagccctgtagtaaaattacttctctaaataattcattagtaagtcatggatcagaaactgtcgttggcagggagagaggtggggggcagaggcatgggtgaagagaattttaaatacagtcagcctcatatctggaggtttcatatgcattgctttcacacctgcagattcagtcgtatgtaaatggaaaaatggttataaaaaataataatacaaattttatttattatttatttatttatttatttttttatttttttgagatggagtctctctctgtcgcccaggctggagtgcagtggcacgatctcggctcactgcaagctccgcctcccgggttcacgggaggctcctgcctcagcctcctgagtagctgggattacaggcgcccaccaccaagcccggctaattttttgtatttttagtagagacggggtttcactgtgttagctaggatggtcttgatctcctgacctcgtgatccacctgccttgggctcccaaagtgctgggattacaggtgtgagccaccgcgcctggccaataatgatacaaattttaaaataatggtatacaactgtctacatagcattacatttattaggtattacaagtaatctagagatgattcaaagcatatgggaggatgtgtgtaggctatgtgcaaatactacagcattttatacgagggacttgagcatcctcggactttggtgtctgcaggtgtcctgggtactgagggacaactgtattgcatgaattttttgaatacttttgcaaaacaatagtatttctttgatatttttcctacatgaacagtttggaaaaaaattcttttttttttttttcaggttcttaagtcagtctgatacaattcagtttttgactactgaaaaattaaggtttctcattgtgaaacttctctagtgctgactttttgttaatctagaaatgattggcttctttattatatgagtgtactattggataatttaaatatatactaaagctttcttatggctgcactataatttcccatagagcttattattagtcttgagctccagccaagagaacttaatgaccgttgtagtgctgtgcaataggtccctcacttttatgaaaagacaaaacttgttttagttttttgttataaatgacttgatttgtttcctagggctaatgtaatataagtaccaatattgggtggcttaaaacaacacatgtgttgtgtcacagttctagaggcttaaaaatgtgaaatcaaggttcgcggagggctgtggctcctgttctagcttctggtggctgctagacccagatgctgtttggcttgtagatggattactccagtctttgcctccatcttcacatggacttctccctgtgtttctctgtgtctcttccccccagcaaggataccactcattaggttaggacccaggcccaccctactctttgaatggactcatcttaactaaatacatctgcagtggacactgtttccaaataaggtcacactctgaagtactgggagttaggggtttcaacatatttcatttgtgggatacagtttgacccataacttttgtgcttgtccagagaatgaattctaaggcattgccatggtatgtgtgtgtgtgtgtatttttttttgagacggattctcgctctgtcaccaggctggagtgcagtggcggcgattacagctcactgcaacctccaacttcctggttcaagcgattctcctgccccagcctcctgagtagctgggattacaggcacgtgccaccacacccagctaatttttgtatttttagtagagacggggttccactatgttggccaggatggtttcggatctcctgacctcatgatccgcctgcctcggcctcccaaagtgctgggattacaggtgtgagccactgtgcctggccttatattttttaaatcttatttgttagtttttaaacaatacttaaccttagttatttagcttcattttgaatcttcaacttagccaaatccaggtgatacaaaacccaagtaactgaagtttatgtacgtaacataagttcgtcttaactcatgataagggtttttaaagcagattcccgggtatacatacgtatacagatggtccccaatgttacaacagtttgatttatgcttttttgactttatgatggtacaaaagtgatatagattaagtagatagcatacgttgagttttgatcttttcccaggacagtaatcggtggtacgattctctctcggggccaggcagtgacgttgagccacggcttccagtcagccacatggtcacgaggcactctgatgccaggggactgaatagccagcattttttggatattgtgtttttgcacctcatgtttatgaagtgcccgttttccactttgtgatattttcacttgacggttgatgaggtgaagcgctgttgtgggttgagcatctgtgcacatgcatacacctgctgtgcacacgcatacacctgctgtgcacacgcatacacctgctgtgcacacgcgtacacctgctgtgcacacgggtacacctgctgtgtacatggaggagccactgaaactgctctcagcgttttcagtgctttggttttaatctgcaaaatgtgttgatgacaaatctttctcctcttcctgtagatttttttaatagtgaagtttatttggaattaagtttagtgaattcattaataacctagttggtaatggtcttttggcaaaaatgagccatagttataaagtagtaacatgttactgtgtggtttagaactagattttgagagcagttccaaagcagattgtttcagaatttatttttactccctggattaagagaactatatttttaaaataattctgttatgtttacaagtatgtgttgtgtaatatagtaatgcccttctccgtaaaacttgtcttcctaaaactggtctttctgtctatagcgggaatattggtcaaacctgtcaaataatcatggatacctactagttgctcagctttgatactagatagttcattatgtggatttaagttacattggcagtgtgaattcttggggaaatcagaataattattgtttctcataatattgctttacatttacatttttcagtttctgtcatgccagttattctttggcactttctcatgagtgtttagaaggagagaatctgtcgtggccacaggctgtgtcattgtacatatgtttaaatatcacatcagggtatttatttccaaatgcatattcttttaaaaagacataaatccattattaaaacagtgtaaaaatcagaaattacaactgctgtgaattacataatatttttctatatttgataataccaggaaaatgtcaagaaagttgttaggaaatttttgaaagtttccatccctttgaaaatatgttgtctaaaattataacttgctatttattttttcagacatctctttataatcattaatttatattaataacatggaatgtgtagctctctagaaggcaataaaatttgcacagcatatatcttgcctactgtcaactagtcaagacctctacctggtgtaaagatgtaaacgtatatcataagacatgcataatgcattctgtctgtacccatatgaaaagtgaaaccatccttcaagagcgtcttgttcggtaatgtctaacccagactttggtcaccatgcttcagtagttactactctttaattctttctcagccatccatcccttcctagatataatttgatctgaaaaatatgaatctagttcaattcttgaggaaactcatgcctaggaaattaatttacttaagattacacgggccgtgtatggtggctcacggctcacacctgtaatcccagcactttgggaggccgaggcgggtggatcacttgaggtcagaagttcgagaccagcgtggccaacatgttgaaaccctgtttctactaaaaatacaaaaattagccaagcgtggtggcacgcgcctgaaatcccagctactcaggaggctgaggcaggagaatcgcttgaatctgggaggcggaggttgcagttagcccagattgccccactgcactccagcctgagtgacagagcgagactctgtctcaaaaaaaaaaaaaaaaaaagattatacgactgggtgtagtttgtgcttgtaatcccataaacccagctacttgggagactgaggcaaggaggactgcttgagcccaggagttttaagaccagcctggatgacatagtgagagcctgtttcttaaaaaagaaaaaaaagaaaaaaaaatggagttaataattttggactacattccagattccttgtttcagttgagtgctttttctattattccacgggtattttacacaatactgctctctttagtacgcaaggctgaattttgggaaattgccatttttaacccataaagcccacaaattcattataatttagcttaatagcataaatattgagttaacctctggaagcaggctttgactttgatattgacctgaccacttaactctctggagactttgacaagtgacatcaatgtctgtctctgtgtttcctgatttatatccacagatagaaagccatctccagatcctagggccattttcaagattcagtgagataaggtgaagcatttgaatgttctccataaatgtcagctgcttttattattactagcattattttttgttttcattattattattaacatagacccgtctaagggcagaaagaaatctgaccaagaatggagtgaaagtcggctgtgaaggttaggactccctgaaaacaaaaaagaaaagtggtaacatcactctgtatccaagggcatggataaggatgattcagaatttttttataacattgatgttaatatacatagagaaatacacacacacacacacgtatatatgtccatggacatcaaaatgaggtataggttaggaagttaccctggaagttagaattgagataattactttgattagcaaaggtttatgttagaaatacgagtggttgaaggcagcgcctttcaccttgatgcctgttgtgtttagcactggatagaaaattgctatttttactgatgactactttaatgcttggttcattcatatgaaataatctttcttttctcctttaataataatgatctctcctgatttcaagttgaaaatgtattaatttaagataacttatgaagcaatgacatatggaagaggagatgggaaattgtttctcaatgggaaagtgtttataaatgggataggtatactaaaggtatttccatttagggaaagaggaaaggaatggtattaatatatttctctaatatttttccccctttgaaagtttgccatgttaggaatcctggggatggagtgatgaattgtggcattgctctgcagttcacgctgctgagagctgccccaacacacacacacacacacacacacacacacacacacaaaggttgcacacacacaaacaggtttgattatgctcatgagacttcttttattattgaaaatatcttaaagttttatctcaccaaggaggccttttctctttccctctctttctagaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgtgagtaaatggtttttgagctatgagactaggggcttaaaaataagataaatgttttcattttatagttaaaaaataatgaactatggaaggtttataattattggatccataaatctgactatgcgttgttaatgcctttcatgttgtaaaacaatcccagattttagaaaaacctagacatgatttattccaacaagtaagtgtagattgagtgtcagccacttgccagggctgttccagggtggggtgcagcaatgatagaagagggaagactcctgccctcaggaagctcatgctctggtgacagagtcaggcaatgagggttatgctgcagcgtgtggggtgatgagagcagagcagtgatgggagcccgagtgtgtggtcagggcaggtgcatgtcagctgtccaaattggagggggcctcacttggaggtgcccagtgagcaaagagctagaggaggtaagggagttgccgtgggttgatggagctttggggagaggaaacagacagcagggaggcgagttgggggtagcagagagagcaagatggggatcggatgaggtggactcagagatgaggagctggacggcttttctttgagactggaagccctgaggatcttgatctggcgtacattacagaaggatcctgaggttgctggggaaggttggtcttagagtttccagttaggaggccgttaatgatggaaaaggatttgccagtaagtgctagagaaaagtaatatacagagtggcatcatggtttttagcctgcaaaactagaaggttggaaacacgttagatgaagagtggcaagagcaagagtggattacacagacaggtggcatgacagcctggaggcccctgttgctgtgctaagttagagaagattgctagtggaaatccaaagtaggctattgagtgtatgcgttgggattgatggagaggtctgagctggagatgtaaattaggagtcatcagtttgtagataatgtggggtgtgggagactacagaggatcaccaaggaagcaggacctgcgcaccttgaggccagagcagggagctagaagcagcagaggagatggaaccaggagagtggtgtctgtggaggtggcggtagggaggagtagctgtatgatgccgttggatttagccatctggaggtcagtgatgaccttgacacagttttgttggaatgggggtgcgaggcaggttagagaattagagtgcattcaagacagacaggaaaggattgtagatgaaaaatagttttctgatgagttgtaaaagtgtgcagaggagcagggtggtggctggaggggcaggatttagggctgaaaaacgtgtttaggtgggagaaataacagcatgtatgctgacgagagctgttcagctttaaagatggaagaattaatgatgtaagggagtgagaggagaactggagggctgcgcagcagtggaatcccatgcaggggcttgtgtttgctggaaaagtggagagcgtgtgggtctcattgtaggcagggggtggatatgatggtggcacctgtgcaagctgtcacctgagttcatagttgagtgaggatggaggacggaggttggagataagaggagagtggagaaagcatgaaatctttctataagaaagtaaggcgagaaggcactgtggaaacccggagggttgttgggcagttttaaaggtccccttgaggttagtggtcatgactttaaggggagttcatcagcatggctgttagtggcttctgtaagcaatattaaatctgagaggtggcacttatttgctagtaaactcctgtattgtcccttggctgcatgtctgggtaatggaaaagggcttctgaaaaaaatcacagtgaagaggtcaatttagtttatatcaaacagaattctaaagagaggtgagctgatttcttacgccctggctgtgccgattgtggttgatctgtagtttgcactcccttggtgtactttatggttttgaatctttaaagtgtatattcttgatttccagccaccacacgtataaaatatctttaagttgcttttgtttctgtggcagaataaaagtgtttagtggcagaacataagagcaccgattaactgtccttgtttcttgttaggaggaaggaacctaggaagcaagcaggaagtctggcctcgctctcggatgcaccccccttaaaaagtggactcagctccctggcgggagccccttctttaaaagactctgagagtaagtgcccaaagatgtggacttcaatactcgggatattttttctctaattaaatactatgtgattattgttgattttttttcccaggaaaatcactaaaataacctatcattttatcactcagagatatttcctgttaatattttgttgtgttttgttacttctaaggtggtcctattttatatgttgttttgtattctggcccttcctatacctatataccatcggaatacttttgggaagttgactttttagctgatttttattatctatagaaataaaatttttaaatcatctctccttttttggacatttacaatgacttgagttggatttgctttcaattaatttttaaaaatttggtgataccacagtaagtatcataaaatgttaaataaaaaattattctgcagatcattttcaagaacagtgacctgacatgtcatcgtaaatgcagcagagctaaagagcactggttacacatggaatagtctagctctggcaccagttactttcccacctctccccacacacagtgataggaatttaaaaagcatagccctgaacatgtaggatgggcagaggtcctttggaaaccgtatcatagtaaatgttgtatttaattagcgtagtgtttcagagcacgtgtacctcttttgagaaagtttcctaaagtagattcactaagaatttgcagtatgcgttttgcataattgtccagtatttccgaatctttttgtattgcttgatatactgtgggacttcctagggcacataagagagccggcctgttgcttctcttaaaccagccatgtatttataatgtccgcatcccttcccatttgcttctttcccgtggttactgccacctttaagaaaggaatccaggacatcatgaacatgtcattctgacattgattagagaatgatcatttagagaggacgttgagaacaaaggactaaaaaaccagtgaggatgtcactttagtaagtgaaatagcagttgcactgaagaaaaatttagaaattcaaaggaaaaataagactcatgaaaataattaacagtctatgaattcatacctaacagggctgtttatggaaagtgatgtcttataatgaggcaaaaaatggtttttggtggttgtgttccaataaagtagtattgtttatggtttaaaaagggatgtagctgggtgcagtggctcacgcctgtaataccagcactttgggaggccgaggtgggtggatcacgaggtcaggagttcgagaccagcctatccaacatagggaaaccctgtctctactaaaaatacaaaaattagctgggtgtggtagcacatgcctgtagtcccagctactcgggaggctgaggcgggagaatcgcttgaacccagaaggcagaggttgcagtgagctgagaccgcgccattgcactccagcctgagtgacagtgatgagactccgtctcaaaaaaagggttgtgatgcatagcttaagcgttcattaatcacagtttattttttccttagttttaggttattatgctcctgtcataaagaagccccatattgaacaacgacaaaaattgatgtggtttagagactgttatattctaagtcactctaatgttaatattttctcctgttcacaggtaaaaggggaaatacagttttgaaagatctgaaattgatcagtgataaaattggatcacttggattaggtaattagatttctagtttttgtgttgatcgttttaaagtgattatttttagggtaaggctgtaaaagaagtgactccgtctgcctacgctgagcaccttcctgctgctgctcattcagcaggtgtttgaatggcttttacgtgttcaggattacacgctatgcgagagatggctacagcaacagccatcatgttctcgtgaacctctgtcttcatggagtttaaattctggtcaggaatatgaacattaaacgggcatctacagatattttgactgtaaaagggtcagtatatatgggtatagaaatggctagtaggttacctttgtccagtcttggcattcagggaagacttcttataagaagtgacttctgtgcagaagcttcatggttaagtagatgtataagagagaagggaagatatttcagttcagactgagaaaaatttgggcagaggcagagccatttgctagatgctggtagtacatggtccaggcctcagagaattcagtctagtggggaaacagacttattgaaagaaaaattgtgagatgtgttcagttctgttctatggagcagaagttggtaagcctgccatgtaagtacattcattcctatggaagtaagagtgtcaatgtgaacattaccgagccctgggccatatgttgagagcacatttctcattcagtgttctgttctgtgcaagactgtagcagtgtgacaggcatactttaggcaaactcatttatgtaaaggcaaacttggtgacctgaaggaaacggtgcagccaggttctcaatggccacttcctatgctctctgtggatgtgatgggatcccttcctggtctgtaatcactcacacatggaagcattggaagagcttcacaggcaggttagggagaaagaaaggtgtgtccccatgtgcttttaaaacccagccctgtccaaggggcagctccgagaatgcccttccctcttctggagagacattctggatagtgcaaagaacttgggcttggagttggatagaagtgacatctcagatgtggcactgattgatgggtagcgtagggagataaactaaactgctatttcctcatctgttaagtggaactaataacatctgccttgttttaaagagtaaataggatttaaatatctcttcatatgtaaattaaagtacagtggctggcatggtaggtgcctagtaaatgttagttttctttttacgttacttttccccccatttgcagaagaataaatgttccctgagctgcccggattcttgttccgcacagtgccctggagtcctggtaactgagttgctggttgtgctgccatctgctctttgtgcgtcctggttgctggctggccagctaggtgggcctgcctcctttccctcccttgtgcttttcctgtcagctgtggtcatggttgccattagatgttcttttccactaaatctcagtggctaactgccaccagagactttactcctgacctctgcaccgtgatggccgccctgtcccctttgtgttctgtttttttcacttttgtggtgtttcactctgttgccaaaccttttagcttttttctctgactgctctattctcttaccaaagcgagggttttccctcctgtttctgagtggggagctgccgagaattgtcatcctcaggagggaatgtcgttgctggggctgcagagttgctgggtacaggcaggagggtggtgtgctccttcacttcactttgtcttgggacttaggcatatctcgggttggaattggggtagttatgcaggtgagaactaccagttcactagctggatgtttgtcatttagctaggcattaggattcagtagaaataaagttttatttcgttttgcaacaatgttgttttctgtttgggttgtttacattttaaatatacagtactctaggtattttgagtaatatgtagacagatgttagtggaccagcctaggagaataatgatgttagtgataagtgcttggcactgtaccaaggaattattttatttaattcatatcctatgaggtaggttttattactatctccatttttacagatgaagaatctaggttaagtaacttgcccaaggtcatgctgcttttagagtcctgatgcatcacacagagccctcaccactgtgttttactgcctgtatgttatttagacatattgaaataatcatttcaatgggaacataaattctgagttccaaataaataatctacaaataaagctttagagcaccatctattttagtttggcagacaaatattaattaaaggtgcccaaaaggagtgtttatagataggtactttgcatatttaaagcaagagttgctaagctttttccgtaaagggccaaatagtctatattttagggtttgtggatggcatgtactgtctctcacatagtctttgtgtgtttttttgtttttttgttttttaacaatctttaaaaatgtaaaagccattcttagttcacaggctgaacaaaagcaggtcatcagccagaggcaagaatgaaagtaaggaaagcagaaggctgtcaggaagtccgggccaaagatgactggggtaagggcagataagacagagggtatgggatggggaggagagactgtcaaaaaatgaagaaaacaagaatccttggcctgagggccaaaatttgctgacccttaaagtaatgtagtacaggttgagtatcccttaatgcaaatgcttgggaccagaagtatttcagagtctggatttttttggattttgaaatgtttgcatttttcttaccagatgagcatcccaaatctgaaaatctgaaagtccgaaatgctccaatgagcagtttctctgagcattacgtcagcactcagaaagttctggatttcattcaagtttggttttcaaatttttgaatttgggatgcttaacctgtatgtattctgttaatcattttgacactggcttaaattattgtaatactaaacaatacataaccaagaagtcagaatctgatgtgttatagcacattattcagtaaatatctttgtctcatgtgtctgtctgaagagaccaccaaacagtctttgtgtgagcaacatggctgtttatttcacctgggtgcaggcaggctgagtccgaaaagagagtcagcaaagggttgtggattatcattagttcttacaggttttgggataggtggtggagttaagagcaatgttttgagggaaggggttggatcttacaaagtacattctcaagggtggggagaactacaaagaaccttcttaagcatgggggagattataaagaaccttcttaagggtgggggagattacaaagtacattgatcagttagggtagggcagaaacaaatcacaatggtggaatgtcatcagttaaggctattttcacttcttttgtggatcttcaattgcttcaggccatctggatgtacacgtgcaggacactggggatatgatggcttagcttgggctcagaggcctgacaatcttgtgttttgaattggctacaaatgctgccaggtggggaatccagttagctttctttaaatccacattgcagccacagccgtcctcgctgtctcagctcagtgtccacctctgctctcctcactggccttcacacataggaacactacaatgggtccttggaggctgacattttagtagctgccactcctggttttacttagcgcttgcaaaccagccacatatgtagtttgtttaatcagatttccacttctccttcttggccctgacagtgcctggtttctggcaagcacttgcagccctttaacctttgaggctacagtggagacgagctcttgattctcaagaggagaggaagctcctgacatgtccctcctgactgcttatgatcagggatttccagttcattactgggcaaggtttggatgtagcaggaacaaggactcatgttttcttcgtttgctgatattcttcccaccccatatcatctacccgtctgtcttatctgtgggacaccttccttgacccaagccttttacccctgttctctttggcctggactttctgacagccttctgctttccttactttcattgttgcctcctgtacacacatttcttctggcggtggtacgattatttctgggaaaacagaagtgaggtagtgctaccctgcactttttcactcctgtcttcccccaccccaccccatcccagacagcttccctttgtattcaggctaagatccttattgcaaccaaccaagccctaatgatccggcttctgccaacccttctgatcgccactccttttttcttcctccacccattctgtcccccaaattcattgttttatggttgtatggcttccttactggtggtttttacattttttttgagacagtattttaaaaattaaaatttaaaaaataaaataaatttttaatttttgagggggtcttgcaatgttgcccaggctggtctcaaactcctgggtgcaagtgatcctcctgccttggcctcccaagtagctggattacagatgtgcgtcactgctctgggctgcactggtggtttttcaaaccaccgcaccctcccccacctcagggcctttcacatgtttcctcttggaacacactgtccccagtaatttgtacctctgcaacctaggtttccactcagttgctaccttggagttcttcccaattgcactagcagtatttggtttgttccactgttcctcttcactagagtgtttgctccctgagatcagagataccatcttagtcattgctatacctctaggggacctagtcatcactcagctggttgataaattaatcatatgatttggctgtaagagaattacattgtctaactgtctggacagagcttgaatcccctcagcagtctgaccgatttagagacagtccagccttatctgagggaagatcgaggacaaggcccgcagggtctttgaacggctctctgtcatgccaggtcttctttttgtgatctgcatcttctgcatgtggctgtacatgcttcctgggtctttcataggccatccattcacattttaagttggctctcatgtgcctccaagtctgctttgaggctgacaactctttttcctcatctagccctcagaagtcctgggagggaagggctgctgatttgcaaatttgtcctttatagccttaagttgatctgaaggtgccccctctgtcagaggcttgtggtgcactttgagaaactggtaacactgcctcactattcaccatcccaccttcattcagttgccttttattaagatcttactgtggaccaaggtctctgttaagcacatcatgtacctgaatccttatgttaactctgattggtgtggctttggctgtacgtcagagcagaggacatggccaagaaagggcacctcacattcccaggtcacagagctgttgagtggcaggtctgaggcctgagcctggctctgtctgactgaaggtgcccttatttgctgtgcttcatggcctcttcacacctcatgagtgttttttaacttttataacaaaacaattagcatgttgaaaacgctcagtagttcatctagtacctagaggggattgatgatgacttgctattgctatacgccattaagtcaagggaccttattaatggtgagtgtgccccatgttaattgccttagagtacccggagtaaagatgaggtgttaaccacattttatagtcacttgtaacagtttattatttcttaggtatttcatttgtcatttgtcttcatattatatatgcttaaaatgttatttctagtctgggactttttaaatgatgcaatataattaattttttttaaggaaatgtgtgtttaatggtaggtaaattgtgacgcacattagatataacatatcttttcttaaacttatcaggaactggagaagatgatgactatgttgatgattttaataggtaagaaaaactattgggcaaatatataaatatatacgttatttgtaaacaatttccgaacacagacaagacaaaattacatttggtgcttattttaatgtatttgattctgttgttcatattgattgaagatgaagaaaagatagttaatccaaaattaaatatttgattttagagcatgtttttgattttacattagaatatagacagtcacattatgttcaggaaacttggtaagaagaagagaaacaattgaagaattaactgagaagtcatttagaagcagttcagttgccgtgtcataagtgctgattttctcttccttccatacctttttgtggcgggaattgtctcaaaattgacctaaaataattatgctctcaaattagttttttgattcagatcacatttcctaatatgtggatatgtggtctgccctaataagattgccattctctttttttttttttttttttttttttttgagacagagtctcactctgttgcccacgctggagtgcagtggtgcgatctgggctcactgcaacctccttctcccgggttcaagccattctcctgcctcagcttcccatgtagctgggcttataggtgcgtgccactacgcctggctaatttttgtatttttggtagagacagggttttgtcgtgttggccaggctggtctcgaactcctgacctcgtgatccacccacctgggcctcccaaagtgctgggattacagacgagaaccaccatgccctgtcgattcctttcttatacacagaaagataatatgtaatgtagaagtaatatttgttgtggatatgattcgaaattttaaattagatgcctgagaattttatttaattgacaggttatctttccaattggaagtctgtatttttttttataatttattatacagtttttgagaaagagcatgatgtagtagatgaaattgtaaaaatctgggtttgtttctttcttgctattgtgaccaaagtcactgctttgaacctttgtctcctcatctgttacattgacttgactgctgctgcccttgctacattattttaagggtcaagcaagacaatatgtatgaaattaattatagttaatattatattttacttaaaggattaaaagaaatatctgaatgtttaaagaatagtaatctctttaaatgtttattttcagagttcttatttttttttccccttctgaaattagtaccagccatcgctcagagaaaagtgagataagtattggtgaagagatagaagaagacctttctgtggaaatagatgacatcaataccagtgataaggtatggtgttctgcatttcccatagagtgctttttttttttaacctatttgtcgatttactgtaaagcttcaaaattcatactaattagtagaaaaacagttgaaaattatgaaaagtcatgacagagacctggctcgagtttataaagaatgtctttgatgaatgtgtaagattggttttggttgtcacttcctttggtatgcaagtctcgctgctgaaatgcctgaggattattcctggggcactgggattgctgtggattaagagggatcagggtgggtcaggcttagtgagaattgaccacctggtgccataggtggaagtcagtatagggtactgtgatcacaggaggaagctgagcctggagtgcagagagtgtggtcatcttggccagttgtgacatctgaacaggcaagccagactgggctaaaatccacaggagacaagacagtaggccataaagttagagtccgtatttgagatccaaactttacctttttatgtgggtggagaacagaagatccttcgatggtgagctgtagcattgcagggtcacctgtcagtacccacttcaagctgtccccagctcagaggagtctaccagtcaggttggaggttgccatggctgggtggggacttgctttccagaacatggtgggattctccaagcgctgtgattgtcacacagggagaaggcctttgagagaggtagcgtttacaatgcaaccacacaatctaagtcagcagcatccgtgtttgcattcttattctttcatatattttcttatttaagctttaacctttgactctcagtttctttacttgtaagatggaagtattaatacctatgtgataggattattttgaaggttaaatgataatatataaagcacttctctaattcctgatgtattatatacccttataattataaatttagctttctcttttcaccctgcatcatcctaaagaggcctgaagaatgttgctttaaagttataccaaagaaactatgaaggattctttaaatatgagggagaggactcgaagaaatgactgttaaactaggatttgtgaaatgacgtgggttgaagaggaggtgtggcatccctttgccattgggggccttggatggcgtccaggagtctgggctttgttagactgcttctcactgggtcctactcactgggtttggcacatcaatgttcctaggagttttcacttaaaagcttaaatttagataattttgccatttacatagattggattttgacagtcactgtacttcatcaggaagcattttctaaagccttctgtgtagagaattgctactgggcacctggggaacacaaaagcatttgtattctttgcagtaagaatacagcagacaatctggtcacctttcagccaaggtgaccaaaaccagtgtccattaagcacctactatttagagagcacagggctggggatgtgggggtgtgaggaaggagatagcccagtggaatgggcaagttctgtaagttcatcacatctgggtttgagttctggagctgctacttaccactcacaaatttggccaagttatttaacttttttttgttttttttttttttagacagagtcttgctctgttgcccaggctggagtgcagtggcgctatctcagctcactgcaagctccgcctcccgggttcatgccattctgctgcctcagcctcccgcgtagctgggactacaggcgcctgccaccacgcccagctgattttttgtatttttttatagagacaggacttcaccatgttagccaggatgatcttgatctcctgacctcgtgctctgcctgcctcggcctcccaaagtgctgggattacaggcgtgagccaccgcgcccagcaagttatttaacttttggggccttgggtctcacatctattttgcaagagagatggtggtagtgaaaattagagataagcgtgtaaagcatatagctcagtgcttagcagaacaggcattcaataaatggtatctaatactattattcattgtagtcacaatagacatttctgtcgtaggcacagatatagacttcttccctcaaatttatgcaggatcagagagagaaaagccatgtacacaaacataggaaaatcaagataaaaagtgacaggtgccataaaatgccagtcattcatgggccatgaaaattcagaagcaggaactaatatttgaccgggattttgaaagatgactctgacttggttctgcgagggctgaggaggaacatggtaagctccatgagaacagaagggagatcccgggacatgtcagtgctgccctgattccagagcttcactggagggtgctgtgtgaagagacagaatgttgggaggagcagggttgttagaaggtgactttgaaccagaaatgacagaggatgaactaggagcagaggccctggggagggtagtctctgcacgggagccagcacgagcaaagacataggtagatgttggaggaagagggccacacgttcctaagggacagaacataagtgtgcatcccaggtttctgttaatgcatagcaatctaattcagcaaacgtgaacatttacacttcataaaacttttcaaaatcttacaagttcccgtcgatttgtatgaagcttgctatcacagggatcctttgtttccctttcaagactcaaaatgtacgttttagatatttttattttgtgatgtaaaatctatttttatagttttgaactaagttggtcactttgagttcttattctaaaactaaggaggcatgaaagccgcctttattagttttgtttttgtttttgtttttgtttttgagacagagtctcactctgttgcctaggctggagtgcaatggctggatcttggctcattgcagcctctgcctcctgggatcaagcaattctaccttagccttctgagtagctaggaccacaggcatgtaccaccatgcccggctagtttttgtattttgagtagagatggggtttcacctatgttagccaggctggtctcaaactcctggcctcttgtgatccccccgccttggcctctcaaagtgctgagattacaggcgtgagtcactgtacccggcggaaaggctttattaaatagccatttatttctagttagcttttgttcattcagttttctttcttggtaactactttaaatgaaactgttcttcttggaagtttctggttattattgtggtcttttctttgccttaaagcaaaactaaattaatgatctccaataactgaattatctagattaagatcgttttcagtccacgatttttcctgtattcactcttgtctgtagtttagcatttgtattaatataacactcaattactttgtaaacgagatggaataccttactgatttcactctgtaataatgatgggaagagaaaattacagttccaaggtatcagtttgttttacagtctgtctgcaagcttttctgacttttcagtttttgtgtaaattggatttgaattgaatgcataagaactgtaattaagattcctaataattttctttgtgagatagttttacagcaggactatgtttggaccaagagaaagggcaaggacttatttgttgaaaaggattttacttacaacctaaatttctgaatatccgaagaataacaaaatgagaggatatgtggggggcagatgaacagacaaataaaagcatctcacagtatctcgggatgaaactgttgcatctctacaagatgttcctattcttgtgcgttattacctggcccaggtgttggcacacttgttctctaaaaggccatatagtgaatattttaggctttgcaggccataactactccaccttgccattgcatggagaagacagccatagacgatgcctaagagtgtgtgtgtgggtgtggctgtgactgtcccctggtctgttgccacaacaatgagtctaggtgggactgggaaggttgggttctgtccttgttcagctgtcagtgggacctgcccagctgtatgttctatattctggagcctgtatattcacccgtggttttttccttagttaagaaatgttttcccagcctgcattatgcttacatatctattaatatttcctttctccattatcatgagttgtttatacaaatgaatagatataagttggttaataggttaactttctagtttacaagtagtttaaacagaagtagaaatgagtcgtttcttacaacactttgtgaacccggggctgggagtctgagactccatgggccgtcctgtctgcccttctgttttcacttcatgatctggcttcaggtggcacagtgttaaagtgtgtcacaccatgtcgagtttgatgttagaaacttaacgttctataccgtcatatgaaaacataagaagggatcgtttccaaattatacattttaatgaattttcgtgaaatttaacgtgggtaaattatggttttagagttagcaattcatagagtgatacttcctgtgaacagaatcatacattgggactatgctcaggtaaagaagtttaatacagtttttcactaatttgtttcttagattaaattggaataatggctaagatgtgttttattttaaattttcacttgaaatatttgagaataatcataaaacattgggctctaaagattgtactaacttagtagacatgattttaggcaaatcgcttctcaacacagctttaaatatgagttggtttatgaagtataaagtaatactttacagcaacagtttttttaatttttagttttttatttcttatttccataggttttgggggaacaggtggtgtttggttgcatgaatgagttctttagtggtgatttgtgagattttggtgcacccatcaccctagcagtacacaccgggcccaatttgagccttttatccctcaccctcctctcattctttctctggagtccccaaagtccattgtatcattcttatgccattgcatcctcataacttagctcctgcttattaatgggaagatgtgatgtttggttttccattcctgagttacttcacttagaataatggtctccagttccatccaggttgctgcaaattccattattttgttactttttttttttgagtcggagtctcgctctgtcacccaagctggagtgcagtggtgcaatttcggctcactccaacctctgcctcctgggttcaagcgattctcccgcctcagcctcccaagtagctgggactacaggcacccgctatattgtctggctaatttttgtatttttgtagagacagggtttcaccatgttggccaggctggtcttgaactcctgacctcaggtgatccgcctgcctcagcttcccaaagggttgggattgcaggcatgagccactgcgcctggcctatttgttcctttttatggctgagtagtattccatggtatgtatataccacaatgtctttatccagttgttgattgatgggcatttgggctgggtttcatgtttttgcaattcggaattgtgctgctgtaaacatgcgtgtgcaagtatctttttcatataatgacttcttttcctctgggtagatacccagtagtgggattggtggatcaaacagtagttctacttttagttctttaaggaatctccacgctgttttccatagtggttgtactagtttacattcccaccaacagtgtaaaagtgttcccttttcaccacatcttcaccgacatttatattattttttgattttttgattatggccattcttgcaggagtaaggtggtatctcattgtggctttgattttttaaaataacttaagactactcacattctgacacttaattattttctttcttttgaacaacaaagcttgatgacctcacacaagatctgactgtatcccagctcagtgatgttgcggattatctggaagatgttgcatagacacgaagaaggaagtattctaattaacaaggacagaggactgaccggttccatttttttttttttccagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgcaaccctttgtgtgtgtggctgctggtacgtgtgatctttgaaaaccttggctttagccctctggaatcagagcttacccaccatagtatattttgatattaggtggttctacacatagttggcaaaatgacttggtaaatttgtaatgctgaagtatattagtataagttaaatttgatgtgtcaactttattttgtatttccttccatttggaaggtttgttagaccattaaggttatattaaagtactcttgtgtgtgctatttagttttgcttgttttaaagaaatctagaagtggttatgagttttaattcatagaattgtcaataacataacatttgcaatcgtcattcctcctgttatccatgtaagcagctttagtcgtaggttctcttcattataatttattatctgtaaagattccttgaaacttattcagtaccaaaatgcatctgaaaccattaagcagtgcttttatttcagatctgtaagttaattgtattaaaatccaaattggaatgaaatagtagtaatggcctaagaccatgttcagtttgacaagctttatatactgtacataatttcattgtaacccttaaaaatagagccaataatagaatttccacagtctcatttatacggttaaagcattattgctattatgtaggtcacggatgtttataatactaaagtattttaaaatgtgcaagtagaaaaaacagtagaaagtgatgcatgcatatttatatataagtaaagcaggattgtgctgtttttgcactttataatttcaattaagttgcggctttttactacaagttaactttattagtaaaaggagcaaattagacctaattcattgatctcggttaagtgagcagactgcatgacttgtgtaatgccagtttctcatttcatattagcctaaatattacagaaattactccttgggctctaaaatgtagaggaaatgaaaatgtaaggattaaggctgtgtaacagaatctggctttttaaaatttaagtgaaactaagctgtaaacatcaagaggaagtaggacataaactgggccggtacagcctgggagccctgtgtatttctgccctccgtctgtgagctgctatctcagtctccttcagctcttcatgtcttagtaaacagcaccacgtgcagatgtaatcttgttgcagtcccccagtgtggttgttataaaatgcatttctttgtaagtcatctctgtaaacagtcactttctaaaagcactatagttctggtcccctggaatctggatcacatgtatgatttatttttaatatttgataggaactaggtttcagtgaaatgatttgaaagcatagcaggatgtggctttttaaatttatgaaactttcgaacagtagcaactgaaatttgtcacttttctgttacgcagagaatcagaccttttgataatatttgggagggtaaaagaaatatgccaaatatgaaacttttttgtcagcactacatacatcttttttttgcggggggcgggggggacagagtctcactgtgtcactcagactggagtacagtgatgcgatctcggctcactgcaacctccgcctcctgggttcaagcgattctcctgcttcagcctcctgagtagctgggattacaggtgcacaccaccacgcccggctaatttttgtatttttagtagagatggggtttcaccatgttggtcaggctggtcttgaactcctgacctcgttcctgccttagcctcctaaagtgccgggattacaggcgtgaaccaccgcacctggccagtactacatccattttattgaatgattttgaatgacttaaagttcaactatgaaaaagctttcttttcacatgtactttttgattaggtattatcaacttatgaaacttgaagatgtgaagtgacaggttttgcatgtgatgagtgttttctgttaaaaaataaatattgaaatattaacccattaaatacatttttatggtaacctatgttttacagtggagttttaaaaatgctaggtctttctttcattttattgataactacaaatgaataaaaagcatttattctctttgttgatattcggttgtgcttttatactttatgttggataacaacctgtgggcagttgtgtagatgccattagtccctgcctcatgcttgcccacagctcttcctcccctccttacttccctctcctgcccatgcaccagagctgtgccagcccactgctgcacagcctctgcacctgagcttgccaaagcccttcctgtctcaaggtgtgatatttgcccctccttgtctggaatgtccttcccctagaactgcatgaagctggtttatttcagtctcatgttcaaagacgcttccagacctaagggagatgtccattctcctccctgtccctgccccaccacttgcatttaccccttttattttattcatctcagcatactctgaaatggtcttgcttattttgtgtgtgtgtgtgtgtgtgtgtgtgtgtgtgtgtgtgtgagaacagggattttcttttaaactgctgtgtacctggcacaacatttgtcccctagtatgagcttggcatctttggggctgtaaacaggcttgagcactgacatggggcctggagaatgtggtttctggctaggcagctggaacaatctacaaaatctgaggggaaagctgtccttaccctaaacctggggaggtccctaggttcaagtctgcaggaaggggatctggttcaggagaaggccgtcctgtgaatttgccccacccaccaagctcagctggagcagggcctctgaaggaggtgccctctgtgtggctctgctgtggtgttggttcatgaaggacatgggaggggggcaggacaggagaggcagctcttcctggagaaaaacacacccagcccaagttggagccctcctgtggcattgggtggggaggattcccgccatcagttctctgtccatgggtgctagtctcacccctgccctccgagcagtccgtgctcccagtgtccctgtcctcttttttttttttttttttttttgaggtggagttttgttcttgttgcccaggctggagtgccatggggcgacctcggctcactgcaacccctgccttctgggttcaagtgattctcctgcctcagcctcccaagtagctgagattacaggtgcctgccaccatgcccagctaatttttataatttttttgtagagacgggatttcaccatgttggccaggctggtctcaaactcctgacctcaggtgatccacccgcctcagcctcccaaagtgctgggaatacaggtgtgagtcacggtgcccggcctagtcttcctgctctaggaagggacgtgtttggggaggaaatccagggcagctacctttgtgagttgtcctaatgctgcgttcagagttccacacgttcaacaagcatctgacatttaaggaaagtgaatgtatgtcatgaaagacagatgaacaaagaactgatcttgaagaaaatgtaatcaggaaacgagataattcaagaacaaaaacctgtgaaggactgaatgtgtcccccaaaatgtgtatgtcgaaacctaatcccacataggatggaattaggtagggcctctggaagttgatgagatcattagcgcccttataggaggcccgggagagctgctttgccccttccagcgtgtgaggacacagtgaggaggtgttgcctatgaggaaacaggccctcccagatggtgaacctgccggtaccttgatcttggacttaagccatctgagctgtgagccctacacttccattctttataaattatccagtccaaggtactttaggaacctgaatggattaagacaaacctgattatgccactccgagatttgaggtaacatttgaatctaaaagaggctatatgaaagaggttataataaaaatgatttttgactaaaaaattgttggcctaagataattcagtagcagggctgaataatgggatgactcaaaatcagtaagctcaaaggcaatttcaaagaaatctttatgtttagcaagaagaccaagatgacaagatgcgccaggagacttggccagaggacctccaggctgacaaagtttccccgaggaagtcagattggaaaagtgtcctcaggttcaaggaaacctgggtgtgcaccgggtgaatgagagtggcagacagaaggaaacagcaaggcctctgaggtaggagggacagcgtttttgaatgtgaaatttattccctgatacatgtttttaaaaatgaatcttgctgcccttagaaaatgaacccccgaacaaggtaaggtcgagctggcccctcgtgtcatccgactttgcgttgtggccctgcctgcagaaacgtgtgctctgctacagccctgggaggaggggccgggctcccaactcctgccccgcttctagcacatgctgtgcttggccacttctctgcctcttagtttaacagcagcactgggcaaggtttgccctctgcacaccagaccggcttcccaagaaccggggaagaggagagggcatgcctggggcctgagcttagtgggccgggtggaggcaggaggtactgcatggaggagcatggacagtggcatgcaggaggccagtcattctgcggttttagctggaggtttgtttttggtagtttgtagaatcatcagatttgatgatgaaactttttttccataaatgttaaattttcagagcccacttgtatttttttttttctttttttttttttgagactgagtcactgtcgcccaggctggagtgcagtggtactagctcggctcactgcaacctctgcctcccaggttcaagcgattctcctgcctcagcctcctgagtagctgggattacagatgtgtttcaccatgcccggcgaattttttttgtatttttagtagacacgggatctcaccgtgttggccaggctggtcttgaactcctgacctatggtgatccgcacccctccccgccccccccgcggcccagcctcccaaagtgctgggattacaggcatgagccactgtacccagccctgtattttctttaaaaaccaattttgggccgggcacggtggctcacgcctgtaatcccagcactttgggaggccgaggcaggcggatcacgaggtcaggagatcgagaccatcctggctaacatggtgaaaacccatctctactaaaaatacagaaaaaaaatgagctgggtgcgatggtgggtgcctgcagtcccagctactcgggaggctgaggcaggagaatggcgtgaacccaggaggcggagcttgcagtgagcccagatcacgcccctgcactccagcctgggtgacagagcgagactccgtctcaaaaacaacaacaacaacgaaaaaacgattttggcatgttttgtaagttgccagactattggatatacctcttaatcatactttgtttgaaatcctttgtggtttctaaagcactagtagctttctgaaaggaaaatttttaatgaatgaagcatgcttcatcctgcacatcccctcctgccccagcacccctactgcccatgcgcctctcctgccccagcacccctactgccccagtgccaggccttttctagcagctctcatgggttcatccctgctgcgggcattgctccaccaaggggcagtgctctccctgccggtaagtgttggaacttcacgtttccctctagttttctctttacattttaacatatactattatgtgtcaatatattaattatatattaattacatttatagaggttaggtatatatggcagatcatatctgagcgtgaattacattctccaaatttttatttgtcatgatttattgcagggttcacttatttgatctaccccaacttaacacacatttccaagaaaatatccatcacactagaaagaaagaaagaggaaggaaggaagggagggagggagagaaggagaaaggaagaaagggaaggaaaatggaatggaggaagggaaaaatggaaggaggaaggaaggaagggaaagaatgaagaaagccatttgttcctgcaaacctaaacctctttgtagtaagttctggcagaaggtgtgtttctggagttaaactacaggcttggaaatggaatttcttagcctaatttctaaattagaactgcttatgcaaattaacactccgtacatttcaacaagcagttggctgatttcttctgtccactccacctgcagatgcagaggtggccccatcctgtgatgtgccaccacatcccttttcagtgaagggctttgttggctgctgtgggcattctcatggcctctccagggatggcctccactgtagagacctatgtcaccaaggccaggccctctcagggggctccatccaacgaccattctgcctcagggtaagaggcccggccctctcagcctgagtccattctggctccagagctccctgagagcttgcctggcaagttactcttgcaattctagcttccagcaggcgttgatttctggggcacttttgataaactcctggcaggaaactcaatctctgggggtcagagtccacttcctggggagcccaatctgtgacccctaggagtggggaccatggaagcacttggctctccagcatgtgctgaatagggggcgctgcctgcagtgtccacgtggaaacctggctgggagaatgcctgtgtgctctgcatggggatgtaaaggtgtgagcaaaccttcttcagagaggggatgttcaatgcgaaatttgaacattgggacctgaaaaactgatgggctgatggggtctgcccatgattggcagccttcatagaatcacgagggaagagcacaggccaccctagacaggaggggtcccctactgacagggaggtgctgtcggggcagcaggcacgtgcaggaaaacggaaaagcagagtaattgaatgtaaatcatgcaactccactacagtggctagaagcctggatgggcaacttggctgagtgatgttgggcaagtattctcagttttctcatctgtaaaggggattaaatacttccttcccttacagggctgccctggtcttaagtaatgcccacagagagcttagcattgttcttggcaagtcactagtactcagtaaatactatttttattaagaaggtaagattcacaggacttagtgtcttaactagatgttgagagtaaggagaagagagaatacttctcggatgattgttcagtttctgatgaatgtctgttcccctttcaaaacctaattcagatgtcacttcctcctcaaagctctcgccccgcgccgagctactgtgatgtatttttatgacctggcagcttttttctcatatccctgttagcggtatgtggtaagaacatgagacacagaatcagaaaccatggatttctggtcttgactccactaccactcagaggaacctcacggtggatgccgtaagtgtttacactgaaaaggattttcacgaaaacctgcattttcatttcgttcacaagagaattatgagactagaaaaacaacaattcttagtataccacagactgtggtgcctaggaataacagacaagctttaactcacacaatgagcatctttatttagctctgcttttagatatctgcatgataaagatgagtgatccaatgttagaaatcatctggacattaaaactgaattgtaggcaggcgtggtggctcacacctgtaatcccagcacttacggagaccgaggcgggcagattgcttgagctcaggagtttgagactagcctgggcaacatagtaagacccctatctctacaaaaaatataaaaattagctaggcatcgtggcctgtgcctgtagtcctagctattgaggaaactgatgcaggaggatcatttgagctcaggagtttgagaccattctgggcaatacggtgaaaccctgtctctacaaaaaaatgcaaagattagctaggcatgatggcacatgcctgtggtcccagctactcgggaggctgaggcaggaggattgcaggaggtttgcttgagccggggaggtcgaggctgcagtgaactgagattgcatcactgcactacagcctgggtgacagagtaagaccctatctcaaaaaaaagaactaattgtaacaaactatctttcaaattatatcaaaacagtgattcataaattccatgttgcccagagatcatgaggagctcttctatgatttgacagtgcaattactgaaggggaagacaccatgcaaatacatggtaaaaatattcaaattattactgatttgacacaaaatattgatgtaaataacataaaactgtaatatgccattatgatgacattaatgaaaaattggttaatgaatgtcattgaaagagcatgtacatcactaaatgttcttagtcactgaaagtgtgaaatagcctctaaactcatatgtggaaaaagaacttgaaaaaggtttccagaaatgtgacaattctagtactttcatgacattttaaaaaagggattgtaaagactgatgaaacccttaaaacctctcaagaattaaaaatcatttttgatcaacagagtaaactgattttttatctctgttgaaagatatttttaaaatcattgtcctatggaaaagtcatatagaacgtttgctgtttaatgtagcacagatgtatcaaaaagccatgccaggcagttatagatatcttagttttctggattttgtgacgtttgtggtatttgtcagatttttaaaatttgtgatttgttgggatttgttcctcattcacaggtaattttatatacttttgtattcactttcgaaaagaaggcaactctaaattttatgaacttcaagtgctataaaacaattaccacagtaaattttgaaaaattcaccccaaaaagaaaccttgtatccattggcagtaactccctatgctccgccattcctctcagctccctgtctggcaaccacttcctgtctcttcagagttgcctcttctggacattacatataaacggaattatacactatgtggccttttatgactggcttctttcacttagcataatgttttcaagagtcatctgtgttgtagcatttgtcagtacttcatttatttttgtttcctaacaatactccattgtagggattgaccacactttatccattcattggttgatggacatttgggttgtttccactttttctgctgttgtgaataacagtgctaagcacattcatatgcagtgtttgtgtagatatataatatgctttattttctcttgagtacataaaagtggagcctctgagtaatataataactctatgtttggtgttttgaagaattgctaaattgttttccaaagcagctgcaccattttatatccctaccagcaatgcatgaagcttccagtttctccacatcatcacgaatactccttattctctctctttttagatatagacattctggcaggtgtgacattgtatctcttgtggtttagatttgcatttggagcatgtcttatgtgcacttaaaaatattaatatctattctgctgttgttgggtaaactgttctatagatgttgatatggcttcgctgtgtccccactcaaaatctcatcttgacttgtaatccccataatctccatgtgtcaagggtgggaccaggtggaggtaattggatcatgagggtggttttccctactctgttttcatgatagtgagtctcacaaggtctgatggttttataagcatctggcatttcccctgcttgcactcaggctgtcctgccacactgtgaagaaggtgccttgcttctcctttgccttctgccatgagtgtaagtttcatgaggcctccccagccatgctgaactgtgagtcaattaaacctctttcctttataaattaccaagctgcggctatttcttcatagcagtgtgagaacggactaatacaggtgttttttaggtctcgttattgtgtcattcacgtcttttatttccttgttgatcttactcttagttgttctatccatcattgaaaatggggcattggccaggcgtggtggctcacgcctgtaatcccagcactttgggaggccaag

SEQ ID NO: 1925 - DNA, 1849 bp, Homo sapiens
cggccgcgtagcccgcgcgcggagcgtaccctgctgcggccgttggccgttagcgcggcttcggcggttgtcttggagaagcaagatggcggcgacggcggccgcagtggtggccgaggaggacacggagctgcgggacctgctggtgcagacgctggagaacagcggggtcctgaaccgcatcaaggctgaactccgagcagctgtgtttttagcactagaggagcaagaaaaagtagagaacaaaactcctttagttaatgagagcctgaaaaagtttttaaataccaaagacggtcgtttagtggctagtcttgttgcagaatttcttcagttttttaaccttgactttactttggctgtttttcaacctgaaactagcacactgcaaggtctcgaaggtcgagagaatttagcccgagatttaggtataattgaagcagaaggtactgtgggtggacccttattattagaagtgatcaggcgctgtcaacagaaagaaaaagggccaaccactggggaaggtgcacttgatctatctgatgtacattctccaccaaagtcaccagagggaaaaacaagtgcacagacaacaccaagtaagataccaaggtataaaggacaaggtaagaagaagacaagcgggcagaaggctggtgacaagaaggccaatgatgaggccaatcagagtgatacaagtgtctccttgtcagaacccaagagcaaaagcagccttcacttactgtcccatgaaacaaaaattggatcttttctaagcaacagaactttagatggcaaagacaaagctggcctttgtccagatgaagatgatatggaaggagattctttctttgatgatcccattcctaagccagagaaaacttacggtttgaggaaggaacctaggaagcaagcaggaagtctggcctcgctctcggatgcaccccccttaaaaagtggactcagctccctggcgggagccccttctttaaaagactctgagagtaaaaggggaaatacagttttgaaagatctgaaattgatcagtgataaaattggatcacttggattaggaactggagaagatgatgactatgttgatgattttaatagtaccagccatcgctcagagaaaagtgagataagtattggtgaagagatagaagaagacctttctgtggaaatagatgacatcaataccagtgataagcttgatgacctcacacaagatctgactgtatcccagctcagtgatgttgcggattatctggaagatgttgcatagacacgaagaaggaagtattctaattaacaaggacagaggactgaccggttccatttttttttttttccagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgcaaccctttgtgtgtgtggctgctggtacgtgtgatctttgaaaaccttggctttagccctctggaatcagagcttacccaccatagtatattttgatattaggtggttctacacatagttggcaaaatgacttggtaaatttgtaatgctgaagtatattagtataagttaaatttgatgtgtcaactttattttgtatttccttccatttggaaggtttgttaga

SEQ ID NO: 1926 - protein, 399 aa, Homo sapiens
MAATAAAVVAEEDTELRDLLVQTLENSGVLNRIKAELRAAVFLALEEQEKVENKTPLVNESLKKFLNTKDGRLVASLVAEFLQFFNLDFTLAVFQPETSTLQGLEGRENLARDLGIIEAEGTVGGPLLLEVIRRCQQKEKGPTTGEGALDLSDVHSPPKSPEGKTSAQTTPSKIPRYKGQGKKKTSGQKAGDKKANDEANQSDTSVSLSEPKSKSSLHLLSHETKIGSFLSNRTLDGKDKAGLCPDEDDMEGDSFFDDPIPKPEKTYGLRKEPRKQAGSLASLSDAPPLKSGLSSLAGAPSLKDSESKRGNTVLKDLKLISDKIGSLGLGTGEDDDYVDDFNSTSHRSEKSEISIGEEIEEDLSVEIDDINTSDKLDDLTQDLTVSQLSDVADYLEDVA

SEQ ID NO: 1927 - DNA, 71864 bp, Mus musculus
  misc_feature (1)...(71864): n = A,T,C or G
gagaaggcctggattaccatgaggaccaggacctcattctgaaatgagatggtaggaccagttgggcaactctggacgaaccaaacccctcttgacttgtgaattctaattcacatgttggagatcaaacccagagtctcatggaaactgcacaatgtgttctttcactgttacatctcagctctcaaagggaggcttcgaatatgtgaacaacgtcatagttgaagatactttagtgatggaaatttctagctcaaattgaagcatatagaagaaatcagaaagaatttacagaaattcatagagtgaaggaagctgggaacgtttgttttctttcagctttgtgtacttactacttaccccctctttaaaaattaaaagtaggtattcctctagaaaaataactattttacacgctgaggaggagcggggcttttcacccagccctgctgtgtgggatcctggagcagtagcgcttgctctggcccagctctggcctcctggaatacactcctgcccatgtggctgtggtggagtcccaagaccctggctgccagcagtctctggtagtgagtgccccagctacggcagctgcagctgcggcttcctccgcttacatggcttcctccacaggccactcacaccacagttgctgcttgcaccttccatttctgggcagctctgcctgtaagcaggctcttccttatttggaggtagaatctcaccctggctgccacctttctcagcttgagcccctttgaaccctagtttctggcctgatcaaagggcccctcgaatgccattcggaggtcatgaaaagacagacactgtagcccagggcatgtattggtggtcacttcctcatggcaccaagtataggagcttttgatctgaaagcacagtgaagcagagtttccacattcagtcttcagagcatcaccaggaaactggaattccatactgagctcagatggaagactcagacctcacagagcaggaggaaatgactattgtcaggagtgacatgtcatggcaaacttcatgaagatgaatttctattcatcctttacatgatgaattccctgatgctcttcccattttaaaggaaaagaaactaaggcttagaaacataatgaacttcagtttccacactgacatatttggagaattatattaactcttcattactataacatgtactcgagataggtcacttcaacagaggtttgttttgggcatacagttttggaagtatagggcccaaccagcatagcacaggccctggtgcaccacaccatgatggcagtgtgagtatctctgactctgctctttctcctctctctataaagccatcaggagacttctattccagtgatcaaatcaaacctaacacttctcaaaggccacagaaggatcatgtttctatttcctcacacaatttgtttgtaaaggattcatttattttgtgtatgtgtgtacactgtcactttctccagacacaccagaagagggcatccaatcccattacaaatggttgtgggctaccatgtggttgctgggaattgaactcaggacttttggaagaggagtcaatgttcttaactgctgagccatctctcccgtcctcctcacacaattgataggtgtcttagttacttttctactgctgtgtagaggcatccaggcctatgtctgttctccaagctgcagtttctggttgctccagatgactctggacatatgactcaaaagatggctgtgaagtcagtcttatgtgggatgtcttgcagaatgggcatcctgctctgcatgttcctcctcctttaaaaaaaaaataccacacttgtatcatggcagaatgggttctctctttctatcttgtgagtcctggattgaacccaggtcatcaggtttggtaccaggcacctttacttgcggagccatctcactggccttttctttgatacaaccatataaactaatgcaggggattctgagagaaacctaagctgggcaggaaactagaacagacattcttcctggtctttcttctcttcccagatttgtggtaggtatccacatagctgactatgatagtccttttcagggactctgaccttctggggacagattcttctactagttctgggaactgaacctaggaccttgaacatgccaaaccaagggtcaggtttctgtgtttgttatttggttgcttccaatatggtcttgtagtttagcctagactgacctagaactggcaatcctgcctctgcattctgagggctgacacgacaggctgcatcaggatcagttttgattggaacatccatctctctttcccagaggtaatctaatatctctgtaggttcagagagctccctggcctagtcccagattcacccagtccttcagagaagctgaatagctattcttggtaggctctgtgggggttcttcaccttctccttgtcctctcagtctcccaaagtcctcactgccctggggccaagagaagtccatgggtagcatgcctgtcaccatacatcaaaggaggctagaggtcctgagctatccagagatggccagaagtcaaggagccctgatcctgggagtggcagagtgaagtcagatggttgacacctgtgcatgtataccagtgcacccttccttacattagaggagtctacatgtcctgaacttgcaacatgtcataattattttgcttatttacagagtcactttctagtccaggctggcctcagacttgtagcagttctcctgagtgctgagattataggggtttgccatcatgctactacagttttttaaaaatatttttatgtgttgaatataggtagactccttcccgtatctctgtgtatcagagtgtttccactttgaggcttctgtttgcagcctgccactgtttgacatggctgggcccaggcctctcgcactcttatgagtttggctgtaccatctttttagttctttccaagtcctccccctatcaaaagataaaaagtctgtgactgctgtcaggcctcaagaagcatggccagggcctggtctagcatcccagacttgctggttttcctccgttccttgggccctgaaagagaggcagaggtaggcactcacattgtacccattcttgggcacctggggttgactgacagtatccaggtgaggggcagctgttatggcagcccagcccagcccagcctaggtgatgtgtacacatggggacttgacagtgccttcctgatacaggcactcaacttttcttccagcacagggcttgattgaatttctggaaacttccaaacttattatttaggggtcagtgcctgtagatgaagcctagaggaggaagaagaagctatttgggctataaggggaaagagaggaggtctggtcagctggaaatgaagaccagataagtgaggaaggaaagagagtaagagccagtgaaaagggagaggaagacagggagcagagagagaaggggacagaactgtggcataagtggcagagtggatgcctcaagggctgggcagggtctcctctctgtcttacctaggtattctctgcatatccttaggtttgggttccagctatagtaaaggcatatgtggcctggtgaggctgtcctctgggtctggccatgatgacagccagatggtttcctcctttgcctctgggcctctgtagccactggcatcaagcaagtaaatatagaggcttctgaaaattcactcaggcctgtgatagaagttaagttgagcacctgcatcacggcacttctaagaccctaaaaatggagagaagagcttagcctgcccaagaagcaactgcaggggttcagaagtgatgctttagctgcagccagggatcctcgaggcttagaggaagaggctttattttaggttctgccctgtgtgaacctagagtggtgttgactgcctctggtgacgtcatataggctagggacaaaggttggacagacagacacttggtagggagaactacagagggataagatcagagtcaactaagaggaaaggcttatggagagagcctggtctgcattgtcacttaaatcagagatcccagtccagggcagaggcagagatgcacttctgtccctagaagggagcagtggacatctgggcagcatctgctttgctttttcgagcaccaatcctagacacccaactggttttctgatcctcactgtcaagcttgtgggatatggggagggaagtgagctgggaaccatatgaactgtttgaaaatatctcacaaaacaggaattgagattgcccacattcccaatggtatcaccactagtcaagacacaaaactctttgctttaaaaaaaagcaaagagttctctatactcctcccctagagagtgctgctcggcagggggttctaatatgagcagaaatgcacaggttggcagtgaatgcccatgccaccccaggcaggcagggctatctgttgctcactgcagtctccctcacacattaactctacctatcatgcatggaatactctgcagatacatggtaaggcagagctatagcagtcagttagcttggttggtttaagaatacatcagatccacaaggaagcaaggtctgacagctgacctgggtcgacatactcacaaaatgatgatattgaagctcagaggtgggtgggaaggtaacgggttgcccatgttggacccaggcagaagactattaattcagaggacagtcaatggatgagagacctctttggcatgatgaagttagcagatgacaacgagggtgattaacaggtgggaggggtatcatggaggctgaggctgttacctcctgggagataagtttttccatgtcccgtgtctacagcatggacagcagaccacagaagccctttgttagtgtagctgctcagccagtatcctgaaccccatcagactaaagctagaatgtgacctagtgcttgctggcctcccttctgctgccttggtcctacattcaatctcttcgtggcagccatgggttctaatgaagacctaggggagattatgtccttcctgtgcttgaaacaccacagagcccttcccccacccccagtcatgttccctgtaaaacagaatatccttactatggtgtactatgtcctatgggtctgtctttgtccctctttgacatactaaagtatagttacaagctctcctgcccctgggcctttgcttactacctcacctgaagctttccctccagttatctgaattttcaccacatagtctttccagttatgttctgagccttacgcttcctggcattcaatataaaaacacagccctcaccccatattctcagccccttccctggctctgtattttcttaacaccccaagagtaacaactacagtcagacaccacataacatttcactcaataacagactgcatgtaccacagagattcctaagattgtctcctagtggatatgtcttagtttgcgtaaggacactatgatggcacaagtgcctgatgtagttctcagaaggaaccatgttgactgtatatcatttacatctccattctgcttcatgcctgcctggggaggaaaatggaatcactgtctcatttcttgctgtggatcctcagcacagagagcagatctagcaggtactcggcacagacctaccaaatctcctgtagatgaacactttaactaattatgtgcattggtgtattgcctttatgcagttgtatgtgagggtatcaaatcttggagttacagagagttgtgagctggcatgtggatgttgggaattgaaccagaggcctcagcaatcagtgctcttaactgctgagtcatctcttcagccctagatgaacactctttccacttgaaagttatgtgacattgggaagagcatcactggatgttagtgacccagtccctgaaaaggatatttaaaatttccacccctcctccaaatagaatacaggtaaaatttgccccactcgagcaaagcaaacaataaaaaccaccccggctgtcctctgagcccagtcttgtccacttttagcctgaaactctcagcccagggttgtttgaacttctgaatctcagggacacctacttaatcttggttgggtgggtccatgtccttctcttggttttcctaagtgttccctagctaacccagtctttggtggccttgtcctttgtgtcgtgccccctatccccagacttctctgtgctcctgcttaagtccccagcatttccatttttctctagcttccctctcactgtataataaagcagctgttcagatagccataggcaactatgaggcaggttggtcagcctgctccaggaacccagccacacctatgggaaatacccataaactattcctaactcagtaggggccaccgttttgctgtacccaggcaggacttaactagtggaatctgaggtttaagacataggaaaccctcctgccctgtagccctatacctggccatcccttgcatgaaaatgatttgtgctccaagcctgaactgcctgccaccacacagaaccctgccaacagtgtcttagggaacaagccagaggctggactcatgcagtctaaatgtgagttttgactttgtcatttgataaatatagattgagttgtgagtaccacatgctagatacttactgtactgggcagaggtgaatacaacttctcttgacctttctagttgggagttccactgagctcctagataggcccctagaacaaataagtactcctcttttcttggggacaactcacgcatcactacctcatttatttagaccctcctggatctgtgaagagtactcatggctaggtgagtcatgtagcctgactgaaccctaagtttctctaaccccatcacctgtccaataggctatcagttcatagagaagccatgggcgtaacttactcattcaccatcattgattatcaaaacttactgaatctataccaggtaccaacctaccagtgcaggacacaccatggaacaaccagaaaagccacctgccaagcaaatagggaaatttctgccacttagaagtgggaaagtgtttcaggcagagggaccagcatgtacagtaagaaggggcactgtaatgaagccagaaggtaggatatggcatcaagaaagtcatgagggcctgtgtgaagggactatcagccactggggacactgaagagttaggccaggaggggaggggactggagaggtgactcagcagttgagagcacatggtggtcatgcagaaacctggattggtttccagcacccacaaggtggctcacaaccatctgtaacttcagttccagaggatccagcaccctcttctaacctgcataggtactagctatgctcacagtgcatagacatgcatgcaggcagaacacccatatgcataaaataaaataaaactttaatacatatgtattttttattgtatgtgtatgagtgcactacatggatgcctggtatttgaagaggccagaaggtggtgtctgaaccctgggaactggagctacagatggtgatgagcctccattagggtccttggaatggaatatctccagccccactcctacctcatcctctgaaagagcagtctgctccctcccttaagtttttaaatttcaaaataagatttaagagtcaggggagagtcggcctcagtcttccagcacgggcacacattatcatctttatatcatcttgtacacctggccttgtgagtgactgcatagaggaataggtaagctaggaagtgttgtgggtgagtctatgactgttggtggttcccagcactgatttgtgctggtgcccacagcaggccttctggcttctcagtctcaggactgcgtgacagagtcccaggacaggtcattgaagaccaaaacttagcagccctgcatttcaaaggtgaggagattagaccttatcctttaaatctcaaccttggcagaggtctcctttgctcttcaagtgactaaggagggccttattgtataatgggaccagaggaatcccagaagcgccaagcttggctgtaagtgctgactccctgtgaagagaacaagggctctggatagtcactggataaggaaatctggtttgttttttctttttgtctgagagaggatttgaagtatctcagcctcacctcataccttcactatagctgatggccttgaactcttgcctctacctcctgagtgctgggattccaagtcagttctcttatgctcaacttggagtctgtttttaaagcaagacaagggtcaacagatagaacaattgtcatatactccctcttagaactcaccaggctgcaaggagagctgagaagaaacaccaccaccttcaccctagcctagaaggatgggatgaggtgtaggggctatcgagacttctgcatgtgcaaggtggggtttagaagtggtagccactggcccctaagtgtgaaaaagatagctccttcccacagagcagataggtgcctgaagaggaaggggtgtaggggagtggggttgggtaattcatcttggcttgggaaacctggatggatacttgaatggatgtatagattcattaatgaatggatgaattgaaagggtgggctgcatgggtggcttagaaagggctggctagcaaaactctcggtttgcaactaagtgtggcctttctatcatgttcccaggggtctgactttagtgtggtggcagttgtcaccccactcccctgccaggtccaggtccagcctcaaaggtccaatcttctttgtttcatcttattctctggccatcttcaggcactaccttgctgcccacctccaagatatcctgggctcaaccagtgttgccccctcaaaaccctgagcccctgggtctgtggggtccgtaagtgctaggatctctgaaatgcatctctggtgcaatgaaaggaggcacatcacgaaggtccctacctacttgtctacacctacacacacacacacacacacacacacacacactcccacacgtcattctgtgccccaaccccagcactgcttgttcgcaccttaaacagctcttctgctccgtgggatcctctagggccagcttctgcctgccaggttgcagaccctccgctatcacagacagtctcagatccctgtgtgtggccagtgcaagcacaggcgcaatgtccatactttttcagtcccttggccccacacagcagtcagcccagtcacaaacaagcccatacgaatacacagcgccctcggaacacagcccacgcaggcagccccgcccacgcagtcacactaccacctataaacaatcgcacacaaacaccacccccacgcaaccactgcatcactcagtcccgccgagacctaccggcatgttcagaggctggtttctagttaatcccctccaacccccccatcatcagcccgtgacattcacacgtagggcagaacagaaatttatagccacactgatacacggtcctgaacgcacagctaagggctcacccgtgggctcgtaagtcactagaaaaaaatattaaagcgttccctcccttctagctttggcacgcgcgcgcgcacgcacagcacccccttccctccccgcccccactcggtctttaggcgcctaggaacctcgcagcagtgacctggccacagcggtgagagccgcgagagcgtctccttggcgccccctcctcctgctctcgcccagcttaccactcctcctccctgccccctccctcttctcccctcctccgcgtctggggcgcgggctgcgcgcagccaagcccccttgtcgcgtgcccctccccgcgcgcgccctgcgcccgcatcgtgctagcccagtggacgtggccacaaggccgtctctaattacctcctgtccccccggcggccagtgaataatggctactgagggcactcgcaggcgctgctgagcaggaagcgaggggctggagaggcgcggcgcgcacgggagcgcgaaagagaggagcgagcccagcgccagcgctcgcggcgcgcagagaaaggaatcgtgtgagcgctcacatatttttctcccaaggatctcatctggcggtcgggtactggaagaagcgagggggagagcgcaccgttgcagagagacggcaagagaaaagggagactgagagtcgcgccacgccggcgccccaagacccaggaggagcccgcaggtattgttggcggcgaagctttgtgtcttcggcgggctgctccgggcaagagggctccctgaatcccggcctgccaccgcgctctgacctgccgcgaagcagggctgctgacgggggtcgccggggggccccccctcccatcgcaccgcgatccttgttggagttgcgggtttgcgtgtttggaggttttccatgtgggtggagggggatcagtctcaggagaaggaatttcttttcttttttcttttcttttctttctttctttttttttaatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttggaacgtttaagcggcccacccccgcggcccccggcccccccccccccaattccccggccgcttccggatctggtggactgatcggctttaaacacttcccctagatacccctccccattccctgttgcgttccctctgtcctgcgccaacccgcttgctaaaacagctgagtggccaagctgacaataaaatctcatgcctttgcggtgaggggcaggggtcatgactcagcctctcctgtgactgctgaccctgagccctaggcaggggaagagactccctctttcttccttgtttgggttggagaggttaccactagatggtgtggagaggaggcctgtaggggtgcccagcagggagagttggggtgcactggctgggctgtggattctgccggtccgggcttgacgattggctggtgcctttgggcacgtagaagaaccactctaaccacggcctcctcccgtcctgtacaatgcaggctgagaggtgatcccggaggtgatgtgcttgtatgacgaagtgcttggcttcctgaaatccacagcagacaccactgctctggtgacccagagatctgggatgaaatggggtgaagaggggaggatggtaggagcagttctttttctacactggcgccatgggaaagaaggtctgtcccagagaattcctggggactgcagtccagaaagggggaggagggataagctccaagggggaacttctgggtcagagccttggcactcaaagctgtcagatcttcactttgggttagtggagaggtgtggggctgggtgggcgttgggaaccccagctttgatagatagctagttgagctgccccaagggaatggagtccagataccataggctggctgttaaagctgaggaagacacctctctccctagaaactggattcttaggggaacaaggggaaatggattgtctttagactgttctgtgcctgggtccaggaatccaaagagttaaccttctcccagaaatctgtcagtccctaaacaacagagaaacattgttagcccctccatgctaacagcatgatactgcctggcaggagctgcagatccagacccgctttccctattcatggcagcagcaatctctgcctctagctggacaggatgcatgctggttcctcatttagggtccttgtaggagacataagtcagagtgtgtggattaggcagctaagctgtggccttaagagaaagaggttacaggcctgggtcatggatactgggagggatgtcatgataggggctgggtttaggaagaagagcaaggagacctttctgaccctctgccttacccacacccacaccttcaccccacagctgagtacctgggtcttttagagtgacttgctgaccccaggatagactgtgacatttgggaggcgagggctctgggacctagagcttcatttcgccaactttgttgctgcctgctgttcaaccccagggcataagcaccttatagagttgtgtgtatggtgaaggagggctggggacacagcacagagcgggactacctaccctgctctggacatcacctccatttcctataggcagaagctattcttatagaacctcagagccaggcacactgcagacaatactgtctggtatttggccagacaaacataggagtgaatgattaatgagtgagtcagtgagtgaaaggggattagaagcagcaggtcattttttaaaggtatttttgacatatatattataacacagtttacaaaatatcttgaaaaatagagaaaaacaaacagattattgagtgtcttaggggctctgacagcttgcatgttggtgtggttcttaccacatgttggctttgatggttggtgatttaaaggctttcttgagttgcctgtattttgaggggggtgctgataacaccagccttttcctgttttgtaaccagctctttgtaaacaccaatgttaatatcttcaggcttttccagtcaagtggatttggtataatttgcttaatactgccctttgttccatatactggaacaaaatgatgtagttgagtatattttatgtagagagccttttctgatgtttaaaggtgatttcctcaaaatgctgctgctgctgccaccaccgtgagaggcttcagcacgcctgcagtggaagaaaaaggcttctctagttttcttgggctaagtaggacactgttcttccttccctactgtctagaaacttcttcgtgctgcaaagaaccttggcaatgagtcacttgtctgacctctctcttttgactcaagaagaggaaaccagagcccagaggggaaatgagtcccaaggtcacttaccaagaacctgctactgacctggcgtttgggttcttgtatctgggaagagtcctaggttgagtttgcccatttcatagatgagagaccaggtgaggagaaccactcagcttgtccctgctgtctagctggagcagtagcaaagaggctcctaacatcttttgtgtcatgtacaccgctgtggcagtgggtgtagggctactacccaagtccccagcctgaagttggttaaccctcccccacctctcactcctttaccatctcattttccaaagggaaaagctgaggatcgcaagcaagtgcatcaagagaggtggggctgtagatgtcaggccccgggtggtaattcctccctctgctgcaacttccacgttcagagacccagctgtggtctgttaggagctggggaggtataagcacctgtcaagatgtactgtgtctgggatggggatcagttaagtctacttaggatccttctgatctgagattgacagtgaatcctggggtgaaaggaaggaggagaaacagacgagacagtgattctaaaatggggggaagcttggaaggaagagaatggaggaaggaaaaaaaaaggaaatggaatagaaaggattttaggtcaaataaaggacgtaaagagaaagccctatggacctcatcaagtacccagaagcctggggctgtcaggctatttagtgctgggtgccatgggctggctctacagggctgagggctgttctgtcaccttctccatagggaacagagaggctactagcctgggccctatatgcttctatgtgaccccaaacaagttgcacccagccttagacacccttgtagcaggcagctgtggcttctgattccccatccaagaacagggccctttttgtcaacatgccaacacctcatccctgaaggttgaaactgctgaatatggacattgtgtgggatgtgtgcaggtgagtgttcatctgtgtgtcatgttttgggatgtgcccatgtgtgtgcctctaatcctcctccccccttatttatttttttgaaacaggaatcttactatgtagataactggcctccaacttgtgacccttctgcctccacatgcatattcctcctgtctagacacacatgcctctatgttctcctgtgggtgccctccatgtggatgcatgcacatctctgcaggtatgtgttgggggtgggatgtaagcttgtgtacgtgtatggctgtgagtatgtaataacctcctgatggccttgaggagacccaggagccagacttttgtgcagttctcaaggttgtgggtaaaagtgaagaatggccctttgctgagagggctacactgggaaagctttgaaaaagaaagaaaatcctagaagactgtcttccttgtggtctccaaggagatcagcctgtgaaatgatccgcacgttaattaaaaacgattatatcctgattgagctgtttttgctcaacccccagccaggaagaggctgaggctgcataggggggtctggataaacagggtctagccacaggctcaggacacaggtttggagggctatgaccagtagtggggatacatgcccaattagggtcccttgaggtgatatccttgaggtctaaggagctaggtggcacccatcagaatgccacggatctgtcttcatttccatggtagtataccatcatttgcataaccctgcgagttggtgtgtgtgcttcatgcagccagatgttgggaactccaggctgtacccagttctctggcctcaagacccagcctgtcttcttagctcttagctgcccccaggctcctatttttgagcttctacttctacagaagctcgaggaagctagggccaagagagtcttctcattctccatgtcactaagttccttcctttctgagcttccatctacacagagcataagccgtgttattccttcacatggggggatttgatgcctagatggtcatcatctggcctgcatcctttgtatctgcccctgctgtcctgtgttagctgataatctgtagcagaccagacccaagtgccactagggcttgcaggcactgcagctacactcgggatgcacatgataagatttctctagggaagcccaggcctggcattgcactgttttgcttggttatctctcccgttaacccaaggaacgctcccgtggagagtcgcagtcacaagcatcccatggtagtcattcctgtaacctgctcacctcagcatctgggagacctgcccaccactgcacctcttcttactcccacacactaattggctgcctctgccccaggcttgccccgattctctgagagggaaagactcagattcaaaaggattgaaggtcattgccccagagtagctgagcctaattttcctttggtataacagtgacggtagcttttcctggcaagtctgtcaggaagtgaggtagggtttgtttaagtgcctgacagccccggatgcaaaaggactcatctgtacacctctacatccaggacaaatgtatgctgccatgggagaggagttaagcttgctgacaatggagaagagagataaaatgtaattctttagggttttctaggagacagccttgggtgcaggtaattcctctcagtatgagcctcttggggagctagtgctcactggagccacctaaggttacctcattaaaagcggagtgtttgggaaaggcagtggatggataccctgctgggctgggtcccagtgagacttattagatctgaccccacggtcttagggggagcttgaccagggggagatgtataagccagaaagtagtactctgagaatgagaggggcaggtaggataggagggaagaagacaggtgtccactcacctgacaagagcccttggcaaccatataaacagagtggccttgcctgccccagttacccctgcaagctgccacctctcaggaatagtttcaactgagtccccgcctcttgtcttcctcctgcccataatgctacttctccccactgctacaggtcaaggcatgggcagctctgtttaaatgctaactcgttatcttgtttcgtcaggcaggtctgaagggccccatgcttgcataatgccagtccaagctggcagtgcaggtgaggccgtaagggccagctggtcttcctggagatgtaaccagagtacctgttacccactttctcaagatccaaaatctagatgtttctgtgacacattctgttcaaaattatataatatcaactgttgcagctaactgcttatgggtcagatatggaccccagaccaccatttgctgcccgattaaatcactgttaccactaggtcactgtgttgtcctgtagcacagggttagtgtggcgggcattctctcacgaagctccctggttcagtgagaccctagcagggctcgggtcagaggagatgcagaggcctgggaaaggcatagagaaataggaaacacaaaatggggtccagtaaggcaaaagcagaattaagagccatgctgtcatgggtgctctggccatataggctagcttatggtctaggcttcagccagagcccaagtgtccaggaaaagctataggggaggccgtcttggaggttagagtgtgaatagaggtgcttcataggggtatccagatcaggctgaactgggtcagcctgaccttgtactcgtggctgtgaagttatattgctgacagcccatatgtctgtctaggaggccctgccctaggagaccctggcaggtgtcccagaggaaggggactcagcacaggattctttgccagagaaggaacattggcagctcaatattcttcacattgcgcttgaggcctgtggtgcaagacaaggaatgtgtgtgagtatgagtagctctagatcagagtgggcacagagcaagggatctgcagctgacaaggcactgggctatgactgctatatatagacagcccatcttctcaatactcttgtgtccccttcctgttggggctccagtatagacctcctggctgaggacagccagaaggatccgagatctgacctgttccctaatcacctgcctgaaccagaactgctgacctgccattccctataccaaggattccgaggtcttacagggaaaagatgtagaggtcctggaggccataatcaaaacccagtagattatagtactagataagagggattaggatgcagattggggtatagcaccagagcctggataaaagcctgctggatatcaggcctcagcctctctcacttcctttcttcagactgtctgtcggtagaatgtaccttcacctccagtttgcagatgtagacactgaggcatgtagagatggcgtgcttctatctggaggcactctgagagtagcccctggccatggctcagatggactcttaagatactgagtggagtaggggagaagggaaaagacccttttgctgaattccctggttggtgcctatgagtacacacaaagactgaacccaggcttggagcaggcctgaagcaggagtaggttcgagcaaggcagagcttcctaggaccctcatgtcctagggccctagggagatggacaccgatcgtaggtcactctgtgactgcagagtaatttacccagggccatgctctgagctgccattcatgaattttctgctgtgtaatacaaacataacctctctgggcattggatctgcaaagcgctcatttttctcctactgttcattgtatcattttgattggctgaggaaggcaagcaaacctcacagagaaggggatgacccttcatgttcccctctctagtggtctcaaagagacctactgagcccatttttgtgccgggggcttttacaacactcaccacctactaaaggtgggctctgtcatgctacatctgacagcacaacatacagaaccctcatggttgacgacagcctctgccaaggaaagtttgcttggtgtttctacaagcctactcctacactgtctctctgaaaagatttgcttgtttgagataagtctggggacagctgtggcttgagaagggacatcctcagatgggcagtgtttgtcaagcacagggctttaaaaaataccacatttaacacaaaaatctactttgtgcttttcttttaaaaagccagctggttgccaggtatggtgcatgcctctaatcacagtgcttgtggggcataggtggaagggtctctatgagttccaggccagccaaagctacacagtgagactgtgtcttgaaaaataaacaacacaaccacaacaacaaaatcacagttaactaatgataaacagtgtttggaaggtgtatccaagaagtctctccttggatactccccacctccagcaagagaaggggtgcccaggaggggagctgtcggggataggcgatggaagcaagcctcaagtgctcgtggaatgtgttcttgcctgttaagtacttagttggcaaggcctgaatgctaacaccaatcgtcttctgcttgttctggaatggggttgcacttattcagatggtctcagtgtcagcaccagcaatggggacttttgttcccacttttagcagaccagaaatctggagctcagtgaaatgaagtgacatacctgggtcccagtcgagcaggactggagacagaatcctgccagaccagtgttcatctcatctcatctcagacccagagaaattgactcttaaggtgtgctttcttcttgtgcattttcaagaacactcttttagttaatatgcgggagagacttccacattcttctacataaccttttgctgaagtgacattgtacgataaaagggtcccaggagagccagtgcagcttgggctaggaaggatagagaatatcgatgcagtaggctgggctgctcccaggagctaagaggcctggacagctctgctgctgccagcaaggtgtggccctggctcactgccaccttagactttaggaccatatgttcactaacatccatgtttaactttggatttcttttcttttctatttttggtggggatgcttttcctagcaaaggaaggtcaggcatagataaagtatgtctcctggacaggacagggagggatggaaaagggtggtgggaggcagatgtcaaagctctgtgtctaggcaaaagctagctagttgggggtcacggcctgtgctgagggcacagtggagggcatattgaagctgtattcacatccatcaaagtgggctctggaggttccagttaattgaggctggttctaaattgggaggcttaataaatggtaattgtcctcctgtgacagcagaccagagctacacagtgtcatcccaacagatcaggaatcatgcacagcttctttcctcttactatttgggggctcagagagttgctccacggaggccaggtatcaggagcccatggtgcaggccagggggcaggccccttctgtgcagttacatagtagaaggattgcagtgtacccatgtctgagcttctgggagtatcccagaagtacaagtgtgtgggggtactgactattccctacttagcaatctccagatcccctcgcccagcaccttaccttgcccacaggacctagctttatgtgttgcagggagagcagagcttggctgtgtggacaaaggtgacatagccaggcttgcttctacccaagggagagtaaacacctcatcttagtgcatgcagatacgatactaaatagactattctcacctttctaatttcctaaaccccaaagcgctgtgattgagcttcttaacagttggcactgagcagctacaggttgctagtcttgttgatttgtactgtctctggattgagagagtgcttccacttctcggcatccccagaatgtaagacccctaggaaaatcgggaaaggtttacagtaggtatagatacatcttagatgtttgtatagttggtggacacatttccatgctgttctgagccaaggttctaaagggtggtgtggttctactatacatcaaatagtttttatcatgctgtgtgtgtaggctgtggttcttaaagtcaggacatggtgtaggggcctctcatccttactatcccttcctgccccacaccctcctacattcctgtctcaggcaagattctctagcccagtggttctcagccttcctaatgctgtaaccctttcatacagttcctcatgtggtgactccaaccataaaattatttttcttgctacataactaatttttttactgttatgagttgtaatgttaatatctgatatgcagaatatctgatacataacccctgtgaaagggttgtttactcccaaagggcttgcaaactatacattcttagttcctgggacaagaggacccagcagatggccgagaggtctccaggagccagagagacaagggaaggagaagcctgtacaatctctttccaggacatcttggaggaaatgggtctcagttccttcagcgtgtgagccaaggcgggaggctttgccttggtgcttccagacaggagctggaatggttccagagccaggatgtctctagagacaacatggagagcatttctggaagaggtaatttctgaagatgaaatagggggtacatttgaaagtgaaatgagaattcttctggagatagatttttttgttttgttttaagtaaagatgaagaggcttttctgcattctgagtattgccaaacataacatttctgagaatggagcctttctagagataaattgtagtgcttcttggaggatgattctggagtatttctggaaacaatgggacacttttggatctgaggtacttctggaggtaacatgagcatctggagatggggcacagcttttctggaaagcttcttggagtagaaatagagttgttaggagagcagtgacatttctggagatggatcatacttgaagagaaaggtgtttctagagatggaacacctttttggagctaaggaatttctggaattggagggaagcactcctgaggaggaaatgggtggttcttagagatggtgttttggatcaaggatagtcatttcttttttttttttttttaaagattttttatttattattatatgtagtacactgtagctgtcttcagacacaccagaagagggagtcagatcttgttacggatggttgtgagccaccatgtggttgctgggatttgaactctggaccttcggaagagcagtcgggtgctcttacccactgagccatctcaccagccccctagtcatttcttgaaatgagggggcacagccaagcaggctgcttgtcagagcaccccccccctttcccctcatgcccatgctctgtgaggtggctttgaggtgccgaggtcagtgttatctttgcccttctctgggcctgcataggatctccataaaggaagacccaagccctcccaggcctaccccatcctaccatgccctttagtctcaccatgggatagctagtgttgagtggggttcatttaattcagttttgttagagccagctgaggctccctttatggcctctagtctttcttcaccccatcttcttgtccttcaaacactctggaggcaggaggataggtggggactacaagggtgaccctaagaaaaggcccaacttctttccctggctgtggggtgcctgtctacctctttcaattccggacaccaagacctgtccccacctgagctggcctggagccctgtagtaattatttctctgccttaattgaaatttcagcctcagtgaatatccctcagaagtgtgcagaggcaaaggccctgcaccagcctcaggtgcccctccccgcctcagaggatggtggtgcaggctgcagtaccagggagaaggtctaggtgggtgggctcaggacagttatggcagactgttaagcatagattacacttcttatccctgctggactagaagatacttagagaaaacatagtcccaagctggccaaggagtaatggtagggctgtgaggagttaatgattggggtagcctgaggatgtagggactcaggaaagcctgtgcctcctcttcttttgactgggagaagggtgggatgatactcaggtagtgccttgatagctgatggcaacaggcccagttcttggctcagggctgagtaaagcattgtgggtaaggttgggttggctggaggacttcgaggaacctatttcctgactgctgctgggtggagtatggcttagatgctgtatgggtgccatcttccctttccctccatcttgtgtagtccctatgctggacctgtctgctgagggagagaacagagaactcaaaggaacactgctcctgataaagggctttttaaatgggtgtggtggtgtatacctttaattctagcacttcaggaggcagagacaaatggatctctgtgagtttcaggctagcctgttctatttaaccagttcctagccagccaggcctacatagtgagaccttgtttcaaacaaagcactaagagcctgctgatcttagtaatatttgtctgggcccaagaaaactactatgcaagccctcacctcgtccacacaggcccccagaacttgtaggagtccagacagcctgcactggctcatgaatctcagtcttcatctgggaagtgggtcaggttagcaggagttgtcagaacaaaagtgacctgtaaaatacctaggactgcaagtactgttaacgtgcatctggcacctcttaaacagtttgagttggtgtggggcagctgcagttctttcagaggatatctgtctggtacctaggaagtatctggatatgaatatcctgattagggctgctccaccccagcaaagggacagttgtgtgacaagaaaaactcaaggcagttggagtaaaaactgacagcatgccggatgtggtggtgcacacctttaatcccagcactcaggcagaggcaggtggatttctgagtttgagaccagcctggtctacaaagtgagttccaggacagccagggctacacagagaaaccctgtctcgaaaaacaaaaaaatgaaaaccaaaaaacaaacaaacaaacctgacagtgtatcagggggttggggaggatgcttatgacggacccactgtatccttacactacggccatcacacaggaagctcctgaagcactagtctgctcagcatggcttccggtgctagctgcttgctcctggcattgttcacagcctgtcctaattggggtatgtggctgtggctaccctctaagggagagaagggacagggatgactagacaggataggacatgtccgcccttggcacctgaggaggtgaaggcgggtgcaaatgaaaatggctatcccatttgcagttctttacttcatgactatgacagggtgaggaagaagaaagtgaggatggcggtctaagctggcagctaagagaagggtatctgagtcgaggccaaggctgctgacagggttgttgcacctcttgcctaccaagctgcttgactggttgcagctctagaaagccatcttattgcacattctagcatttgtttctcctttctcagatgagctctgcctccactccatgagaatgtttagattctacactatcagcttgacaccagctggctgcctctcccttgtacaggccaggctagaggctgaatcagttggtaatgaccaaaggcagccaggggtgagtccaaggcaccagcccaactgccagtcagctgctaaagcttggttgtagacagggctgtggttatggagccctccccatgcatagaaccaccagctgcgctgacatgattcaccaggacaggcagctctgcttcccattgtagggagggtggtggaagcctccagatgctatggtcccaccccatgaggaggatcataggccagacctaatgtaacccagagggaacagtcagcgtcggaggttagtgtctggatgaatgggtatcggacactgcatagcttaggctagaccttgtccctggtaccctggacttggtccctacccaggagagcctttgaccatccagggaaaggtgctctgtggattacactgaacagaattctgtggctcatgctgctcccatggtccaggtcctctctaaagagcacatttgtcatgcatgggctgtcgtctgctttgcctgtcatccagggaactcttgtctttcagagcagacagtttgctcttcctcagaagtactgtccagagacacctattttgcaccctaacccagttgtctccagaaagttagggatttccctcctatggctccctacctgtgccagcagaaaactggcttactcctggagctgcccaggtgagaaatgacattgtgccagggatttgtgcaggtacaacacttttcagtaagtgcctctgaggttgtgaagccagacttagagagtaaaagaattctctagaccacagagacatccgagatttgaactaggtcttagagcagaatcttgtaaaaagctgtgcctgttgggaccagggaaggaggcctggtggacagtgctattttgtgtttgtttctgacctctaccctgttgcctaccaacgcagcaaaccctgggacagatcctgtcttattttctccagaacaaagcaggctaaagccagggcttcagtgagaggaggtaaaagaaaccaaagcttgccttttgtcccccaagaaagcatctagggaaacggatttgtccttgaaccgtaatgggaggccttcaggagatgtgaaggggagattgaggcagaggctcttgggctgtgatgccactctcccacccccacttccgttagagcttcaggaggtggacaccattttagtattcagcacacgctcaggctcatatatgtgcatacatgcacacatgtctcgtcacatacgctaccggttcccctttaaacaaggcctggaacaactgactaatggaggagaggggatggagaaacagaaaggaaaaaaagagaacttaggtgagagaaaattcagtactggatactttagttaccagcgcctagtgactcacagggcaggctcagccaccttcctgaggagggagacccaccctctgggcccctccatcaccccattaagaagatgggtccttattcctgagttctgaggcagaaagaaaaatcaaggatttttcaataagagaacccccctgggtggctccgaatagttgcttccttttgtggtggtgagggacatgccctgccctcttgtccttgtcctgctccactctgccaaggctgcctccctccaccagctgcatctggacccccctgtgcccgggtccccacatggatgagctcttcctccaaagctcaagtcttattgttcctgcccttccctcctaacacccttagcttagcagaggccacaggcagccttgcatctcaggaaagccagagaatccctgaggcttttctgaaaaggcttaaagctggtgctctatgccgaggaaacaaaagcacgctccctacatccagggtgatgggcctgtgggccagggccatgatcatggccatcgctgcagtgcctgtggacggggaatgaatggaaaacagactggttaaggaggggaatagaggaaagaaggagatgcataaatctatttatcagacactgcatatcttaggcaagcacatttcagctgttttggcttttggcaagctggtcctatcctttaattttctaataaaaaggaattacatttcctgaaaaggcgttagccagcttcatgtcactgtatcttgtagggaccataattcctttcttgtgtgtcctcttgctctgaggcaggctcctggggtcacaagtaatgtgaatggggtcagaacagatacgagatacaccttaaggcttgctcatgcccttcccaacctggcctattcactcctgactcagtccatgtctctaggtacaaggactggcctgagactcacagcagaaacttaatacatgaagaattcatatatttttactgctgatgtctcgatatcgagcagactgcttggatgatgaaatcttggttggaattagtgaagaaatgaacaaatgaaaacttcattctttaactaactggatggacttacccatcctccctcctgtctaagttctgaaactaaatttattagaaactgccaaaaatgctgtcattccccccccccctttaaaccatacacgttgttttcattttaaagatagtttttacatttatctattttgtatagagtggagaaagtatttttattacagtgaatgtaataaattagttttcctttctaccgtgtgagtttcagggattgaattcatgtctgtaggcttgggggagagcatctttgccctctgagccatcttgggagcccatatacatggttctcagtgcttcatttatttttccagatttactttatacctatggacattgtctatatgtacatgcatgtatgtgcatctgtctggttatagctctgcctatggaggctgcaggtgggccctgcctgctgtccagcagggccataggcagtacagagtggtcctgatacatgcatccctctcccgagggggtgtcttttgctttacacatgctatcgttccagtcctaggttgacagaactctgaccacaatgagtacttaccaaacactagccttggggacttgggagcagccttccttgttctgtgtacagttctaggccctgagtgtcctcatatccctgctgtgtccaagtgtctcacagtgaagaaagcatggatccagaagggtgaagaagccacagcagctccccactgctagtgccccgctctaccagaccagtttgagccaatagaaaaatgagggcctgctaggtggtggtggcacacgcctttaatcctagcacttggcactcaggaggcagaggcaggcagatctcttgagtttgatgccagcatggtctacagagagagttctaggacagccagggttacacagagaaaccctgtcttggggggaaaaaaagacaaagttaataataataataaatactagggcccacgggctatggggttttggatctcagtgaatgtggatgttttcttcaggctgcttctgattaaggtggagttagcccctcactaactggaaggcttgaaggccattggagttcagcctacggacatgtgcccagggcatgttcctgggtggctcagaagtccaaagtgatagactccgcttaggtatagctagtcttagctaggaaattgaaccagcagggtcagaatagggccaaggacatgcagggggggcctggttagctctgaatccatagaggcagtgggcaggttgttgggctctggtagggcattgtctcctggcaccctagtacagtgtgcctttgaattctgtctctctgtagatcgttttttagagtgtgtttaaggtagggaggctttgcaagacagagaggtacagagcaggtactagggcctacagccccaagatgtggctgctctgtccagattggtatgggtcatgcttagggcctggtgaccactggagaaggcatattcaaggggtggcctgtggattcttgccgttctggtacgcttctgtcaggctgctccacctgtgagcactgtctcagtgtatctgtgtcaaggtattcacactataatgtggaagttagttcttccttctgccgtttgggttcaagggattgaactcaggtcttcaggcttagtgacaggtgcctttaccttctgagccatcttgcctcgccaccaacccctgcctacataatcttgcttaaagatctatgtagagacagagttcaaaggcctttgtgtagcaggaaccctccactgatttggtgaccatgaacctggtcaaggtcccaaagggaccactgtatctcctatcgcccatgatgctcagctgctgctccccagaaagaagtcttgtcataaagaaaaggagaaagagggaagacaggctttcgcagcatctcttggagggctggtgtcatttttctgatctgaggaagcatctgttcagctcttcagagggtgggggttgcttagagctgtgcagcgtggagtaagcctgcttctatcttgggggtgtgatgagccatggggtccctgctcccccacagattcttgcttggaatttctacagccattaagtagcctctggctgtccctgcctcatccaaagatgggggcttccgtggataatgttagagtctgcccttcagtgtcatttggcaaagaccttaccttgcatgagagctcacacacgtctttgttttttaaagataacagctgccaaacaaattgtgtgtattatgtgacgattaattcattaccctgtttcttattaatgaaggatagttataactgcctctctgaatgttgatgggggaagccaggagggtctctagcccagagaggagctttagttggggtgaacacactgtacctctaagggtttctagaagacatagtgatggctcatggacccacccatatcaccaagtccaggctgggtgcctgtctcttatatggaaactggctagtaatcttcctggagttagaggacctgttcccagccctgagagtggcagcagggggtagctactgtgtactaccccctactctaggcagagcagagcctggttggtagaggagtgtcttagcacaccaagagctgcatacagaactgaggaaccaataagtggacacagtccagaggcactgggtgtaaggaagacttcctgaagatggcactgctctaagaagtttggggagtttaaatgttttttaaatggttctggggatggaacccaggtcctgtatgtgttagggaaggaaggttgccatatgaaaagaaacaacatatgcaaacatgatgtacatggagcggtgatggtgggtcacccttaagtgctgagtatgagctgagggaatgacaccccaggggcctctgccttcctctactgttaggtacccagtgacaaagacacctccaggctagggcttttagttcttgaccagaagatgtcaaccagactaggatgtatatcacagcagcctccagtgcctgtcaggccgtccctttaatttactgcacccaactcccaagattcctgttgagaaagaggctggatacagagcagagtctgcatgtcagcagagttgatcttcttgccagctgcccagctgcctccagggacagccttccaagtgctgggttaaaggagcgcaccacctcacctggccttacctcaggttttgagacatgttctctctgggaaccaggctctcctcattgggtagggccagcactgtgtctccacctcttcagtcctagctaggactgactataaactctcctggctcctcttgtggatgctggagatttaactctggtcttcgtgctttcacaactttgctgactgaacgacctccccagaccccatctcaggttggaataaaaataaccacttggaaaataaaatgacacatttgagtcttcggcctccagcaggtccctttaccatatctttcctgggctctgggtccagatttaagttggagatactcttgaacacttggaaattggagaaaagttcttgatcttctgcagaaacatatgcttgtgcatgtacacaacttttcatttgatttcgggtaatcaccacacccgggctgggtgttggaaggtggggagacctgtgtgtggacagactgccgcgctgataagaagtctgtggttgtacatgtcgtacactggcctctgtgcatggctggcccctggagtgttttgtacaaaaccatgtggcatacatctggccatcatcttcccttctccttttttataacagctcaggctgtgacactgatgaagttatgagaattatgtgtacaccagtgaagaacagtcctacaaattgtgccattcaccctgtccattaggctcaaaaggactgtccccatcttgctgaggaccaagggaacctggggcagattgctctggactgagatgcagggccaggtgctgcctgttttttcaggtggggacagttggaggagtgtgggtcatggcctaggctagctctgccttgtcaggcacagagaaggctcagtctaggtgggaactgttcccacctgtacaggcaggtgtgaagggtgtgagagcacctgaagccagcatagcactgggtgtctgccagcaaagcagcctggctacagtgcctcagccttgacctatccgctgctgtcaggaagtgcagggcctgcccatgctcctctcatctgtaaccccttggtctctgaggcttttccaggcagtgggacttcaagcagagtccttttgcagcagactccctggccaacatgaagacgtctccagcagcagcctctgccacttgtagctaagcaggggaagttggacttgcaagttggctccatggagcctgtaatcagccctgcaaggcccctgctgtgggcacccttaagtgctgcttccggagcctacttgagatacacctgcttgtgctcagaagagaggcaacaatccaccaaaacaaccccaggtgccggcaggaggggtcaggactcagattcccttctcatggtccaacattgtgtgaggtctggtgcaagcttcctcaagttttagtgtccttggaggtgcatggccccagggctttccctcccagggcctctgatggatgccatcgttgggagaggaatgagctcctgactccttcctaagcctcctccttcactgtgccctcatctctttctttccagagacattataaatcaaacggcttagaacgtaaggcatcaaaaattctgaaaccttcatctattattaacgctgacagtaaattcccccttcgagcattttacatagcaactgttaccaagactcacgggtagagctgcactcaaccaccaaatcctggaggctccgggcggatggctgggccagccagtttctgggccatacttgttggccacctgagcacctgctagcctctccagctgctggtggggaaggaaggatctcttagctaaggaaacagctgatgtcctgctgaaagagggtcccagctgcttttgctgatctctgctgcaagatcctcgcagaccccagctccaggccagagaaaaggcccctgaggctttctgaggccatgcctgggggtagggatagggtctgagagggaagacaggaaaaggcttcagagatgctaagggttgtgcagatgttgtttacagactcacccacctgtcagccagactttcctgagtgactgtttgtctgcaggcggtatctaagcaccagggatttaaaacaaagacaaaaggcctagtccctgtcgaatctggtttggtaggagacagtggtgtcaagctctaattgcagtggagtacaagaatcaatgtgtgtaccaggaacccactcagggaagagggacaggcagaaaaggatggggtggagagtggctgcccagggtttgaaaggatgaataggatctgtgggttttcaacataactggcatatgctcaggttccgcagcaagcattagcccaacatttgttgcagatggatctattgaagaaggagctagaagagaaagcaggagaggctgttagaacttagaatgtaaagcagtggtgtttgttaggtagccctgggagctgtgggaggggagctgccgggacattgtacttgcttgttactttcattgcacagatgaggagagaagggtctgcaaaagcttaggcaggcccttgctacatgcccagcccgtgttgggtagagcagtgcagccttggtttagttctgataaaggcctggaccatgtgggtctttcctggagcagaatgaccaaccaaggaggacctgtcagaaaccaggacaggggcttgggaaatagcacggagtaaagtgcttaccatgacaagctggcaaggtggtggaaacgtgtgatctcagtgctgaggaggtagagacatttggatccccagagtgctctgttcaggcagcctagccgaatcagtgagctgagttcagtctcaaaactttaggttgagagtaattgagacagatgtctgacaccaacctctggcctctacatacaatccccccctaccccccagcagaaccaaaccaaaccaaaacaaaaaacaggacctccatgaagctatggggtcagtgttatatagtaacaaataaaataggtggtaactgcagagattttagcaaatggaaatcctaggaaaatgggcttgctggtggccttccctctcatctaatgccaggtcacactgggtcatggccaggatggggcaagatgtttgttttaagacaggaatggtattctgagtaacacagcttttggcaaactgtactcttggggggtggggggggggtacacagggatacaggggccttcctccaaaagataaatgaaggaaagtaggccaccaaagggcaaggggacagtgctgatgtctttcctcacggtccatcacattctgtacttagcacagctctgcatgtattgtctccaaggctaagcaagcaggtttagagatgtgctgagccatgagatggtcctggatgtgggatggggaagctttctagagtaggtgggctaggatacaagtgtgagagacttgggtgcatagcctcggttcacttacctgcagaattggcttgtggcacattcctgtagtctcagaacttttgaggtagaggcagaaggtaagagcctcaattatgtagtgaattcaagagcagtctgggccacatgacatactgtcatattccccaacccccaccccaaaagagaaaaatgaggcacacctcaactatagactatggttcaggccagggctacaggtttgtgttctacagtgttacaggtgaggggaacaaatgactaggcaaatgtagctgaacactcagttatcatggtggaaggcagagagggaagaatcgatgatctagagagggcttggcctttagggctagagacaccacagattactgtctctctgctttctgaaaactaatttcaaggtgtggccagctgagttctgggtagcttttgtccccctgctttagagagggcggagccccacccagcatggtgggggaagtatcctccagctgtgtgcctgactttggtttccctcgctctcatatggcctcttagctctcttaaaccctatgcaggcttctaaagttataattgatatgagacctccagtacacaaagtcctcagcagaagggtctggctccccatctggcaccaactgctcagagatggcctctgtgcctctggcatgtagtaagggcctggcagatgaacactgcctttggcctcttcactgtcctcccagggtgatgagtggcaggtatttcagcaatttctcggatttctgtgtactcaccagattctgcatctggaacccaaaccacgtttttttgatttttgtgagcatctaccatgtgctagtggatgggtgctatgacagaaccgggaactgtggcctggaagaagctactgctgctaaggatagggtttcagggagggaatccaatgtaatctgaggagagatggttcttgtgtggagatgacaatccatggatagtgtgccaggcaaatggagagggtagagcatcctagcatttgatgcccagtgtgtttaaaggctgggtatgcaaaaagtcttttaaaggatcttgtagtgggcaccatggttggaggggcctttggtgccctgagctagcagctcctgagcctgaacaccaccagcagacagtctccagtcagctgcattctgtactgctcagctgtagagcgaacattcacttcttcattgggccagcatgttccttctgtgtgcccccagagttcccaagacgctgtagagccatggttggggcctagtagcagagtgcttagtatatatgaggccctgggtcttatctctaatcacaagcaagtaaatgcacaaggcaggaaatttgagaatggggagctgtagagatgggatttggtctgcagaggaatcagtcataggaagtagctttgggttataaaaggatgcaagtagacagtgggaataaggggaaactgtatatgtgctcgaggggcccaagtagctgcagcacatgcggaagaggagtaggggaaagtagatggcctgcttccagcacagccttggctggcctggggacgtccgtgtgacttgaggatagtctctcttcaggcagtaggaaagctgcccatgtagcttcatgtgtgactgaatgagcggatcgcattctctgagcttgggaattttgtggtgtgtacttgctcatcaccctcccagctgtgaccatggttagccatggttgttccatggggaggaaggatacatggaaacaaatttaagaccccagaacacaggccatctcaagaccctctgtcttacttctccatgttccccagttccctccctctctttcttccctttcctacctaccttctatgcctgtgggctgctctgaaggctggtagaggtgatgagagcctcctgctcgtatgccaagtttgttggtgtaaagttggggtatgtatcatatggcctccattggaagccttttttttaatggaaaaaaacacattccctgggattccaactcacatgacctgaaacagtttggccaacgatactgtttcctgtgttcccaggtcattcattttctgagtcacctcccccttctaagcaataggagacgtgtctgtcagagaagaaggttgcttaggagctgccctggaccacccagaatgagctgtagaaatgacaggcacaccagctgctgactgtgaacttggccctcgccactgggaagagctggctcataggcctgacccagtagttcagtcagcctctgcccagccgagccaaaggcctgggaatggatgtggacaggaggctgctgctcacaagctgctgctcacagttggcctagtcttccgggagaccctttccatcttaagattcttatagattggttagttcttctcttttttgtttttaaggaattaagaggggtgagggtgtgtggctcagtgtacagcacctgtatgttggaggccttgggtttgatctcttgtaccatcaaaaactagaaatgatgtcatagttactgttttgactggcctccccagcccctaggtgacccaaatacaggggtccttagatacccgcccccaaaaggacagcctgacaggcagtgtctaagaggctgaaagggatgtggggagaaatgcatctttgttgcagacccatgtggggctctttatgtaaatggtttcagtgcctaacaggaaaaagaaaaatgaggctttgatgtgagcctcggcatctctgtcagacctgtacagtgtcactcaggcttcggggtggcctgtttctattaaggagctgtcagctgttctcaggccacaggcccagggggctctcagggtaggggtggtccagagctgtctatagaatgctgtatgagtgtgggagctgtgttggggatgtcggtgggtctggattccctgagtaccagagctgtgggccaccccagtagatgccagagaagaaaaggggagatggagacaggtgaagaccagctggccaggcagcacagcattgcatagagtgggacaggcttccttcccctagcagatacaggaaaagatcctgctgttccatagacctatataatccaggctatctcatggagaggatcctaggtcccaaggaacattctaaatgaataaagaatgacaggggacagatcaccaaaggctaaaacaggcacactgtgctcttagtctagaaggatgtacgatgtctacatggtatctatggcaacagtctattagccagaatttggttacaccagctcttgtccccattcattctagaaaatacagaactgctggtctttttagaaaccttgctggaaaaatatgaaaaaaaaaaatagtattcacctccaacctcttacatgaaaagacattgatgttaacttttagtgtcacaaacttgggattgtgtttagtgcctgcttctgtgccctgttcattgtatattgtattcagacccttagcatttctctgtaataagaaaagctctatgagaacagtgatactgtgggctgggatttggaggacctgctgtgctgtgtgatcttgcaggatcagttgatttctctgagccttgttccttgtctctgtgtagggacagagaccaatggttgtttctcaggctctgcgtaggggatatggatatgttgcctgtctcaagatacgtaacggtgacagctttgccctccttagacgaaagaaagcctggtgatgtttgtggcagggcaggcactggacaacactttccaggtatatagttagtgggatgctgaggacctggctagtgctgcctccagtaagcactttaccacctcttagcccaggactttgcatctctgaacactagcccccacatagcctcagaagccagtgatggtttgccagttacattgatggaagcagggtaactgctcaaagaaaggagtatcttgttactgtctggatgatgggactggggcctggcattgactcttggtcctgcagtgctcatcaggacttcaggaacctcaggatattgtatccatgaccaatcctcaccaagtcagctgcccaggacccatattcagaaatccctggtgcatgctacagctctgccatctctgatgagatctcactgttttcagcaagggccttacatgtcagcaaagcttccctgactcttggccgcagaattgcgtgacgttcccacagctctatctgcctgtcccctatacagtggagaactctgctctgaggtcaggtgcttactaggatcacaggggataagggtctggttggccattataaactcttggtcacacattctgggggacatgggatgataggagtcttggactggacataagaaaaggaggcacacacaatagggataccaccgcctcacctcctagtcttcttgggctaggtgggtagtaccaggcagtgaagttaggcaagatatacttggtacccgtccatgagggagatagaagaacagggtcaggccactgagtattcagaaggctggataatggtgctcagcagtttgaggggaagctaagagtgtgtcagagggcagcacatatagggcaggcctcaggcagcttagcgggaagggagctaaaggaagcaggcagaatggttttccatctacacagaagccagcggccggagcagagcttctgcctttcctaccaggccaccccaggattgaggcagttgagcctcagaatagaagtgagcatgtggctctctttccaaaggaggagacaaaacagggctctgcctttttaatattccaatcaacttttaggggctgggtctggtgaggggcacaggacagcctagggcatgttgagagcagacttggtggaccataggatatgagtttgcagacctgtcctaggggtctgggagaggctatgcaatgcaaagaagggaagaactgattccagtgaggacactgggaaaggacaaggtctggtgtctactcaagcacagagagagccgctgcagtccagaaggtcttagggctggagctcagtatactaagggcaggaaatgaagggataggaagacattgaacagtttatagcaataaagccctgtgaacagagcttctgtggggctacagggacagaggctagagccctggagagccctctgggttgtaggtacagcatctgtggcagctgggcatgtgataggctctgtactatggagtgaggttggagagaccttggaagaggaacacaggtgaagtggttatggggagacttgatggagtggtgaaggcttgagggtgccagggacacactagatctcaatcagaagctttggagaatcagaagaaagatgcagctgggggtctttttcctcagaaggaggcctatgttctagaaagaaatatagtcactcagagaggccaaaagaaggaacagagggaaaacagaattagagcagagatggggcagggctaggggctccccgggccgccagctgtggggtctgccttgggaacagtgaggggaggagtcggtgtcaggagagctcgtgtactggccttcagacaaggtctggcgttcaggatttctatccaccagccaagaggggacagcctatctcccgaagagcttcagggcatccaggcctcaaggacaaaggctggggttgggggtggggggtgagcaggagatggagcctgtagctgtgagcttaatggccccggaaagaaaaaaaaaacataaagctgcagaattacggggagacataaacagagctgtcaggcattagctgcagggagacggctgagcagggtagagctgcgatcctgtgtgtgcataaaaagacagaagttatcaaaggagccagattaaggagctgctgtctctgctgtactcaggttccctggcaggttcctttcttatgcctcagcctgccgcctctggtcataggctccggtcacatgctgaccgaagggggcagggggcagaggtgccagtgatgtttgagtggacaggggacccaggtaggagtgggagggtaggagtcaggtctaaggagggggcggtgctgaccctgaccctttatgagtgatcatacaccctgccagctttatttcttgctgttgctgatgatgatgttagctaagcactaatggacttaagtttcatccaaagccatccctgtagtcctcagcagatgacaaacaccctgctctcctgagctgcagagataccagcctatgcggaggcatgtacatgcctgtgcagatatgctgcccgctgcccctgctcccatcagagaggctcccagcaatcctgagttggagaagggtggtgtcccaggtgagaatagaattctgaactaggtcttaggggtacctagcatgtagacaggagcctggcctagtaattctcaggcccctcttgagtacctcagaccaagcaccatgatgagggtctgggaactgtctgttcttaaactctcatgctcttttaaagaatcatgttatgcatgggctaagaaaaataccattggctttgctggagggcagaactccattcacctacctgttcactcgctcactcaataaatgtgaggcctccaccacttgatccatcctgcccccaactcaaacatgcccatcagaggcctgatttgtgcttttgagtctcttaggggacagcaattgggcagtctctaaatgcagtttgtgtgggagaagatcttttgttggcagaggttctgaaggttgtggggggaaatgggcaaagagctctggaagctgtgtggccccaggacccacctggtaaggagaacgggcatgtatctgaagaggagggtaccagaacatatgcagggccctcacagaggatgtgtggcatcttcaggtgctcctgcttaccttgcatatgcccaccagtctgggatgcccttccttcacagtatagctggggcttttatctacccttaaagctgcccagtgggcttgcacacacatctattgactaaggaaacttcattcttatgtctcagcacctgccttcaatcaccctatgttacgagtggttctccctcccactgatgcccagtgaggtcaaggaggacacttgaggaaggtggccaccaccaggagggcctcagatgtctctctctttagcaggcctggtgagctggaggcgagggtttggtaggatttgattcccacactgtgtgacccttttgtcctctctgggctttagacacacactgggttacttatagatagtggccctacctggttctggcacaccaagagttgcaagtcaggcttgagttggagacatgcattggcaggttggtagactgactccatcactgttctctaggagataatccagctcttcttaactggcctccatatttacctgtcactatagttactgtgagtcacagtgtacatatatccagggttgtcacccctgctcttgtctgtgcactgtcacttagcacatttgtgttctgggtcttgaacctgtctcatttccacatctaactaaagaaactacattttcagacctttcctctctgcctccctttccctcagtgtttcctgcatatttctcaagactcaggacttcctctgggttatccctctgatcctgtgcctcctgggtataataagttcagcctttgcctgtacatcagcgctcaactgtcttctgcaagggttacttgatctttttgctgtttttggctgcgtctgttcctagcacccatgcacgtagagtacacacttgggaactgcttctcaggtggaagcatagttgggcaggcgtgtggatgggcaagcggatgaatgggcaggtgggtggtgggtagacaggtggacagtggggaagttgatgggtgaatggagactacctagatgaatgaatgggagggtgtcagtgggctgagggactagagctcccaggaggtaagcttctgagccttgaagggggctcagtttccctgtgtgtaaaatgttctgtctgctcagctcctatggttgggaatggtggccaagaagacaataggtcaggtgtgacagaaagtggccacaaaggaaattgttagcttgcagcaccgaaaaaagaaaagttccttttctgtaggccctgccctgactagagagttgggactagggttcaatttaaatccaagtcttgctgtttccaagatatcctttgccctcttgggatttagttatttgtttgtttgtttgttttaataaggtagggtgcttatgttcttgctgattctctggagatgaaaacattgtttaggcacacctggaaaacatggatcctataccctaaatacatgtagagttttacaccctggctctgtctctgggcccgaccccactcaccaccgcagcatgatttatagaatgttagaactttcatctgaatacacaaatgccctaagcctttttctgtgcctgtgacctcatctgtaaagtgagttaggatgtgactgatgctcagaacagagccagtacctggaaggtcagtgagatccgtcatagtgatggtagcaagggatttctgttccttagtggctctcagctcagttctgggatatggacgtttaactgcagtccctacttaaaggatgacaattacaggcttggagaggcggggtagctcgcctgaggtcacagagtcagtcagcctcagggtcttgggtacttggtgtttgttcccaaagactctcgtgagggcattctggaaaaagcgacttctagatcacagtgaagcacaaagctatccagaacattcctggggctgcagggcttcctgctagtctgccaggccagttccatccagggttggcacctggagttgtcacatgtgacaggaccctgctcaggccactgctactaggcctttgtgtccaagcattgtgcctgactatcctgatagtaacctgctggtgggaatagcagtgagcagatgagagtcagacccatgtgacgcccaggagctcctgtctttctggccacacctctgaagccagcaaagaccagttggggtttccagtcctttgcttttgttataaaaagtatgtcaatatttatctttcaaaaggagagatatgccctttgctgttcctgacaactctgtctatatggtctcttttaatggccacttgctcaggtgaggggtaggaactgatcccttatccccagtaggcctcacagctcagagcctttggtttcacaaaccctggatggcatctgcctgtatgttttacgtgtgttttgttggaaggagtacaggaaagtgtattgctaggccacacagaagagagaggaaggatctaaaaaaaaccccaagagtacctttgaacaccagctctgggatcctcttgtcctgtccccatgaagatcagtgtagtgagtggtcaggcccacctctgccctgtgggggccatagtgtcctttgtatcaaaaagagtatgctataggaagttgtaacctctgtgcagcctgtgtcctttgtcatttggttggggtggaggcaggtggccactggcctaagggataaagtttcactcatacaatcaggtctggctttcttctaattttatcccccttgttgctgtcccttgactggacatgtaggggactctggttcttagtgctgcaggtgactgaccttgcacatactactttgggctgggactctggccacatggaatttttatttggatccgtagtgccagaaggtgctccaaagaggtggcactagataacctgctccacccccatctggatcagggctcccttcttcccatgcctcaccagccaggccgagacagtaccatgcctctgtcccctacatgctcagaaagtcaagtcagtggtatcctgatgaacccccacagggccaggtctgtctgtgtagggaagggcaggcatgactggaaagagcccaaatcaagctgtcctcccaccccctcacaatagccctgccagttggatgcctagaatattttacaactcgagagcatgaaacatgaagaggttaagtgcccaagcttccccaggtatgtgtacaggagctggaacttgaaccctcagccactcactgtcaggcttcatcatggtggatatagggagatttcatctttcacacggctgcaagccctgtgacctctcgaagtatcctggctgactgaacctgacctttggaatagatagaatttgccagtctctaccagttataaggaattctcccacaagcttccagagtgaggcatctgtgggtcaggccaaatttagctgtgtggagctagaaggatggtctgaagccgtggagagagttctggaaaggttggatgcagtcaaaagcaaggtccaagggggcctgggcacagaaccagcacacagggacgagctgaagtgttgtgttcactctgagtgaaacaagagcatcgttccaaacggttacacgttgcccaggcttcgttctctgctcttaaataccttcccatttcatggctgttcagagagtaatcagccagcttcccacttgggctcaggaagtttgtccaggcggcccctaaattagcagggtctgccagctccccctgtctgagggtggtgcttctcttgtgtcagagcagccaccagcatggcacagatggacgctctcctgtaatgacagcagccacagatccagcacttctccaactcaagaacccggaaaatcaaaatcagagcactgcacaggaacatctaagcctcgatgagtttgtagcttccttcccacaacagccatgcatatttggaagagtgctgtaggatgagattcagtctacaggtgaataaaagatctgtagaatccactcatgccaagaagtcctgacagagtggcttggccatgcaacacttctctccccagaagaccagtgttctgaaatttcatgcccagtgcacctgtttctaccttcaggaaccactctgtgtccccagccggaagcccagcttgcagcacagccctcggggctcccaaagactgaaatctggaacagcctttctgttatttggagccatttccagaagtggaaatgagaagagaccttggaagggtagttcaagaagtaacacctctggtggctccaggtctcttcaaacaataccagtttctggtggggaacaaggttcaatagtaaaatgggaagaactttccagatctgagggaggcatagcccaatgtgtaccattcccctagtaccttgtttctgctgaggtaccagtcctcttcttgctcctaacctaccttggctcccaggcccctcccatctagagccccctgggatatcaacctctgtctgcttcttccaggtgctctggcctgctaggcctctttacttacctgcgtgctactgctggcctcctgaggcctctctcctgaggacgaacccaaccaaaagcccagcccctcaaaagctgggatttttgttttgttttgttttgttttgtctagctgacttaagcctcaagagattggtctcagccttcctagtgtggggaccctttaatacccttcatgttgtggcgttcccctgccataaaactattttcgttgctactttacaactgtaattttgttactgttgtgaatcgtaatataaatatttgtggtttccaatggtcttaggtgacccgtgacagggtcttgacccacatgttgagaactaactccatggtttttgtgtctgggatggctacccatttctctgctgactgctgcggctaaccaccttctccttaaagaacgtttctcctaagaccccccgaattgggttaggaaaactctggaaaacgccaggatatttgagggtctcagtcagatcccggagttggtcctgacttggctgcccatctgatgctcacctcttctaaagagggcggaatgaagtttaaggtgggtggcctttccgggagaagagcaaccacaacggacgcgaacttcctgcgacctcatactgaggaaggaaagggtctgaagaaggcgagtcaaagtgggtttctccctagggggagcctaggcagaccaacaagagggagtaaaccgatctggcaagcttcctgtgtgctcctggcacgtccccagaccctggctcaggaaggggcttgctttgaagtttccggcaagacctgcccattgctgttcaaacggcttatttgtctagtggcttaaggaaggggactggcggtgggggtggcagcgcctggcttggcgccgttgcaccctgagggtccgtgcatttgggaactccagcttctgtgaactagaggatgttgagatcaggccgagaaccccagggggactcggtactccggccggctgtttcaggctagcggggagctggagccgcctcgcaccgccactccgcgcagggtgggagggagcgagggaggcgaggggacgagcgccggctccccgcccccatcccacccggttccgatatttagctgaaaggcacgcggctcctaatcggccctttccaggctgagatgtagcggcgctctgcccgcgcaagggcgggggccgggcccggggaggcgcagagtccggagcctgcgagcgaggtgaggagcccgcgtcctcggctgctggagcgggcgggcgggcgcgcatcgccgaggcagatatagaaaggggggcaggttaaaaataaccctcttcggctgggaagctcgcgcgcactctctcgcctcgttcggtgccagaggactccaggggaggtggcgttggggagggcagcgcgggattcccctcctccgccgccgggcggggtgctgcctgcacgccgcggctgcacgtgtgcggggccgcgcgcccaagcccctcggtccggcccgcggcgatctccccagcctcacgcttctggctgccgcccctcccgcacccagagcggctgtaggaagcgctcctttattcattatttacgagcgttaataggtttggggcgcgcggactgggggcggaggcgaggacgccgcggggaccccagcgttcggggaagggtgcggacctgcgggaaggtctacggggcgggggtggggagagctcacacgcaatttcgccggtgcgcacttagnnnnnnnnnnnnnnnnnnnnnnnnnnnnnnnnnnnnnnnnnnnnnnnnngcccccactttcctccctgcacggcccttgcagccgcgtccctgacgcagctctggcctcatttatcatcatctttggtcaagtggagtgtgcaaggaacagctgcttcactcggctgacttccgagggcggctacagcgggaatcaggaaaatgaatgatggaggctggggggccgcccccaggtccgggtgcaggcgggagggaggcggggagcatcttggctgcctttgcctcgtggcaagcgcagcgcccccttcctctctgggcgcccacagtccctgcggatctgtggcttaggacgggcgggtgtgccggaggtcgccgtgaccttgctggggtcagtgggttgggctgcggaggaggcgtcgcggcgtctttggtggccctctccggattggcggaaggccgggagacaaggagggggaggggaataccaatggaaggtgaaattttacctgcccctgagggagtcctgcggattttctcccggcgacagccgcgctctgcctttgtcttacacggccgaaacatctgtagcagcggcggagaggccgcagaccccaccctccgcgccgcgccctaggcagagtaccctgctgcagcccacacctcaatgtggggtcctcgcccgcgcccttccccgcctggtgtcgatggggcgggggctggttgcggaaagggttaatggcctagtcgcagaccctaattgtcagagctaggccccgctccgttccaattaccctaagtagagactgaatgcgcaattaacggagtcagcttgccaactggaaagctgtccccgctttcacgttgagcggaatactccaccagctgacttggacgaagcaatttcctctgctctcccctttctctctcctccagccccttctctttttctctctccttaataataaaattataccaagcagtttgcggtgtggcaggcggccagaaaagcgtttctttaaacgccgccgtctcacaattaggcagcaagaggatttgacacgccgaggcggcctgacaggcggcttcctcccctgggggcgggtgcaggaggggcttcagtgccctgctcccccatatggaacccgcactgagaaggggccagggctgcacctcctgggctgtcagcttgctgcagtgagaagcccttggggcaggcagcaggggaggttctacccagactcctggaagcagcaagatctttccctgctgggctatacagtaggaaagccatgttctctgtttctgtgtgacagagaggcatttggggcacgtaactgctgagcctggtggacaacttactgactctctctctggattttcattgatttcttcgggtttgggattggagtgttgagggagaatgtgcccagttcctggggctggttgcttttccatgccaagctgtcttccgaggaggttgcagacaggactgtctgtgatgagccagagaccctctgctgctaccactgcgagagcagacctagagtccccatgagcacacaggaagagctgctttgaaagcacctgggtacccagaccactggctctagcagccaaactcagaactggaccacggtaggtaggtaggcagtagccactgtaggagggagtttgttctggaagcttccagagggcagccacttgcttccttcatcattttccctcttcctgcccctgggtggccttcagcgacgccttggcagttcactgcgacttaagctacacacatcccctggagcctcagctctgcgctctgcttgctctccacctggacgcttggctgagccaagctgggctcaagagtcagtggacaccaacaggaaaggctgcaggaaagagtgcaggtcctagttagatagtttttgttctgcccaccaactccctcacccactcatgaaactgctctgtggccttcaccctctgaggctgtgataaagaataaatactgtgataagcacaaagccagtagtgtccctctgtcccacttggtcaccatcagagcaatttttataggggcaactctggggccagagtagggctttggagcttaagagcaaacactgaagtccctaccttcaggctcttatccttaggaggcagctcattgtaccattaattatgtaattactgctgtcatgaaccccacatgggagcttggcaggggtcccaggaggggggaggggtggggccttacctatctcttgtggaatgttacagggcacctcctacaccacctctacaagctgagctcatgccacactcctacctctagctcttgagctctttcctgcacccaggcctctcaccttttacttcagggtttgcctgggccatgatgctacctacctaccaaggcctgctgctctggagccagagaacatctaggtactccttgttgcattgaatacccaagtccccagcccaagaagctaagagctaaagtgcatgggtgtgtgtgtgtccactttgtcagtctttgacacctggggctgatggtcaagtgacaacccacagatggtccttttgaactttgccctgctttaaataacaacaataaaaacccttgagacttggttgctaacttttttttttggtctgtgtgtgtgtgtgtgtgtgtgtgtgtgtgtgtgtgtgtgtaaggacaacttccaggagctagtgctccctactgtgggtttcagggatggaagttgatcactaagccattatatcttgccagccctggtaacattttttgcaaatgaaaaacatccctactgtacatttctgacctgtaacctcttaaagcaaaggctgccctgctctggctccttctccccccactttgcttgggaccagtgtgtacagctgcctccaacccccatctgactacagacctccgaagtagactcttcgtccgtccttaagaacaggtctgtgtttaatgtatgaagcagacctgtggccctacctagtttatgcctctcagtccgcccaaataccttgtatcttatcagctgacttcttagtctggatttagtttcacagggttaatgtgacatttggagcatgattcatttaataaatatttattgttctgggcaatggggacatggctatgaataaaataggcaaaaatccctgctcttatggaacttttttcattcgagaggagactggtaatgaggccaaaaggtaagtgctttgaagaactagaaggaagcacaaggggtgtcattttaaatacaatgataacagggacacagtagagttgcatgggtgtctgggaatggttttcctagcaaaagggacaactggcacaggccttgaggcccatggaggtgaaagacttgcccaaggtcaaaagcctagtggcatttagacagcctgctactagcttgacacttcttttctgcttcttcaacaagtaaggtaagccctggtccttctgggagcatggagtggagaggacaagctgtcctgatgagttcggctttctgtaaggatagcactactggggcttggagtgtggaccaacccaagcagcctgggaacccctgtgagctccctctagccagaccccgatctttagaccctgcccgtgggtggcatcagtgagggtaggctagcctgagctggacatgatggacggggcctgctttcttcgtagttggcctttatgtttctccttatttagacagtgagcggtcaataaaatggcccacagtagccacaagagatcgatgaagaagagtagcagctgaggtggctacagagaagacagccctgatggtgggcacagggctagctggactatgggcccctgccactgagggcatcagctgtgacctactgcatcctagtaagagatgctgagggctgtgtccaagaaagaactggtgggccagggtcaatgccatggtgttgcatctcactccagtgccctagcatggtagggatggtaagtctggagttctcacacattgtctagcgaactcagattcagcctcttaggcccccagccttagaagattctgggtccatttttttccccccggtgttgcccaggctggcttgttggcagtgtttggtaattgaatttaaagcctcatgaatgctaggcaaatactctaccactgagctctatgcctaacctgccagactggtcctgaacttgagatctgatccccttgcttcagattccaaatgctgggatcataggtttatgccactatatcctgctaattttctatttcagtgatggagattctgtctgcatgctaggcaagtcttctaaaaagcctgaactacaacctgtctcgtgtctgctacttcttatctctccgcctgcctctgtctactcaggaccccagattcctgcgggaggtggggggaggtagtgtaaaaaagatgttaccaacatggggtggtcttgagaagccgtgctttggggtagttttggggtagagctgcctcaccacgaccaccaccaccaccaccaccaccaagcagatccttcagcctcttcctgatgctagctcctagcccaagaagtttagcgtagtctcaaaggccagtggggtctgactgctcttgtgggttccatgaagattcatccctgcttcccagacaggcccagccctaaaaactaacagagacctctgatgccttctgccgattgatttttttttttttttttgtctcattccttttagatagtctcactgcccccaagctagctagcctgcaagatcatgcaatacctgttttctcctcttcttccccatccacctccctttgttgctagggttacaggctcaccctgctttgtccagctttttttttgcatggatgctggggttctatactcaggttctcaagcttgtacagcaagccctcctactgagcctctcccagcctccaagtcttaatatttattcttcatccataacagatggggagagccttggggtctcacctacccactgctccatgaatatctgtctttttccaggcttcctgggccccataaataccccctttctggttctcaggccttgaatgggttaaactttgaattttcctaagctcccaatcaagttataaaccactctggccaggtgggaggactggtgactggggactcctagtgaagagggaatgggcgtcttcccacctctccctccacctgtctcccttttccctcggagtaacattcctacaaggcccacagtatgcccatctcacttgtagggctcactcttgggcttgatgagcctgtgggactaacgacccttcactagagactggtcaactactataggtaggattgcctgctgagaactagggtacagctcagtggtagaccttgcttaacaagttacaggccctgggtttgtccctagtagcacagaaatatagagccaggcttgcaggcagggtctggcctgctgtagaggggcacataggcatatatttgtctgtcctgagctcagctctgcattcttgctgtcataccaagacactctctcagggtgggactttctggtgtgaggtacagaagaggggtttgatcttcaatgttcagctaacaaacatcctctacccctattaatgtcacctttagtagtagaaaggacaagataaaacataaagtccagttttatcagtggctagcacgcgcgcgcgcgcgcacacacacacacacacaaagtctttgggagaaggctgtgcctgaggctcagcctcactattccttcagtgcactgtttgatggctgtgttgatggcttgccgtccttggctgctggaatgtcaaaggaggttcatccagattgcaagcaccaccagattccacgaagctctgcccttgttgagcctggtacgctcttcatccagtgtctagagtaaccagtggttacaggggtggagtattcatgtccctagggcaatgagggctgctctggattcccatcagctgtgtgccagattctgccaagctggttgaggggaagccttggcaagttcccaggagaagggggaggagcagaagctggggcaaggttcaggttcccttctcaaaccttactgctgttaatccggccatcacagcttcttccctccctgttgaaggtcaccatcacctatggggtattcattcttccatctgctctcctgatgccgcccatgccagtccttcactatctgcgtctcatcccttccatatcctttcctggtgctcttgaaaaataatcataatcacaataattaataacaacagagcccgctgcaagtcttaaagaggcagcacctatttttctgctggcagagccagcagtacctctgtagctagcagctaggatgccaccatgcctgagcctttgtttctgtccctccctctgccagggttggagggtggtgctggggcacatgtttctgcctgtgtcctccaacaggccctgggcctctgagattttaattgaactgtcttttcttagagatagatgctttccacatccagctgcctgtgtgcatcgggaagctggcctgtaatcctgtgtggggaaattaaaaggcataacagctggactgattagatggggcagggacagagcaggcagggaggggacactgttcatggctcccctctttagatgatgtctctggtaatgcattgcattttggggaatgtgttgcagggatacacacacacacacacacacacacacacacacacaactccagccgtagaaatgttaatgatatccacaggacactcagcaggaaatgagagtgatctgggactaataaaaaccgaaatgtaatttgtgcagatatatgagggaggcagatgtagccttcagagcagtccgggtttgtgcgttcttggcttataaacacacacccagggagggcagggagctggcattttgtgtcctggtcttagaaatggcccagcagccatcctgagcaggtgttgcattccccccccccaacccccgcatccagagtgtgctctgctctgggaagatggggcaggaggcaccaggctgccctgcctccagcccttctggaatggcaggcaccacttcgtgtttcatccaaagggcaggtaggcactgtcctagtgaggggctagagacatgtgctgagttgggggtgggataggcagaaagctttaacaatctggagaagaggaaagttgtattcggggcagctgggtcagtcctactgctctgagctctggaggctctggctgcctgggagtgccctgttcaactggatggagctcttttaccccccttccttgggtcagttcccagacaaaggaaggaaagcacctttgtgggatccagactaaagggaggctggatctccctgccaatagctcccactcctgcctttcactcctgtccctgtgaggcacttacctctcttcccccacatttagttcttgacaaaccaaccaaacccctgacacctttgtggtctatggcagtgtgttttgggacaagaactgttccttcctagaggcttgggctgctcagacccagagagcttgaacatcctgccttcaccctgcgtggtggctgggtaaaccctgaatctgtgggatgtggtgccaatagtcagccttctttgtgatttctccaaagcttggggggcattcctgtttttcaccactgaggattttctggggtaaccaaagccaatcggttgaaggaaaccagccgagatagccaagcctggattgtgactccacaaaagcccctggtctacctgcccctgccttccatatgagtgctgtctgtaccatccctgacctgggaaagttcggaggagctcattggggagggacagagaacaggaagggtcgtgtgctgctctccagtggccaggggactgtgtctttgtcccctattagtatgcatccccacactctggactgcataatctgtttatgcacctatgataccaagaacaggaggcaggtgctaccatccttcattcccaggagtccggggaggggatgcttagcagcccccagtcaacatctgccagaagggacagagtccagatggcactacaggggaggcgtgtgtgagcgtgcatggacatgtgcctgataggtcctttgtacatgtgtggattcctgtatgtgcagttacagtggcctggaatgccacctctccccaattggggaggggtcctcacgggtgctcagtgtggctgagtcacgcttaggtacggctacacaaagactaagatgatgggatccagcaggcccccagggaacagtggaattgctctgctaaatgattttgagctgtctacaagggctgggcgtggtagtacagacgagctgatagagaggaggagctggcaagaggggcctggagtggccattcattgtgacttgctctgtgtagcctgtttggactgtccatttcagcgggagctcaccgtagaagcaggattttagagcatacctctcagacccagaggctgtcagtatgtgcagagctggtgggagggtgccggggagggatgctgactgaggcagcgagcaaaccgtggcccatctgaattgtttcccctctgcaccatcctttctcttcacagataaccagcccgagtcatgcagtcttttcgagaaaggtgtggtttccatggcaaacagcaaaactacccacagacctcccaggagacatcgcgcctggagaactacaggcagccgggtcaggctgggctaagctgtgatcggcagcggctgctggccaaggactactacagccctcagccctatacaggctatgagggtggcactggtacaccttctggcacggtggccacagcagctgcagacaagtaccaccgaggcagcaaatccctgcaggggaggccagctttccccagctatgttcaagacagcagcccctacccagggcgctactctggcgaggaaggtcttcagacctgggggggcccacagccaccgcctcctcagccacagcctctgcccggggcagtgagcaagtatgaggagaacctgatgaagaagacagttgtgcctcctccaaacaggcagtaccctgagcagggcccccagcttcccttccggactcacagcctgcatgtcccaccaccacagcctcagcagcccctggcttaccccaaactccaaaggcagaaaccacagaacgaccttgcctcccctctgcccttcccccagggcagccactttccccagcattcccagtccttccctacctcctccacttatgccccaacagtgcagggtggtgggcagggggcccactcctacaagagctgcacagcaccatctgcccagcctcatgataggccgatgagtgccaatgcgaacctggctccagggcaacgggtccagaatcttcacgcttaccagcctggccgccttggctacgagcagcagcagcaagcacttcaaggccgtcaccacacccaggaaacactccactaccagaacctcgccaagtaccaacactatggacagcaaggccagggctactgtccaccggacacagctgtcaggactccagagcagtattaccagactttcagcccgagctccagccactcccctgcacggtctgtgggtcgctccccttcctatagctccaccccgtcaccactgatgcccaatctggagaacttcccctatagccagcagccgcttagtactggggccttccccacaggcatcacagaccacagccactttatgcccctgcttaacccgtccccaacagatgctgccagctctgtggacccccaggccggcaactgcaagcccctgcaaaaggagaagctgcctgacaacttgctctccgacctcagcctgcagagcctcacagcgctcacctcccaggtggaaaacatctccaacaccgtgcagcagctcttgctgtccaaagctaccatgccacagaagaaaggggtcaagaacctcgtgtccaggactccagagcagcacaaaagccagcactgtagccccgaaggcagcggctactcagctgagccagcgggcacaccgctgtctgagccgccgagcagcacgccacagtccacccatgctgagccacaggacactgactacctgagtggctctgaggacccgctagagcgcagcttcctctactgcagccaggcccggggcagccccgccagggtcaacagcaactccaaggctaagcccgagtctgtgtccacctgttctgtgacctcacctgatgacatgtccaccaagtccgacgactctttccagagcctgcacagtactctgcccctggacagcttctccaaatttgtggcaggcgagcgggactgcccgcggctgctgctcagtgccctggcacaggaagatctggcctccgagatcctgggactgcaggaagccattgttgagaaggctgacaaggcctgggctgaggcttccagcctgcccaaggacaatggcaagccacccttctcactggagaaccatggcgcctgcctggacactgtagcaaagacttcatggtcacagccaggggagccagagaccctccctgagcctttgcagctggacaagggtggcagcaccaaggacttcagcccggggctgtttgaagacccctctgtggcctttgccaccactgacccgaagaaaacaagcagtcccctgtccttcggcaccaagcctttgctagggactgccactcctgaccccaccacagcagcatttgactgctttccagatacacccactgccagctcggtggatggtgccaacccctttgcctggccagaggagaacctgggcgatgcttgtcctcgttggggcctccaccctggtgagcttaccaagggcttggaacagggtgcaaaagcctcggacggcgtgggcaaggcagatgcacacgaggcctctgcttgcatgggcttccaggaggatcatgccatcgggaagccagcagccgcactgtccggggacttcaaacagcaggaggcagagggggtgaaagaggaggtgggtgggttgctgcagtgccccgaggtggccaaggccaaccagtggctggaggagagccgccattgctgttcctccactgacttcggggacctgccactgttgccgccccctggcaggaaggaggacctggaagctgaagaggagtactcttctctgtgtgaactgctggggagccctgagcagaggcccagcctgcaggacccgttgtccccaaaggccccgctgatgtgcaccaaggaggaggcagaggaggcgctggacaccaaggctggctgggtctctccatgtcacctctctggggagcctgctgtcctactgggcccctctgtgggtgcccaatcaaaggttcagagctggtttgaatcttctctgtcacacatgaagccgggagaagaagggccagagatggagagggctccaggtagttccggcacctcacaaggctccttggccccgaagcctaacaagcctgctgtacctgaggggcccattgctaagaaagagcctgtgccacggggtaagagcttacggagccggcgagtacaccgggggctgcctgaggcggaagactctccgtgcagggtgccagcacttcccaaagacctcttgctcccagagtcttgcacagggcccccacagggacaggccgagggggctggagccccaggccgggggctgtcagaagggctccccagaatgtgtacccgctcgcttacagctctgagtgagccccagactcctggacctccgggcctgactaccacccccacgcctcccgacaaactgggaggtaagcagcgagctgccttcaagtctggcaagcgggtcggaaaaccatcacccaaggctgcatccagccccagcaaccctgctgccctgcctgttgcctcagacagcagccccatgggctccaagaccaaggagccagactctcccagcatgcctggcaaggaccagcgctccatggtcctccggtctcgcaccaaaccccagcaggtcttccatgccaaacggcggcggccctcggagagccggatcccagactgccgtgccaccaagaagctccctgctaacaaccatttacccactgcgttcaaggtctccagtgggccccagaaggaaggtcggatgagccagcgggtcaaagtacccaagcctggtacaggaaacaagctttcagatcggcctctccacacgctcaagagggaagtcggctttcatggcacctgtccccgccaaaaaacggagcctcatcctgagaagcaacaatggaagtgggggagacgggagggaggagagggctgagagttcccctggcctcttacggaggatggcctcaccccagagggccagacccaggggtagtggggagccacccccacccccacccttggagccacctgctgcatgcatggggttgtctacacagtcatccctgcccagtgctgtgaggaccaaggtgctgccaccgcgaaagggccgcggcctcaagctggaggccatagtacagaagatcacctcacctgggctcaagaaactcgcatgcagagtggcaggggcccctcctgggacaccccggagcccagccctgcctgagagacgtccagggggcagtccagccggggcggaagagggtttaggaggaatggggcaaatgctaccagcagcttccggagctgacccattgtgcaggaacccagccagcaggtccctaaaaggtaaactcttgaacagtaagaagctgtcctctgctgctgactgccccaaagctgaggccttcatgtccccggagaccctgccatcactagggactgcccgagcaccgaagaaaaggagccggaaaggcaggactgggaccttgggaccctccaaaggtccgttggagaagcggccgtgtccgggccagcctctgctcctcgctccccacgacagggccagcagcactcagggcggaggcgaggacaactccagtggaggaggcaagaagccaaagacagaggagctgggaccggcctcccagccccctgaaggccggccctgccagccccagacaagggcgcagaaacagccgggccaagccagctacagcagctattccaagcggaagcgcctcagccgaggccgggggaagaccgcccacgcttcaccctgtaagggacgtgccactcggagaaggcagcagcaggtactgcccctggatcctgcagagcctgaaatccgactcaaatacatttcctcttgcaagaggctgcgggcagacagccgcaccccagccttctcgccctttgtgcgggtggagaagcgagatgcgtacaccaccatatgcactgtcgtcaactccccgggggatgagccgaagcctcactggaagccatcctcctctgctgcctcctcctccacctcttcctcctccttagaaccagctggggcttctctgaccacattccctggaggctctgtgctgcagcagaggccctccctgcccctctcctccaccatgcatctggggcctgtggtgtccaaggccctaagtacctcttgccttgtctgctgcctctgccaaaacccggccaatttcaaggaccttggggacctctgtggcccctactaccctgaacactgcctccccaaaaagaagccaaaactcaaggagaaggcgcggctggagggcaccttggaggaggcctctctgcctctcgagagaacactcaaaggcctggaatgttcggccagcaccacggctgccgcccctaccacagccactatcactacccccacagccctggggagactgtccaggcccgatggcccagctgaccctgccaagcagggccccctgcgcaccagtgcccggggcctgtcacggcggctgcagagttgctattgctgtgatggtcagggggacgggggtgaggaggtggcccaggctgacaagagccgcaaacatgaatgcagcaaagaggcccctacagaacctggtggggacacccaggaacactgggtccatgaggcctgtgctgtgtggaccagcggggtgtacctggtggccgggaagctctttgggctgcaggaggccatgaaggtagctgtggacatggtaagaggctagagcagctggggtgggctagggcagtgtgaagtaccaacaggctggcagaagtgtctccagggctctattgtgggctacttgtgcccatagccaaagagtacagcctccagccctggggtctcttgggggagtatggaggcaagttgaagcacacccggggctacagcagagcacattcatccatcttgccccaaggtatgtgctacagtttctatgttccactgggcccagtggagcatactgctcacacatactaccccacaccggagttgctgggtcccagcaagacagaggccttccagagttgaatgccaagatggcctggtctcccctgaactgggacatagggggtagcttctaaacaacatgtggctaaagtgtgggacactggtcctgggcaaccctggcttacctggccaccggagccctgaagcgcagacctccagttttaagtcatcccttcagagaactgcagcatgtactgcccccagccttgctcctgcctcccctgtggggcaaggtcacaggacctagcacattaacacctattgatctttaaggctatatctgggatcacaggtctgggaaggagaaagcattttgagccgtggctgcagctaagagtcatcaggctgagggactggcagaggccacttcagagcccatgctccctgaaattttggccccagggcagcaaggccgcttcctgcctttgcagattgtgccctggttcctgggcagtgaggctccaggcccactcctccacactggttctttcagggtaaccgtgctggttctgttggtctccccctcctccccttcctcctctctgcacactgtgggcagctgagcctagaggaccccactgtccaatgcccccctcctccccatactttattgtcccagatcttgagaagtgttctgcccaggcagcccccccctcgaccttagggaccactgtggatgctgcccctggctccaggctctaggctccaggcacttactgcccatggtgacaactatagaatctctctgggccctgctgtctgcccaccttggtgaaaaggacacaagaacatcacagctttcaggacctcagccagttgatgagcaggcaagacatcagccacacatggtccacatatcctcttcctgcctatcactggttccttggtaactatcttcatggctaccttaaaataatctcatctctccattagaaagtaacaagctggagagatggcccagcagttaggagcaacggctactcctccagagaaccttggttcagcccacagctgtctgtaattccagttccaggacacctgacactttcacacatacagtaggcaaaacaccaatacatgtaaaataaaaaatcattttataaaaagaaaaaaaaaacctggatggaacctctgtccagttggttgtcctgaccctgcaccatccagggctttggggcccagggttggcagcaagtcatctcatgtccccaacccgacataaacaaggagaaatactggtaagttgaggtaaaggcccctgtaccctggctcgggctgtacctctggcttcctcttcctgtgctgccatccacagactgtcttgttgagctgagggggctctctctgctgagccgtcagctctgccacacctcagagtaacagtgaaggccaagagaggcccccactggacgagggttagctgcataatgaagacttccctgctagaggtggccctggctgacagctgggacctgttgccaggctgtcccccagagccacaggctcaggacatggccgcctagaatatgctagagaatagacgagggtgtttcccaggttccctgaagtgacctgcagggttatagttcagcccattgctttctgccccagtggcttgggactaccttctctaggaaccaggcagaccctggttcaaatatatctccaggaagcctgacttcctgtgcaagccccagcatcagcacccacgcagtatacaggccaggcctttggtctctcctgtcgtccatagtccctgctgtcttcacagcacgtccactcaggccgcccacgtccctagactgtgtcatcctcatttcctggctagggagggcaggagactggtggcctctagtgtgggtgtctgggccaagaaggggggcacagttggtcagctatgccccttgtaagagaactggggacaagacaatagctttcatccttctatgcttcatgtctgcagtgagcagagccctgcctcgggagttgcttgggactctgtcacaggggggcccaaaagagtcttgcagtgcttccaagggccattgtgaatgagtgagacctggtctacttggagtctccatttgtgcctccgttgatgccttaagagatggacctggggctctagatccttgggtggcttacccagagcctctgctttaatgtctgtccctgctggccactccagctacagagagttagaacagagcccaccctgccagggcagcctgggcctgctgagctgcagctcaggatctgcctggaagtttgagcttactggttgtccccagctctgtttccttgggcctagagaagttcattgtgtgctgggacttgcaccgagtgcattgttggtgtagtgcttagcctctgagcctgccgtgtcctctgcttccctcctacctcactgcccacagtggtgacaggcttggggacagggatggccaaggcccatctcttatctttccctgtgccaaggtttggtgtcgatcctccattagacttttgtcttgtcctagcctctgagcccagcaaaagtcaggggctggacatattcttggggtgggagggtcatcagattcacttgagatcagcctcttgggggtcatatgtcaattcttcccccagctcatttctacgtatctgccgccatttgggtagagtgcttcttgcctgctctcacatgaaaggggcctctctcaccatctggaaagtggaggtcagtgaaagccacaccccttgtggctgctagaaggagccagtggctggggacacaccagagccagcatgtaagcagcacctgacagatggtggctgccagccttggccactgtggtgactagcaccactagcccaagagggtcccccatgcagtgtgccagcccaggaggtggcagagggccagcccttgagggcatatccctccatgctgcattgctgtgccatcccggcagaagtgctgctgggcctgtagaacacacaaggactcacttgccttcctctctctccagccgtgtaccagctgtcacgagcccggggcgaccatctcgtgctcctataaaggatgtatccacacctaccactacccatgtgccaatgacacaggtaagagctggcttcaggggcctgggtacaactatttcaacccagaccccatgtgcctcccagggcattcacctgccccaggaactttatcttgttctcttcacctctgcctgcatttggctgtggagatgggtgcgtcagcccctacttagctgatgttgaggacttccagagctgtcgggactcaatgtgcaaagtgaagcaggtctctgtggtctctgacaggtccctatggcccaccccattcttacttattctccgtgggccacaggactcagaagcccagccttaatccatctagtggggaccttaatcacttgtctataaagaaagcatctcctcactggggatggcaacaccactcttgtccaggctcagccctggtggctctccttcctgtgcctgtcatgcagtctttgtacttaggccccatccacagagctggactgtgagccgctcttcactggagcagcagcagggtaaattaacactgtctagaaggtatagcgtcaccctccctccatcccacccagttctggcctggtcctcccagcctgagcagtcgtcactgcactgctctttctgctttctggatccggagccagcgtcagccacagctaatcagtctggggggggggggggggactgagctgcacccaccagaaggggacggtggtgggtaccgggctggggttatcttgggctctgccccatcagcatggtggcctgtgtggaatgtggacttacccgagtgcatgggttcactccccatccagctacctcagccgaggtctggggtgtctgttctcccccactccaggccagtccagcttccccagggcctcaacctgaaggggactgattgccaggaccgccatgtctgttagagatggctggtgacttctccgttgctatgataaaattccaacaacagcaacttagggaagggaagatttattttgcctcacagttccaagtcccaagttatcatagtagggaaatcatagcaaaggcacttacgggagccagccgcactgcatcagtaaagaagcagaggagccaagcatggtgggacacttttaatcctagcacttgggagacagaggcaagcagatgtcttttgagtttgaagccaacctgttctacataggaagttccaggcctgccagggctatatagctcagatggccaggcagttgagagctccctcagaggtttcaagttcagttcccagcacccacacaatggtggcctacaaatcccgctccagtggatctgatgccctcttctggcttctatgggtactgcattcatgtatacaagtacatactcagccatacatatactttaaagagttcaaggccagcatggtctacagaatgaatctaggccagccaagactgtaccccctacccccagataataacaataactttaaaaaaaggtagtagcaatggagaacaacagatctcactgcaattaacctaatcaagatcctccctcatggggctggaagaggtggctcagcagccgggagcactagctgctcctcaggagcacttggctttgattttcagtactcacatggtggctttatagtcatctgaaactccaggtccagggcatctgatgtccttttttggcctctgctgacactaggcacacatggtatataaacctacattgtagtcaaaacaaccataaatgtaaaatttttaaaaagttaatcccttcacaggcattcccagagacccattttccaggttattttaaattctttctagctgacaatgagcagtactcacatcagatcgggagatagtgtgcttataaagaaagccattctctctgagctggaggaacgtggggaagattccagatgggcaacattggagccaggccccaaacatcagatgccttaagccatgcctggttagttcaggactgcagagcaggccttgaacactcaacagaaatctcagactcaatagatctgaggctgagaggggcctggggcggtgagacaccagcctgacaggctgatgagccagcagtcccagcaggggagggtggttgtctggtaaaggtggagccatacatgctagagactgcaggacagaattcacaggccttacaatgggagagcaggcatggggcgcctggtttcctcactttacaatgttgatctgggcagggctagcatgggaagattgggcatttatagctgggttaagctcctgacccttccatacccagtttggtggcttcttagtaccttctgggccagtgctgtctgcttcaggtggttggcctagcacatcccctgatagtagcggggccctaacaaggaacaaggcttgtagcttgttttttgttggccaaaggtgggtcacataaagctccggtttggagggtgggtggggactacagagccaggtagccgagggtagggcacggtaggaggcagtctctgccattgggctcctgacctcagcattggggcttgatgggggactctgaatagctatcagggaggtggagccctgggaaacagcagtcatggcaaatgacaaggtcagagtgcctggccacgtggctaggagtacaggaataatataccacatgggccagccactcctaggtgtcctcagactcctaggttgctagaaaggactggaaacccccttttgcctctcacaagagcatagcagctatagcacaggatccagtttaaacatctgtattcagtcccaaagctacccccaccccagttcctgctctcagctgagctgactgggaagtagcaaggccccactgttagcaagcacccgtaggttatagctaaaccttggtccagtgtaggtgcagtcccaaacgtgtgtgcctgcgtgcacccacccccagcagttggccctagaagacaacctctcctgcagctttctcaagtgacatccacctccctcccctctgggtggagaagagggaaggaaacaggaagttctgcaccatccctagtgtgagatgggaggcgatgtctgggaaggtgagccccgatcagtagccgagaagggagcaatgatggacccaggaggcctgtaggtagagcggacaccagaggacaatggctaggttttcttatggcagctggcaaggactcatgatagcagcacactgccctgggtaggaataacaactggcttgcttagccatcctttgtggacatctgggggattcatctagacctggaccttgtaacctcctactgctgtctcttaagaataagcccttccgtgtggaacatttcctctgaacgtgaagaaggatcatgagagcacacagtaggtgacattgtgattgatctacaatatagaggctgagattctgtagctgacatttcagtcaagacctgagactccactctgcagttgtcagtcacccaagcaatcatggggtgctttctgagcatggacctctcctggccactgtgcaggaggttgggtcaggagtgggcatgtctgagaatgagtgttccttctcctttggggagacctgggtaggagggagatggccaggtagtggtggccagggtgggggtggggcgggggggggtgtctaggagtggaggccaggaagggacatagcagggtagaggcagaggggctgcacctctggggggatttggactaatgagggttctgagcaagaccagggcatcagaactaacactggcagccagccggctctgcatcaccacagaaacttttctttgctcacaggttgcacgttcattgaggagaattttactttgaagtgccccaaacataaggtaggtgagcaggctccccagagaaagcattccctacctaacccagtttctccctgccctgccagagagtagggaggggtgcaggctgggtcctaaagttactttgccagtctagggtgattgcacagttcttgtggaaggacaggggtggcagcggctggtgataacagtaacgggctgtccctcccacagaggctgccgttgtaatccccgtgtggccgaaactccaaggaagaagagctgcgcccacagccggtccttgatcccatccagggtctaggttccggctgccttgggcgctggcgtgaggcctaggttgcgaagaaaaccggggccaggcttggcgaaggcaggccagggagtggccagacccagggcacaatgtctcaggcggggggcaagtcccctgcaagttctgaaaaagacgtggcatgcaagctgtgcccctgggaagaggctaggctgctggctcagtggacgacgtggggcagacccaagcctttcttagaggcccagcggcgggggacatggctcagcacttggcatggatctgcccaagatcgtggcagcctgggctcaggccagtctatccttgatgcgggctggcctggggtggcgccctatggcttctgtttgtcccctttccagtcttccaccccactgttggagccccgtctggaagcctgaggagactgggcctggctaccctctagcagatgtgcagctgtcccagacaaaacaccaacatgggattcagggactgccactcagctcactcggctcataggcggagacagtgctagattcgtgtacaaacctgtgtacccctctatatatatgttacatagaatgtatatatgttgggaacatgctcgcttctgtgtgtcgctgctgtgcgtcgtgtgctccacagcacagagccctaacctggccttggctggggtcggggccaaagtgatgccccttccccgagcaactaccaccatcaccaccaccacggccagcccccacctgtccgtttgtgtcctcagctctgtccacgctttaataggcctgatgcagccccttctccctgcaacgttctgtacatatgactgtaaaatggtaaacgtgtgtattatatctggcctcgttatatagtgtatatatatgtatacatatacatatatataatatatatgaagactgtaaatgttaagacaactagtgttcttattagtatattgcttcacactgaagattgtgtgtatcgagctgtttctaaaagatgtttattttccttaagagttaaaaaaaaaaaaacagtcattgcattcagaaaaaaaaaaagtcaataaagataccacgattgttttggaagtgtgcggcctgtggatgccgaccagattccctaaggggttgggagtagagggaaggggccgggggacacaaacagggttcccagtctactcactaatgggccctgatccttcgcctatgctggtgcacagagatgactagggaactgtgtgtgtttctggatatacggggttattacctggtggagggctggaaggcaaaggaacaactgagaccatcaaggcccctcaaggggtatgagccatgagatcagagggccaaggtggctcaacatagcatcaccaagccagcaaatacaccttacaacagatgggaagtccggcttcccaaaggacaagccaggaaagatagcaatcagctgaggcagacatctgcctacccagataaacaaaactgaagttataaataatttcattttttaatattctgtacaaaatttctcaacctatgaaaataaagtttgcaaaagtcaaagtagtacatgggcctgccccggagccaggcccagccggatctacactatgtacaggtctcccagggtgagcctcagctagggaaaagccactaaggtgcctacagagcaagagggtgccatcgggccagtgcagcctctgcaatttccagatctgccactagaggtcggcatggtcctgattgcttgtcaggctcaccctctggaagaccacagccaatgacaaaggtcctcaagggaaagctttggggtctagctggaagtgacggtggttccgccgcccaggcgcaggagcatctgctggcagtccagcagtagccggtgatcgccaagcttctctacggtgcgtgccgcctcggccagcatgctcattcgctgcccaggagccgacaggaaggcagggggcagatagcaggatgccaacagcagggcctcggtgtgctcccgccatgtgggccgtggctccagctcagctgcagtgcctgcacagatcacatcaaaggaagggaggcttgggtctggccgagcccacaccccatgtgcaggacaaagtagctgagctcttccacgtggaactcccagtctggctgctttctccacttgggctgggcacacaggggggctcagcttctttcctatgactgcctcaaaaactgtcatccccgctgatttctgtaagtcagctctcagtatgtctcactagaccaagacggcccctgaccctcaccagccctgtaagcacagccacctcctcacctcctttgccactggaacctgccctcctcctcagactgcgatccaggagctggtgtgtccgggcaggacttgctcctgccatcagccgagctgtggcctcatgtaggaatacctgagaggcaaggagtagtcacccgtttcagatttactgtccccccactcccggcttcctacctcatgcccctcagtgtgagaacagtgggactcaccctcctcatagcaggccggaagctctgtgccaaccgccgcaggctgctcaggtcatgttggaaaccacgcagctccagagcagaggcctggggtccattgctggtaccgtgagctacctggactgaagctggtgactgctgccgctgccacagactggtacgggccacaagaagtagatcacacaggagcagctgcatggcctgggatagcaggcagggcagagggaggagtttccctatggacatcaagctttccctagctgagggccaccctgtctcaaggcagcgtcagtaagggcaggaagtccacagcactggggcctgactccaggttgcatcactgaagcactgcatctgcctcaacacatgcaccgcctcctgctacaagcccgcagtcttcccaacaatggctcccaacaggaaccctgccagtctgctccccacaccctccttcctggtggtggcgaaacagtaagccccctctccccaagacttaagccgtcgttaaaactgaggtaaatccatttagcattattctgtactaacaccaagaacctggaaatggacagctgtgaccctggcctagacaggaacccaccctacccctcaccttgtcaatggaactgccagttggtgtagaggctaagctgtcccgcaggtacccactggccttctcacagatggccaggctggctgggctagattccacctttctgtggtccagcagagcccgggcagccttgaaggagtacagagctgccctgggcaggggtctcctgttggggccatggcagacataggaagttagaccaaactacagccctccctgagatctcccgccacggttctagactcctgggaggacagcactgtcctcctgtacagatatttaagcaaagtactgcggggctgactgggcgggagggacctggctggggactcactcagtgtcctgcagcacctgggggatatgctctaccagtgggtacaagcgctcagctgcctcttcatcccgcctcagccagtggatcaccacagctgtcagtgaggcccaccacttggccactgggtctgggcctacagaagagggaaaggtgcttgactttcagccacactgtatctgggtctggcaggagtcaggacgggggtctggagctcaccagtggtggcagccatgctggagctgacagagaaactgcacgcaggagccccggcagcatcagaacagctatttagcaactgcagatatccaagggcatctgagaactccctgaggcaggagagagctgtcaggacacatagcagcagtctcgggttctgggtgaaaatggctctcaccaaccgtccaaccaagcatagtctgactctaggatt

SEQ ID NO: 1928 - DNA, 7217 bp, Mus musculus
ggctactgagggcactcgcaggcgctgctgagcaggaagcgaggggctggagaggcgcggcgcgcacgggagcgcgaaagagaggagcgagcccagcgccagcgctcgcggcgcgcagagaaaggaatcgtgtgagcgctcacatatttttctcccaaggatctcatctggcggtcgggtactggaagaagcgagggggagagcgcaccgttgcagagagacggcaagagaaaagggagactgagagtcgcgccacgccggcgccccaagacccaggaggagcccgcagataaccagcccgagtcatgcagtcttttcgagaaaggtgtggtttccatggcaaacagcaaaactacccacagacctcccaggagacatcgcgcctggagaactacaggcagccgggtcaggctgggctaagctgtgatcggcagcggctgctggccaaggactactacagccctcagccctatacaggctatgagggtggcactggtacaccttctggcacggtggccacagcagctgcagacaagtaccaccgaggcagcaaatccctgcaggggaggccagctttccccagctatgttcaagacagcagcccctacccagggcgctactctggcgaggaaggtcttcagacctgggggggcccacagccaccgcctcctcagccacagcctctgcccggggcagtgagcaagtatgaggagaacctgatgaagaagacagttgtgcctcctccaaacaggcagtaccctgagcagggcccccagcttcccttccggactcacagcctgcatgtcccaccaccacagcctcagcagcccctggcttaccccaaactccaaaggcagaaaccacagaacgaccttgcctcccctctgcccttcccccagggcagccactttccccagcattcccagtccttccctacctcctccacttatgccccaacagtgcagggtggtgggcagggggcccactcctacaagagctgcacagcaccatctgcccagcctcatgataggccgatgagtgccaatgcgaacctggctccagggcaacgggtccagaatcttcacgcttaccagcctggccgccttggctacgagcagcagcagcaagcacttcaaggccgtcaccacacccaggaaacactccactaccagaacctcgccaagtaccaacactatggacagcaaggccagggctactgtccaccggacacagctgtcaggactccagagcagtattaccagactttcagcccgagctccagccactcccctgcacggtctgtgggtcgctccccttcctatagctccaccccgtcaccactgatgcccaatctggagaacttcccctatagccagcagccgcttagtactggggccttccccacaggcatcacagaccacagccactttatgcccctgcttaacccgtccccaacagatgctgccagctctgtggacccccaggccggcaactgcaagcccctgcaaaaggagaagctgcctgacaacttgctctccgacctcagcctgcagagcctcacagcgctcacctcccaggtggaaaacatctccaacaccgtgcagcagctcttgctgtccaaagctaccatgccacagaagaaaggggtcaagaacctcgtgtccaggactccagagcagcacaaaagccagcactgtagccccgaaggcagcggctactcagctgagccagcgggcacaccgctgtctgagccgccgagcagcacgccacagtccacccatgctgagccacaggacactgactacctgagtggctctgaggacccgctagagcgcagcttcctctactgcagccaggcccggggcagccccgccagggtcaacagcaactccaaggctaagcccgagtctgtgtccacctgttctgtgacctcacctgatgacatgtccaccaagtccgacgactctttccagagcctgcacagtactctgcccctggacagcttctccaaatttgtggcaggcgagcgggactgcccgcggctgctgctcagtgccctggcacaggaagatctggcctccgagatcctgggactgcaggaagccattgttgagaaggctgacaaggcctgggctgaggcttccagcctgcccaaggacaatggcaagccacccttctcactggagaaccatggcgcctgcctggacactgtagcaaagacttcatggtcacagccaggggagccagagaccctccctgagcctttgcagctggacaagggtggcagcaccaaggacttcagcccggggctgtttgaagacccctctgtggcctttgccaccactgacccgaagaaaacaagcagtcccctgtccttcggcaccaagcctttgctagggactgccactcctgaccccaccacagcagcatttgactgctttccagatacacccactgccagctcggtggatggtgccaacccctttgcctggccagaggagaacctgggcgatgcttgtcctcgttggggcctccaccctggtgagcttaccaagggcttggaacagggtgcaaaagcctcggacggcgtgggcaaggcagatgcacacgaggcctctgcttgcatgggcttccaggaggatcatgccatcgggaagccagcagccgcactgtccggggacttcaaacagcaggaggcagagggggtgaaagaggaggtgggtgggttgctgcagtgccccgaggtggccaaggccaaccagtggctggaggagagccgccattgctgttcctccactgacttcggggacctgccactgttgccgccccctggcaggaaggaggacctggaagctgaagaggagtactcttctctgtgtgaactgctggggagccctgagcagaggcccagcctgcaggacccgttgtccccaaaggccccgctgatgtgcaccaaggaggaggcagaggaggcgctggacaccaaggctggctgggtctctccatgtcacctctctggggagcctgctgtcctactgggcccctctgtgggtgcccaatcaaaggttcagagctggtttgaatcttctctgtcacacatgaagccgggagaagaagggccagagatggagagggctccaggtagttccggcacctcacaaggctccttggccccgaagcctaacaagcctgctgtacctgaggggcccattgctaagaaagagcctgtgccacggggtaagagcttacggagccggcgagtacaccgggggctgcctgaggcggaagactctccgtgcagggtgccagcacttcccaaagacctcttgctcccagagtcttgcacagggcccccacagggacaggccgagggggctggagccccaggccgggggctgtcagaagggctccccagaatgtgtacccgctcgcttacagctctgagtgagccccagactcctggacctccgggcctgactaccacccccacgcctcccgacaaactgggaggtaagcagcgagctgccttcaagtctggcaagcgggtcggaaaaccatcacccaaggctgcatccagccccagcaaccctgctgccctgcctgttgcctcagacagcagccccatgggctccaagaccaaggagccagactctcccagcatgcctggcaaggaccagcgctccatggtcctccggtctcgcaccaaaccccagcaggtcttccatgccaaacggcggcggccctcggagagccggatcccagactgccgtgccaccaagaagctccctgctaacaaccatttacccactgcgttcaaggtctccagtgggccccagaaggaaggtcggatgagccagcgggtcaaagtacccaagcctggtacaggaaacaagctttcagatcggcctctccacacgctcaagagggaagtcggctttcatggcacctgtccccgccaaaaaacggagcctcatcctgagaagcaacaatggaagtgggggagacgggagggaggagagggctgagagttcccctggcctcttacggaggatggcctcaccccagagggccagacccaggggtagtggggagccacccccacccccacccttggagccacctgctgcatgcatggggttgtctacacagtcatccctgcccagtgctgtgaggaccaaggtgctgccaccgcgaaagggccgcggcctcaagctggaggccatagtacagaagatcacctcacctgggctcaagaaactcgcatgcagagtggcaggggcccctcctgggacaccccggagcccagccctgcctgagagacgtccagggggcagtccagccggggcggaagagggtttaggaggaatggggcaaatgctaccagcagcttccggagctgacccattgtgcaggaacccagccagcaggtccctaaaaggtaaactcttgaacagtaagaagctgtcctctgctgctgactgccccaaagctgaggccttcatgtccccggagaccctgccatcactagggactgcccgagcaccgaagaaaaggagccggaaaggcaggactgggaccttgggaccctccaaaggtccgttggagaagcggccgtgtccgggccagcctctgctcctcgctccccacgacagggccagcagcactcagggcggaggcgaggacaactccagtggaggaggcaagaagccaaagacagaggagctgggaccggcctcccagccccctgaaggccggccctgccagccccagacaagggcgcagaaacagccgggccaagccagctacagcagctattccaagcggaagcgcctcagccgaggccgggggaagaccgcccacgcttcaccctgtaagggacgtgccactcggagaaggcagcagcaggtactgcccctggatcctgcagagcctgaaatccgactcaaatacatttcctcttgcaagaggctgcgggcagacagccgcaccccagccttctcgccctttgtgcgggtggagaagcgagatgcgtacaccaccatatgcactgtcgtcaactccccgggggatgagccgaagcctcactggaagccatcctcctctgctgcctcctcctccacctcttcctcctccttagaaccagctggggcttctctgaccacattccctggaggctctgtgctgcagcagaggccctccctgcccctctcctccaccatgcatctggggcctgtggtgtccaaggccctaagtacctcttgccttgtctgctgcctctgccaaaacccggccaatttcaaggaccttggggacctctgtggcccctactaccctgaacactgcctccccaaaaagaagccaaaactcaaggagaaggcgcggctggagggcaccttggaggaggcctctctgcctctcgagagaacactcaaaggcctggaatgttcggccagcaccacggctgccgcccctaccacagccactatcactacccccacagccctggggagactgtccaggcccgatggcccagctgaccctgccaagcagggccccctgcgcaccagtgcccggggcctgtcacggcggctgcagagttgctattgctgtgatggtcagggggacgggggtgaggaggtggcccaggctgacaagagccgcaaacatgaatgcagcaaagaggcccctacagaacctggtggggacacccaggaacactgggtccatgaggcctgtgctgtgtggaccagcggggtgtacctggtggccgggaagctctttgggctgcaggaggccatgaaggtagctgtggacatggtaagaggctagagcagctggggtgggctagggcagtgtgaagtaccaacaggctggcagaagtgtctccagggctctattgtgggctacttgtgcccatagccaaagagtacagcctccagccctggggtctcttgggggagtatggaggcaagttgaagcacacccggggctacagcagagcacattcatccatcttgccccaaggtatgtgctacagtttctatgttccactgggcccagtggagcatactgctcacacatactaccccacaccggagttgctgggtcccagcaagacagaggccttccagagttgaatgccaagatggcctggtctcccctgaactgggacatagggggtagcttctaaacaacatgtggctaaagtgtgggacactggtcctgggcaaccctggcttacctggccaccggagccctgaagcgcagacctccagttttaagtcatcccttcagagaactgcagcatgtactgcccccagccttgctcctgcctcccctgtggggcaaggtcacaggacctagcacattaacacctattgatctttaaggctatatctgggatcacaggtctgggaaggagaaagcattttgagccgtggctgcagctaagagtcatcaggctgagggactggcagaggccacttcagagcccatgctccctgaaattttggccccagggcagcaaggccgcttcctgcctttgcagattgtgccctggttcctgggcagtgaggctccaggcccactcctccacactggttctttcagggtaaccgtgctggttctgttggtctccccctcctccccttcctcctctctgcacactgtgggcagctgagcctagaggaccccactgtccaatgcccccctcctccccatactttattgtcccagatcttgagaagtgttctgcccaggcagcccccccctcgaccttagggaccactgtggatgctgcccctggctccaggctctaggctccaggcacttactgcccatggtgacaactatagaatctctctgggccctgctgtctgcccaccttggtgaaaaggacacaagaacatcacagctttcaggacctcagccagttgatgagcaggcaagacatcagccacacatggtccacatatcctcttcctgcctatcactggttccttggtaactatcttcatggctaccttaaaataatctcatctctccattagaaagtaacaagctggagagatggcccagcagttaggagcaacggctactcctccagagaaccttggttcagcccacagctgtctgtaattccagttccaggacacctgacactttcacacatacagtaggcaaaacaccaatacatgtaaaataaaaaatcattttat

SEQ ID NO: 1929 - protein, 1243 aa, Mus musculus
PARVMQSFRERCGFHGKQQNYPQTSQETSRLENYRQPGQAGLSCDRQRLLAKDYYSPQPYTGYEGGTGTPSGTVATAAADKYHRGSKSLQGRPAFPSYVQDSSPYPGRYSGEEGLQTWGGPQPPPPQPQPLPGAVSKYEENLMKKTVVPPPNRQYPEQGPQLPFRTHSLHVPPPQPQQPLAYPKLQRQKPQNDLASPLPFPQGSHFPQHSQSFPTSSTYAPTVQGGGQGAHSYKSCTAPSAQPHDRPMSANANLAPGQRVQNLHAYQPGRLGYEQQQQALQGRHHTQETLHYQNLAKYQHYGQQGQGYCPPDTAVRTPEQYYQTFSPSSSHSPARSVGRSPSYSSTPSPLMPNLENFPYSQQPLSTGAFPTGITDHSHFMPLLNPSPTDAASSVDPQAGNCKPLQKEKLPDNLLSDLSLQSLTALTSQVENISNTVQQLLLSKATMPQKKGVKNLVSRTPEQHKSQHCSPEGSGYSAEPAGTPLSEPPSSTPQSTHAEPQDTDYLSGSEDPLERSFLYCSQARGSPARVNSNSKAKPESVSTCSVTSPDDMSTKSDDSFQSLHSTLPLDSFSKFVAGERDCPRLLLSALAQEDLASEILGLQEAIVEKADKAWAEASSLPKDNGKPPFSLENHGACLDTVAKTSWSQPGEPETLPEPLQLDKGGSTKDFSPGLFEDPSVAFATTDPKKTSSPLSFGTKPLLGTATPDPTTAAFDCFPDTPTASSVDGANPFAWPEENLGDACPRWGLHPGELTKGLEQGAKASDGVGKADAHEASACMGFQEDHAIGKPAAALSGDFKQQEAEGVKEEVGGLLQCPEVAKANQWLEESRHCCSSTDFGDLPLLPPPGRKEDLEAEEEYSSLCELLGSPEQRPSLQDPLSPKAPLMCTKEEAEEALDTKAGWVSPCHLSGEPAVLLGPSVGAQSKVQSWFESSLSHMKPGEEGPEMERAPGSSGTSQGSLAPKPNKPAVPEGPIAKKEPVPRGKSLRSRRVHRGLPEAEDSPCRVPALPKDLLLPESCTGPPQGQAEGAGAPGRGLSEGLPRMCTRSLTALSEPQTPGPPGLTTTPTPPDKLGGKQRAAFKSGKRVGKPSPKAASSPSNPAALPVASDSSPMGSKTKEPDSPSMPGKDQRSMVLRSRTKPQQVFHAKRRRPSESRIPDCRATKKLPANNHLPTAFKVSSGPQKEGRMSQRVKVPKPGTGNKLSDRPLHTLKREVGFHGTCPRQKTEPHPEKQQWKWGRREGGEG

SEQ ID NO: 1930 - DNA, 49745 bp, Homo sapiens
  misc_feature (1)...(49745): n = A,T,C or G
ccaggaggaagggattcctaactggtgcttaggaccatggactttggagaaatctattcctccccaccagtatctagaattggctgtggagtcctgccaatgctctgttcctgacatttctagaatttctccctgcatttccagcccctgccaccactttggtctggccccattattgctctctgggggacagtcccagcttcctgttcactggcctcctggcctcccctctcacccccatcaccaatccatcctgcctcactgcagccactgcagactccccaacacacatgtgtgatgctcactgttgctcactctctggggctccccgtggccctcaccacaacatctgtgctctccactgtggcccagagggccacacaccacgtggaccctgcccatctctcatttcttgcctctcacttccactcgagagccagcctgcattctcactactatctctcactctctcctgccttccaggcttttcctctttcccttgctaactccggcacatcccctaggtctcaggtgaagtgtcactcccctgggaagcccctctgccctcctgttcccactcaggtatgacgtagggccctttcccatgcgctggcacttacttgccttctccacgaggctctgagcccacagctgtctctgggtgctcagtctctagcaggtgtatggcatacagtaagcacttagtaactgcttctgagatggacagatgggtatgtgcaagggtggatgggcaggtgggtatgtgtgcatggatgcatggatagaaagaaggtaggctggtgagtggatggatgggtgggtgattgtgaggtatacaggtgagtgagtggatgggtggatggatagatgggtgtgtgtgcatggatgcatggatagactgatgggtgggtgggtggatggatggatggatggatggatgggtgggtgggtaggtgaataatagatgggtggactgttgtgtgggtggatggagaggccaggtggtctatgaggtgagtccagaggcattagaaaatggagttctaagcctttggctttccatgggccccaatttctctgtctgtaaaatggtcagctcagctcctgtgcccagcgtggaggctcaggatgagctggagagaaggtggaggcttcagcaggcagcacatcaggcgctccacagacagtgcatgggacagaacaaggttgcttggcgtccctgcagcccaagggctcccttcttcagggggacaccgatgccctcctccatccctgcttgctcccaggatccttgcccaggtagcagactgggaaccagacccatagagttcaaatctaaacgttgctgctcaccaggaaattccctttgcctcctaggccttaatggcacatctataaaatgggggtgctcgtgtattcatgttctttgcagtttctctggggatcaaaacaatgtgacgaagggaggcagagagaaaaaatgcaatgtgacagggaagatggcacctctcctgatgcccagcacacagagggtacccaggaaatatggggcttagaatctcaacacctgaaagagcagcttctgctgcagcccctgccacaggcgccacactggccacagtgctccctcctagcccttcttcccctggccaaagctacctctggaaactgagttcgaagtttccaaaccttatcccagaccccatagccatgagttataataggcacataattaataatcacgtaattataatgtctatattatttataatttgtatatttatatataatttatttaactgcatctataatctataatttaaaattacatcaggtaagtaattacttacctactatagtgcttctgccacttacaagctgtgtgactttggataagtgccctaacctctctgtgcctctgctgcctcctctatgagttaaaatgtgtagactgcttctcagaacagggcccaacacatgtctggtaggtgtgggaattagccccgaggatgctgatgacaaagcatttctgtatctgttttgctcatgggttctttgctcaaccctgcaaggtgggcatttaatcactatccctattttatgggtgaggaagcggaagcccagcaagttggggtgactcacctgaggtcacacagcgagtcagcagtgggcgtcaggtactcggtgttctttccaaagactcctgaggccctggtctggaaaaagccagctctggaccaggccggaacacaggggcctttctgaaccttcctttcaggggcctggggccgcaggggcctccggcccgtcagccaagtcttttcctcccaacatgccagccagggaacacagacagccggaccccgctctggccactgccccgccaggcccctgtgccaggacagcgtgtccgcccacccgggcagtgaccagctgttcctgaggctgtgggctggagccaggtttctgtcacttcaaggagctcctgtcttcccggccgcacctccacagccagcaaggaccagtcagggattttcctgaactttccctctgttataaaagagtatataaacatttaccttttaaaagtaacagctaacttagttgcgccctcctctgcccagcattggtctggcagctgcatgtacgttgtctcctggcatctgcgcaccatcgtctgaggtgcataatcttgtgcctgtttgcagatgaggaaactgaggcacagggaacttgagttgcctgcccaagcccccacagcaaggcagtgtctgggtggggatttggacctagacagggagcctccctaccaatcaggccttcagggcagagtcttggggcccagaaaagcccagcccagcttctggttttaaattttataacgtgttcctttgttcagatgattgaaggaaagcatattgcaggtagaaatagaatgaaaacattgtaacacatgaaaccaggagtgcctttgtgtgcagctgacccttgaacaatgtgggggttagggacgctgacccccacacagctgaaaattcatgtgtaatttttttttttttttttttttgagacagggtcttgctctattgcctgagttggagtgcagtggcacaatctctgctcactgcagcctcgacctcccaggctcaggtgatcctcccagctcagcctcccaagtagctgagactacaggcatgcatcaccatgcccagctaatttttgtatttttagtagaaatggggtctcatcatgtcacccaggctagtcacaaactcctgggctcatgcagtctgcccgcctccacctcccaaagtgctggaattataggtgtgagccaccatgcctggcctcatgtgtaactttcgactccccagtcaattaacacacattttgtaaacacacattttgcatgttatatgtattatttactgtagtcttacaatacagtaaactaaagaaaagaaaatgttattaaaatcctaaggaggagacaatcgaatctatttactagtcatgaagtaaaagcggatcatcgtgaaggtcttcatcctcgccgtctttgtattgagtagactggggccaggagaaagggagggtcttgctgtctcgggtggtggagggggaggcaggagaggcaggcacactcggtgtaaccttttgaaaaaactatcttgggatcttggctcagttattccgatgctgagtatgctaatcacatctaattttcattgattctgagaaaaacatccacatataagtagactgtgttgttcaagggtcagtcatacctggccctggcagcagcaggtccccacacagcttagcgcttgagccagtcctggctgctgcgtcccccaaagctgtgtacccactgaggaggacgcagcctgtacaggaattcaggtttggttctccttcccctcttgggggctgtttcctcatccgtaaaatgggaggctgatccctatcttgcgcattgcaggacgcaggggagctgactcctcttggcagctgggtcttgtcccatcctactgagggggaaactgaggtcaacccaccagcctagagtcaaacagctggaaagtggcagtgccagatttgagcctgaaaccaggttattttttcagtcaccttgcctagccattcatagaagtttttaaatcttttaggagttatcacatgctcatggtagaaaaattcaaatgcaatttcctttttatacaaatgttttgtacacacttttttttttgagacaaagtctcactctgttgcccaggctggagtccagtggcgcgatctcagcttactgcagcctccacctcctgagttccagcgattcttgtgcctcagcctcctgagtagctgggattacaggtgtgtatcaccatgcccagttaatttttgtatttttatacagatggagttccaccatgttggccatcctggcctcaagtgatcatcccaccttggcctcccaaagtgctgggattataggcatgagccaccgtgcctggctcacttttttttttttttttttttttttttgagagagggtcttgctctgtcgcccagactgtgcagtggtgcagtcacagctcactgcagcctgacttcatgggctcaagcaatcctcctacctcagcttcccaagtagctgggaccgcaggcaaacaccacctcacctgcctagttcattttttttcttgtagaggtaggatctccccatgttacccaggctggtctcaaactcctatgctcaagcaatcctcctgccttagcctcccaaagtgctggcattacagtgtgagccactgcacccggccctgtacacactttctacactgcactttttttcaccaacttgaagactgctccaattaatccatgtggtgcttccattctctgagtactcagccaatagaacctcccagatgtatctccctcatcccccttggatggacagctaggggatcccgtgttttgctgctgcaaaggacattgcagttggtagccttgtgcagatgacttcgggcccaggttagagggcacatgtaatttgcatttgggtccatattgccagaaagctctccaaagaggtagtaccagtttaccctcccatccccaactagattgggcacctctttccccatgccctcaccagctaggcagatgctctgtgccaagaaaaccaaacagctgcttcccttacaaatactcaagggcctgggcatgtgtgggggcctgagtccagcctgcacccgttaccaactgcaagatctcaggcaataggcttcaccccgtggggctcagtttcctcatctgtaaaacagtggtgattggattatggtgagaagtttgtagatgcaaatgcctaggacagtgcctggaacatcgaggccccaggtcagaagtggctgttcttacgagtctgcatgagtcttgtaccccatgactgcagtcatgggatgggggcccagcccctaggatggatgctcaggcctcagacctgtgttttgggaagggatgaagggaagggaagagcaatgtggggaattaccaaggggaaagggtgggattagcttatcccagcttcccactgtgccagtggggaaactgaggcccagaggggcccaggccttgaagtgattgcaagttcagcagcatgaaactgctctttatccgtgcactgctgtcaggaacaaatgctgaatggagagtccggagggttgcccaggccactgcaggacccaagctctgagactgagggcttggggacacagagccagagccttgtcctgaaatcctggagggtgctccttggacaggacaaaacttgtattctctctctgagcccagcctcagcagaacccagagtcttccagggctgagatcttgccgtaccagctgcggtcacagacctgccacactggcttgacctgggagttccttacagctgcagaacccctgtcccacctgacccgctgcatcaaaatctgcgtctcaccaggatgtacactttaatgtttgaggagcactgagactcagccaggatgatactctacctgcctgcaggtacaggccgctgctctatgggcagacctcaaccctcagccccagaatgtcctccccagctctgtcgcagacatacgtggctccctgggaggcatagaaagtacaagacttggacctggctccccatgaactggtggccctggaagttgctaccttttattgagcccctgccagctaccaagcacattatcccatttcgtcccacaacagcactgaaagtttgctgtttaatttagagtatcttgcagcttaggcacacaaagcacagagaggttaagtaaactgcccaaggtcacccagcatatacatatgcaggagctgggatatgaatccagagctgaccccggcaccagagtctagccatttacaatcagagtgggcatgggggcagatggtggctcctctcacccctgaaaccggagccccagcccctatgagccctcacagttcattggtctggctgtggtgaatctgacctctcaaaagcctccctttccggagcagaggcctgcgattctccatgctggagagcccgccaagagggattctcctacaactttccagaacacagcagttctggggccaggccaagctagctatgtacagctggaagaggctctctcccccagatgctgagtgactagaagccaagagggagggagttctggaatggtctgcagcagctggaggtgaggcctgagggggctggggcggggcctgggaagaggggccagtgcacagagtattctgaaccgcagaaagtattctgttcactctgggagaaaaacaagagtgttgttcaaaacagctggacgccaggcccagttgccctcgcctggtttttactcttaaacaccttcgcatttcatggctgttccaaagagagagaaatcagccagttgtccattcagacacaagacaaggcatcagccgacaaccaaaggcaaatattttccgtggtgaggaaagcctcccgggtggccccaggcctgcctctggagcagtggctggctggtggctggctctccccgaaggtcgctgcttctggtcagcagactgcgtgtctgggggactggccaggatccgcacccacccagggagcgctgggggcagcggggcggccatcctaggcccgtagtaaatggaagctcccttcctggcatgagagcagccaggcctccagggaggccaggacagcgtgggccccacagttccctgtcttgaaaccccagcccttgatatcaaaatgggacctgttagtctgttgtcggggagggggatttaactgcccaaagctcttaggccctgagtgaatttttttcagcacaacagtagctacacacagttgaagagtgtggcacatggctacatagggtttgtatttggtctacagatgaaggaacaagacccatgtggacttaggcctcattatcataattctgcagccccaggagccaaatccccacatggaaacccttagtaggtagcctggccaagtgggtagcgggaaatcagtgatggtaggccctgggacttctctctagtcccctccccacccttttttttttttttttttttaatagacggagtctcgcccttgcccaggctggagtgcagtggcgcgatcttggctcactgcaggctccgccccccggggttcacgccattctcctgcctcagcctcctgcatagctgggactgcaggcacccgccacctcgcccggctaattttttgtatttttagtagagacggggtttcaccgtgttagccaggatggtctcgatctcctgacctcatgatccgcctgcctcggcctcccaaagtgctcggattacaggagtgagccactgcacccaggctttttttttttttttttttaaagacaagagttttactcttgtccccaggctggagtgcaatggcgcaatcttggctcactgcaacctccgcctcccaggttcaagcaattctcatgcctcagcctcccgagtagctggaattacaggcgcatgctaccatgtcaagttaatttttatatttttagtagagacggggtttcaacatgtttgccaggctggtctcaaactcctgacttcaagtgatccacccaccttggcctcccaaagtgctaggattacaggcgtgaggcatcgcacccggccacccaccctttttttctcccaagaaaaccagttttctgaaattttcagggggaaccaggacctcctcgcccatgtctttcacccctgggtgcctgtatcctgtattcaccaaagccccacgggcatctccccgattgaggtcccacccctcagggcctaggacagggggaccagggagggcccccagaggctggagtttggaatacccccttctcttctctggagctcagtttgcatgtctgtgaaatgacaggtgatgtcacctcccagaagggcagtttgagagaagtaaaatctattgaggcaccttggacacaggagggggtcagacggcatcagcctttgagggtgctgcagttacacggctccagcagtctgagccttatcaagacctttccagatatgagggaagtccatgcccagtgtctagctggctgggggagaagccccttgagaacccccactctgtaatgctaggctctgcatttgcttaggaggctgtgtccctgtctctccccttctgggccagccttgctttctgggcaggcccaggagtgtcccgggcccagcactcagagtcagcgctgtctttaatctgtattccacaggcatcctcaccccctcccctcccaggagctaggaacctgccaggcttcttacctctctgctggaatctccaccccccaccagaggctgccctcttggggaaggggcccagcccttgaggcctgtctcctccagactagctaaaccacagagagaactccatctcaggttcccaaataggcggtattcttccccgccaccaagctaggcagctcctggcggctggaatgccctgctcctttctcagcccaccacttcctccaaccttccgtcctctgtgctgcagcagggagtcttaccccacctccttcaggagggaggtgctcacgggttcctatgcctgtgggtctccaggattgggcacggagcagtctgcaaaatgtcaagtgagggagagatccagtcaaagccccaggggggcctctgagctcagtcagctcctctgctgctccccacctcttgggggaaggacaggctggggtttgcatgggtggccttttggagagcagagtaatgggagcctacttgaacttcctgcggcctcattccctgactgggggcggagggtagtctgagctgctggcctggggtgcttggccgcaggggaaggggctgggagggaggggtctgggtgagtctaagggagggtgagcctgaaaaggggacggcagcactaaactgccttcggggagtccccactgtgcgcccctggcactttcccagtcccctggcgcggtcgcaggcacgggtggggtctgcctcaaagttgttggtacggccagcccgctgctgtttaaatggtgtgtttgtttagagcggcttagggagggaactggaaatggggggcgggggcagcgccccacttggcgccaccgctgccggagggtctgcgtgttagaagccccagcttcgtaaatgaccgaagaagggtgggcgttgaggagggaaggccgaaaaccaacggagggctcggggccccgggccggccgccccctttttgcggggggagagcaggagccgcctctcgcagccactctgcgcgcggggtgggagggagagagggaggcgaagggacgacagcgccgggctccccgcccccatcccacccggttccaatatttcgcagaaaggcacgcggctcctaatcggtcttttccaggctgagatttagccgtgcgatgcccgcgcaggggcgggggccgcgggccaggggaggcgctcagagtccggagccgccgagcgaggtgaggagcccgcgtcctcggctggtggagcgggcgggcgggcgcgcaaacccgagaggcagatatagaaaggggggcaggttaaaaataaccctctccggctgggaagctcgcgcgcgctctctcgcctcgttcggtgccagaggactccaggggaggtggcgttggggagggcagagcgggattccccctcctccgccgggcggggtgcccgcctgcgcgccgcggttgcacgtgtgcggggccgcgcgcccgggccccctctgcacccggtcggtgggtgccccctccccaggaccgggcgcatctggcagtggccccccgcccgcagccttgcgcggctggagggaagcgctccattattcattatttacgagcgttaataggtttgagccacgggggcggggggttggggggggcgacgaggacccagtggggaccgaagcattagaagaagggatagggagggagggggaagggcgggggcggggctgtgccgcggcctggaggaagaggtctcggcttggggcccggcgagccgggcgcacctctccgtcaggtttctccacaccgccggccgtcgaggctgctcagggcgccaagagggcagcacgggccttagattttgctctcggcctctgtccttcgcgtcctcgcccttaccgaggcgtggggagggagctgcggagccgtacgccccgccctgcgcgccccttgccgccgccgcgtccccgcggcagccccggcctcatttatcatcatctttggtcaagtggagtgtgcaaggaacagctgcttcactcggctgacttccgagggcggctacgggagaatcagggagatgaatgatgggggctgtggggggccgcagccccccggcgtccccgcgcaggcgagagggaggcggggagcgtccagggccgcctccgcctcatggcgagtgcagcgcccccttcctctctcctggcgcctgcagcgaccggggaccgggggaccggggcaccgaggaccgggcccgccccgggaggggactgggcgcggggacgggggggcgcccttcgccggcggagaactggcgggcgcgctgccggcagagcccgaggttgccgtgaccttgctggggtcagcgggctgggctgcggaggcggcggcgcggcgtctttggtgcgctttccggattggcgcagaggccgggaaacaaggcgggggcgggcgggggaacacaaatagaaggtgaaattttacctgcccctgagggagtcctgcggattttctccggcagcagcaggcgctctgcctttgtcttacacggctgaaacatctgttgcagaggggcggagaggccgcaacaacccccacacaccctgcgctgctccccgtccccctctgccccagccgggctgcaggactccaggcgccgcgttaaccctgctcgcgctggggcgcgcgcccgcactcgctgccgcagtccagcgcctcgcgtggggctcctcgcccccgccccggatctggtcctggccggggcgcccggtgacccccctccacctcgatggggtgctgaggtgtaggcggggggcgggggcggaaagggttaatggcctagtcgcagaccctaattgtcagagccggccccgcttcgtttcaattaccctaagtagagactgaatgcgcaattaacgaagtcagcttgccaactggaaagccggccccgctttcacgttgagcagaatactccaccagctgacttggacgaagcaatttcctcctctctctctccccttttttctctccttctctcttccaatccccctccctctttttctctctccttaataataaaattataccaagcagtttgcggtgtggcaggcggccagaaaagcgtttctttaaacgccgccgtctcacaattaggcagcaagaggatttgacacgccgtggcggcctgacaggcggcttcctcccctggggactggggggagggagggggtgccaattccccgctcccccaggtggaacggggactgggaggggctggcctgctgtgcctccccggctgtcagaatggctgcagcgagggggtgtcaaaggcagggaagcgaggggcggttccgcctaggctggggaaggcggaaggcagcggcacattccacgactcctctgggaagctggcgtatccaggagggagaccttgttcccctttctgtttgacagacaggcactctggggcatagagctgtagacggatctcagctctgctgggcgtcctgcacaagccactggcccactctgggcttcttccattaatccctcggcaaaatgagggggagatttgacctagaatgtgctctgcaaaaagtgtcttcccgtggctcattgcccttaacagctggtcttgtaggccaggagagggggggtgtaggcagcaccacgtagaagcaagccggagacccctatgccgtttgggtggcagacccatgggcctcaaggcacacaggagggtggctcggcggggagccatgatgcaggcagctaatagatggggtgactttgcaggattgccagggattggtgccatgaggacagaggatactgaacactagctgcagcagccgggccacttgagctcggggaaggcccagagaatttggcagaggtgggaggtaactgcaggggtccccatttgctctttgcagccccccagtcccacccaggctgctgcttacatggggtgccttcatccttccccacatagttaagcccttcttccagccttccctgatcacctcctctccccacccccatgggcccctgggtgtcactacatctcaacaccaccagggcagttgtatgtgtgtctgcctgcctctggagagcaagggccatgtgctgtttcctgtgtgtctccggcacccagctcggcccacatccagactgtaagctgagcagaaatgtgctccacaggtgaaccagtgcaggcactaggggctctggaggagacagcacacactttgtctctccttcctgattggctgttgcatgcatcctggcctccaggcccctcatcctcaaacctgtctctgggtatcatccctttggtctgtgttgggggttaaatgcactcaacacagaacccagcaccccaatccatctcatctgtttatttatccaagtaatactgaagggacatcgactctggggccagtttctgggtttggagcttagggtcaaacagaggaagtctctgccctcctcaggctacgttctagtgagggaggcacatgtgaaacagctcattgtaccatcaattatgtaattaccgctgccatgagagccaccaaggagcctggcgggggacccaggagagttggggtggcgcctcgcccggtgtctggtgtggaatgccacagaggttctcaccgcctctggaagcctccagcctttccagtccccctcctctctgcacctcctttccaaggccgctgagtgcacctcctgcacgggtctgccctgcctcccccctgagcccagggcactcgcctttctgctctcctgcgttgctctgcttatctgtgctggtcccagagcttctgctgggcccgtgagcactgttcctcctgctctgggtgccatcgagcccatgcagatcccctttgcatcggttctgtcagcatttgaccccaggagcttgtgatcaaattcaggccacagacagtgtctcttgaattctcaagtatgaaagaaaaaactttgtacttggttgataatattttcttaaatgagagctgtccctttttgtaaaatcctgatttctgtctttttcaagggaaaagctcagaagctttggcaccctggcctcccactcccaagtggccgcagtccgctggtgctgagaggggctgctgctgcccctccccccccactttatttgggagcaggatcgccagtttgcctccatacccacctgcccacttccctgccaggcctcgggaagatgttctttgtcaaatgaagcaaagcagtggccacccctgatctcccgctgcctggcccacccacatgtgctctgtgtcgccactccactgctctttctggatattttcacagagttactgtgacattttgtgcattattgattcagtaaatatttattgttctggacaatggggagtagctgtgaacaaaacaggcagaaatccttgctctcatggaacttttgttctaaagaggagaccaataataaagcaagtcaagtttgattacaacaaggtcagtcgtgggggtgcaaggggtgctgtttcaaacagtggtcagggaaggcttattgagaaggtgacagaggtgacagaggagccaagacttggagccagggtagaagctgtgtagttatctgggagtggtatttccagaggtaaaaggcttgcccaaggtcacacagtcagccagcagtcagacaaacctgcagacacttgacacctctgtgtttccacttccccagggaagtaagtcatggaccctctgggcatgtggggtagggaggacaaggctggggccagacagtcctgtgccttcccttagcagccaggccaggagtggtggctcacgcctgtaatcccagcactttgggaggctgaggtgggcggatcacctgaggtcgggagctcgagaccagcctgaccaatatggagaaaccctgtctctactaaaaatacaaaattagctgggcgttgtggcacatgcctgtaatcccagctacccgggaggcggaggttgtggtgagcccagatcgcgccattacactctagcctaggcaacaggagggaaactctgtctcaaaaaaacaaacaaacaaacaaaaaaactagcagtcacacctagcctatctcatccttatcatgcagcctcctacaagggcaggcactcctggggcttggggtggggagaatggagctggctgggagcacctctgtgggtcccatctgacccctgtgccagggtctgggccagccccttggtcttgctaggcccaggactgattgtgtctgatggcatcagcctggcctcgtgggggaaggacaggggctgtgtcccccagcaggacccagacaactgcctgggccaccagacccttgccctgttaactgtctgcgacccagcaatcagcaccccccaccctttttcccttttcttcattttgacagagacacagagaggtggtgacgctttttgttcagtggtgaataaagtgatctaaaaaaaaaattattgtccacaagagactgatcagtacagaactgataataggtgagctcctcccggcagccttccctggggggcctaggaatgcctgcagctgctgtggaatcccatgttgctcccccacacctcacagtggaggtgggactgctggccatctgcccctcgtccctggactgtgggccctgcggcccaggtctcccggcctcttgatagctgtatcccaggaatcggcaccaaggatcggtggggtgggagtggagagcagggcacagctttagagttaggggacctgggcacctaggcagggggcctggctgtgcccatgaacagcaggtggggccaggccagcgggtgggcgtggttaggccctgcagggatcccattcagctggcttagcaggtctcagctgtccccacagctgggtccctggaggagatggtgttgggggctgtgaggggaggctcctcaaacatctggagagtccagatacctctgcactctgaagggcccagagcccccagccacaccagggctcccccaacctcaactgagcctggctagggctgcccttctgcttctcaccccatcactggcatcctgatatttgggacccccagaccctatagagagggtatgttggtcaccccgtgggattcttccttgagcatgggggggccatgaatgaggagggatgcatatccaagcgttgcccacagggagtggtctggaggggctgcctggtcctctggggttcctgatgtcctaggagggtcctccatctgcccgaagcaggcctctcagcccgtggaccctaacctgtcccagaagcctatgggcacccaacctcttgtcttgtgggctccttggaaactcgcccccttcctcccattcaagccaggcccctaggatatggaattgagcccatacgatagcagtgaatctggcgaacgatttctcattttcaccaagtctcctgtattgattattcatcacccacaacagatggggaggcctgaggagttccaccttctccacccctgcctggactcctcctctgccctgtcctcagcttctggagccctggtacactgctccttcattctcaggttcccaggccttgagtgggttgggtttttaaatttttttcttgcagctacaaatcatgaaaacaggtcataaaaccaccttgggtaagtaggtgggatggaaccagtggcctcagagctgctgctggggatcaggaagcccccagtccgtttctttctccctctctccctgcctcccctcagcctccctctctccctttctcttaggaaaaaattccagccaccacctcccagctgggctccctcaggagccacagcagctctggcctacactgtgcccatttcgctgactggggcctcaagcctggggtctgaggaggctttaggcctagtgacctctccctgaggctgcccaggggacagtagttgccttggtgacagtgggtggctggtgaccatcactgcccattagtggacccacccgaggtgggtctggctgcttaaagatgaggacagaataaaaaagtgaggaccctggcctgaggctcaggctgtcacaggctgcagctcagccccttgccccacagcagctttggcttgcatcctgctccaagagactgttcctccaaagtgggagcccctcacgggggctcaggacaggggtgtccacccgtggtccagtcactgccgctgctgctgagggcgtcctgcataggagcttccctgcgggtgggctctgctctggggtcctaagcagggcacttgtcctgaacctcacttttttctgtaaagggggaggagagattaatcaaaccgttgttcaagaaagccgcacagagtaggtgttctgcagccgccttgctcccgcctcagcagtcctatagatttctggagggaaagggctgaggtctttgcctaaaagaagggctgtgccccaggtgtgtgccacactgccgaaggcctgtgagagccgctggccttgcaccgtagggtagctggggtttcgttgtgcccccactatgttcatggcttggagtgaggacacccattgctgtgtcaaggggaatcctgatgccctgggtgctatgtgattccagctcatgctccctgctgtgcctggcctgcctcctctgtccagcgctgagaagactaagttccaggatctgattctaagggtgaagtgttcatgtatctggtgcttagaggatgcactagactccgctcctcctgccttctagtttcagcaagaactttggagataaggcctggaccaagtgtctgagaggagaggcaggttggggagaaacggatggatgggaatgagtggggaccgtccgggcagtgtggttgagctggaccatgaggagtgagcccagtgggtggggggtgccctcccttgtcccctctcaccaccccttctccctccagcccaagccacaggccaaacccacaatctgcctgctaggccacttcttccctgcccccaggttcaaaggtcaccatcgttctgccggggccagggaggggggtgctctttctgccccctcctctcctgaggcctgcccagcccaacccaacccagcccagccctgctgcctgcctcgccttctgtgtcctgtcctagtgctcttgaaaagtaatcataatcataataattaataacaacagagcccatagcaggcctgaggcagcccttaaagaggcagtgcccccttttctcccagcagagctggcagtgggacctggctggcactgagaggcggcctgtgcctttgttcccatccctccctttgccttgggttccagggtggtgttggggcgagcatttttgcctgcattctccatcagcactgggcttctcgtgttttaattgaactgtcttttcttagcaatagatgctttcaccgcatccagctgctcgtgtgtattgggaaacctgcctgtaatacagctcggctaaattaaaagacacagcagctggaccaattaaacagggagggaggaatgcagacggacaggcagggagggggtactggtaatagcaccccctcactgtctctgtctgtctttaaataatgtttctggtaatgcattttggagaatgtgaaaaaaaataaaaaataaagccgtagaaatgttaatgatatccacaggacactcagcaggaaatgagagtgatctgggactaataaaagccgaaatgtaatttgtgcagatatacgaggcgcagccttcagagtggtcctgggtttgcacattctgggctcataaacatgcgcctggggagggcagggagcgggcgctgtgccctcggcctgggcacaggcccgcctgggctgccctgtggcagtctggccagggcaggagcgtgaggctgcccacctggcagggagctgccagaccagaaccaagtgccgtccccagctcctctgggttggcgcgtcgcagcaggaacctcctgtaatgttttatccaagctgccaggggtaggattgaagtgggtcagaagggtgggcacgctgcttgttagggatgcctgcgacaaatccagggagaggagctggagcagagggaaagcggctttgataagccggtgggcaggggctcgcctcgtgggaaagtggccggcccccacactgggctgactctcctgcatttgtgggccagggcaagctgactccagagagcaggagaggtggtcccaggactgggctgacgggcttctgggggccatctggctgccctgggcttgccctgctctcaggcagatggaggccctctgtcgccttccctgcatccatccccagacactaaatgaggaaggcacttgtggtggggtccgggccaaggaagaagggtaaatggagcagcacccccagctctcccccactccccacctttctgcctcttccctgtgcccctccccgactctgcgtgcctctccctctctgtgcccctctccccctctctttgtcccttcctgaccccttcaacaacctggaatctttgtagcctgaggcaagccaccccttccttttggagcatttgggaaccagcactggaaagtcccctatcccctcctgggggcctgggccacacaggccgagctgagcccctttcttcctgcctccgggccagcatggttctgggtaaatcccaaaccctctgggactcggccaatggccagcccctccatgcacttcctccaaaacctggggcattcctctttcttccatccctctttgaggggtcttctggttggccaggccagcgagtcagctggaggaacctttaccctggatgctgggctgtcagatgctctgctctgagaggctcccccaacccaccctgggtcctttcctgacccaggattctgctctgcaggcaggggcaggttagacccctgcctgagccccatcccctaaaatcataaccagatgggctcttgagtgttgcctgccccagccctcacctgctgaggtggggaggaactggccaggaggggacagggctgtgtcgccccatgtgggtggggctgggctgtgcccttccgtggccgtggccctgggactgcatctctactcccattagtatgcactccctcactctgggccacgtaatctgtttatgcacgtatgatatcaaaaacaggaggcaggtgctgccgtcttgcgttcctgggagtcagaggaggggacattttatgtctacagtggcttggcagcccctaatcgatgtctgctagaaggaacagacagattccagatggcgtggcagtgatagaggaggtgtgtgtgtgcatgcgtgtgtgtgtgtgtgcgcgcgtgtgtgtgtgagcatacatatgcttgtgtgcacgcatgtgcgtggggacaggggcagaccctcctcagtccccagcatggctgggtcatgcttgaacacggtcgcgaagggactaaattacaggatccagcaggccccaggggatgagggagcgggaattgctctgctaaatgcttttgagctgtcaggaagggctgggagtgatgggtgggggacattggggaggagctggcaatgggcggggggggcgggtagctccccagtgacctggcgctgggcagccggttttgcctcccgcatcagtggccgtccttggcaagactcagctgcaggcgatgtgggagcgggaattacagagcacacctccctgacacagaagttgtcaatatgcgcacagctggtggggaggctcaggcgaaggggggactattaagagctgcgcgggggagcaggcagggtggggaggtgggtgggcgggcgctttctgaggcaaaaggaagtggcccgtctgaatcgctcatcctctgccccctccctgcccatcctcccctccctccttccctccctccctcccttcctttttcttttcacagataaccagcccgagtcatgcagtcttttcgagaaaggtgtggtttccatggcaaacaacagaactaccagcagacctcgcaggaaacatcacgcctagagaattacaggcagccgagtcaggccgggctaagctgcgaccggcagcggctgctcgccaaggactattataacccgcagccttacccgagctatgagggtggcgctggcacgccctctggcactgcagccgcggtggccgccgacaagtaccaccgaggcagcaaggccctgcccacacagcaaggcctgcaggggaggccggctttccctggctacggcgtccaggacagcagcccctacccaggccgctatgctggtgaggagagccttcaggcttggggggccccacagccaccacccccacagccgcagccactacctgcaggggtggccaagtatgatgagaacttgatgaaaaagacagcagtgccccccagcaggcagtatgcagagcagggcgcccaggtgccctttcggactcactccctgcacgtccagcagccaccgccgccccagcagcccctggcataccccaagctccaaaggcagaagctgcagaacgacattgcctcccctctgcccttcccccagggtacccactttcctcagcattcccagtccttccccacctcctccacctactcctcctctgtccagggtggtgggcagggggcccactcctataagagttgcacagcaccgactgcccagccccatgacaggccgctgactgccagctccagcctggccccggggcagcgggtccagaatcttcatgcctaccagtcgggccgcctcagctatgaccagcagcagcagcagcagcagcagcagcagcagcagcagcaagcccttcagagccggcaccatgcccaggaaaccctccattaccaaaacctcgccaagtatcagcactacgggcagcaaggccagggctactgccagccggacgcagccgtccggaccccagagcagtactaccagaccttcagccccagctccagccactcacccgcccgctccgtgggccgctcaccttcctacagttccacaccgtcgccgctgatgccaaacctggagaactttccctacagccagcagccgctcagcaccggggccttccccgcagggatcactgaccacagccacttcatgcccctgctcaatccctccccaacggatgccaccagctctgtggacacccaggctggcaactgcaagccccttcagaaggacaagctccctgagaacctgctgtcggatctcagcctgcagagcctcacggcgctgacctcacaggtggagaacatctccaacaccgtccagcagctgctgctctccaaggctgctgtgccgcagaagaaaggtgtcaagaacctcgtgtccaggaccccagagcagcataaaagccagcactgcagccccgaagggagcggctactcagccgagcccgcaggcacaccgctgtcagagccgccgagcagcacgccacagtccacgcatgcggagccgcaggaggccgactacctgagcggctccgaggacccactggagcgcagcttcctctactgcaaccaggcccgtggcagccctgccagggtcaacagcaactcgaaggccaagcccgagtccgtgtccacctgttctgtgacctctcctgacgacatgtccaccaaatctgacgactccttccagagcctacacggcagtctgccgctcgacagcttctccaagttcgtggcgggtgagcgggactgtccgcggctgctgctcagcgccctggcacaggaggacctggcctccgagatcctggggctgcaggaagccatcggtgagaaggccgacaaagcttgggctgaagcacccagcctggtcaaggacagcagcaagccacccttctcgctggagaaccacagcgcctgcctggactctgtggccaagagtgcgtggccccggcctggggagccagaggccctgcccgactccttgcagctggacaagggcggcaatgccaaggacttcagcccagggctgtttgaagacccttccgtggccttcgctacgcctgaccccaaaaagacaactggtcctctctcctttggtaccaagcccacccttggggttcctgctccagaccccactacagcagcttttgactgtttcccggacacaaccgctgccagctcagcggacagcgccaacccctttgcctggccagaggaaaacctgggggatgcttgtcccaggtggggattgcaccctggcgagcttaccaagggcctggagcagggtgggaaggcctcagatggcatcagcaaaggggacacccatgaggcttcggcctgcctgggcttccaggaggaggacccccctggggagaaggtggcctcgttgcccggggacttcaagcaggaggaggtgggtggggtgaaggaggaggcaggtgggctgctgcagtgccccgaggtggccaaggctgaccggtggctggaggacagccggcactgctgttccaccgccgacttcggggacctcccactgctgccacccaccagcaggaaggaggacctggaagctgaggaggagtactcctccctatgtgagctcctgggcagccccgagcagaggcctggcatgcaggacccgctgtcacccaaggccccactcatctgcaccaaggaggaggtggaggaggtgctggactccaaggccggctggggctctccgtgccacctctcaggggagtccgtcatcctgctgggccctacagtgggcaccgagtcaaaggtccagagctggtttgagtcctctctgtcacacatgaagccaggtgaagaggggcctgatggggagcgagctccaggggattccaccacctcggacgcctctctggcccagaagcccaacaagcctgctgtgcccgaggcgcccatcgcaaagaaagagcctgtgccacggggcaaaagcttacggagccgtcgggtgcaccgggggctgcccgaggccgaggactccccatgcagggcaccagtgctgcccaaagacctcttgctccctgaatcctgcacagggcccccccagggacagatggaaggggctggagccccaggccggggggcctcggaagggctccccaggatgtgtactcgttctctcacggccctgagtgagccccgcacgcccggacccccaggcctgaccaccacccctgcacccccagacaaactggggggcaagcagcgagccgccttcaagtcgggcaagcgggtggggaagccctcacccaaggctgcctccagccccagcaacccggccgccctgcctgtggcctccgacagcagcccgatgggctccaagaccaaggagacagactcacccagcacgcctggcaaggaccagcgctccatgatccttcggtcacgcaccaaaacccaggagatcttccactccaagcggcggaggccctctgagggccggctccccaactgccgtgccaccaagaagctcctcgacaacagccacttgcccgccacattcaaggtctccagcagcccccagaaggagggcagggtgagccagcgggcaagggtccccaaacctggtgcaggcagcaagctctctgaccggcccctccatgcgctcaaaaggaagtcggccttcatggcgccggtccccaccaagaagcggaacctggtcttgcggagccgcagcagcagcagcagcaacgccagtggcaatgggggagatgggaaggaggagaggcctgagggttcccccaccctcttcaagaggatgtcttctcccaagaaagccaagcccaccaagggcaatggcgagcctgccacaaagctcccacccccggagacccccgatgcctgcctcaagctcgcctctcgggcagccttccagggggccatgaagaccaaggtgctgccaccccggaagggccggggcctgaagctggaagccatcgtgcagaagatcacctcgcccagcctcaagaagttcgcatgtaaagcgccaggggcctctcctggtaatcctctgagcccatccctttccgacaaagaccgtgggctcaagggtgctgggggcagcccagtgggggtggaagaaggcctggtaaatgtgggcaccgggcagaagctcccaacttctggggctgatccgttatgcagaaatccaaccaacagatccttaaaaggcaaactcatgaacagtaagaaactgtcttctactgactgtttcaaaaccgaggccttcacatccccggaggccctgcagcctggggggactgccctggcgcctaagaagaggagccggaaaggccgggcaggggcccatggactctccaaaggcccgctggagaagcggccctatcttggcccggctctgctcctgactccccgagacagggccagtggcacacaaggggccagtgaggacaactctggtggaggaggcaagaagccaaagatggaggagctgggcctggcctcccagcccccggagggcaggccctgccagccccagacaagggcacagaaacagccaggccacaccaactacagcagctattccaagcggaagcgcctcactcggggccgggccaagaacaccacctcttcaccctgtaaggggcgtgccaagcgacgacgacagcagcaggtgctgcccctggatcccgcagagcctgaaatccgcctcaagtacatttcctcttgcaagcggctgaggtcagacagccggacccccgccttctcacccttcgtgcgggtggagaagcgagacgcgttcaccaccatatgcactgttgtcaactcccctggagatgcgcccaagccccacaggaagccttcctcctctgcctcctcttcctcatcctcgtcctcgttctccttggatgcagccggggcctccctggccacactccctggaggctccatcctgcagccgcggccctccttgcccctctcctccacgatgcacttggggcctgtggtttccaaggccctgagtacctcttgccttgtttgctgcctctgccaaaacccggccaacttcaaggaccttggggacctctgtgggccctactaccctgaacactgcctccccaaaaagaagccaaaactcaaggagaaggtgcggccagaaggcacctgtgaggaggcctcgctgccgcttgagagaacactcaaaggtcccgagtgtgcagctgccgccactgccgggaagccccccaggcctgacggcccagctgacccggccaagcagggcccactgcgcaccagtgcccggggcctgtcccggaggctgcagagctgctactgctgtgatggccgggaggatgggggcgaggaggcagccccagccgacaagggtcgcaaacatgagtgcagcaaggaggctccggcagagcccggcggggaggcccaggagcactgggtgcatgaggcctgtgccgtgtggaccggcggcgtctacctggtggccgggaagctctttgggctgcaggaggccatgaaggtggccgtggacatggtaagaggccagcccagccagggtggggagtgtggggttccaaaggacaggcaggcaggcagtcggggagccccttgtttctagtgctacagtgtgggccaaatgtgtctgcagtctcgggacaatctgcagagtcctgagcctctctggggtgtgtgggggaagtggaggcacccatctggctaaggcaggtcacactcacctaccctgtcccaggagacttcccgccggggcccgtatgcccagccaccgccactctcccactcacctggcatcttcaggctccagccccacccagaatccactgggcccctccccatgctgtcaccggagatgccaaggcccagagaacacgaggactcccaagattgaacatcagggctgccccgggcggtgcaagagcaagttgcccaccctctgttcctgtctccattgcctctgggatgaagctaagggctcaggaagaccctctctggcgacacaggcttggtgcatggacccagtcacagggttcctccctctgcaggacagtccatggggtcacacagtcacaacaggcagggcggggcagatccagaccctctcaccattggctctgagaccagctttggaagccatagtcactgagcaccaacatgagagagggaactctggggctgtgccgccatgcacctttggggctgtgacctgccctctctgtgcctccgtcccctcgcccctaacgtgggtatgagggtgcccatggaggaggggtcgggagggttaaaaggtgggcacctctgagcccaccgagcacagcagccctgtgatagtcagtgcagaggggcctggtggctctggtgacagcagggtgacgttcttcgtggtgtcaccacttccccagtaccatagagtacctctgtgcccttctgagggaggggtcagtgggggcggtggggtgcacctctcccccggggccatgcttctgcccccacattcaaccccgactccactgcctcatccagacttccgtggagtgacgctcccggctctcagcgctgtgtggtggctctcagtggggacgcctgcagccttctctggcccctgccctgagtcccatcccctccactccttccttcaacccactatgtgcggctgaggtcacaggggagccagaggggcttggcaggggtctccagaggccctggacaaacactgcctgcatctgagtgattcagtgacccagcacagtggccccagccggtggcttcgcccctccccctgcccagcctcctcccccgtcgctgcactgcccacctgctcctcgcagtacacccctgcagcccctctgagcagcccctgctcctgacagttgccgtggcattgcctggccaaaccaaggtcccggtgggggcccactgtgtttgccacccacgcctcctagtgtgtgtcttgggcacctgcttcccactgcccatggggatggctggagaccttctccacgcccagacgccctgcccacctcactccaccctccacctcagaggaaggctggccccgacaggactcctgcaggttcctggtgccgcgggccttgcttacccagcagatggtggccttgggcctcttccctctccccttcccagttagtgattttttgcctctctcctgctttctgtctctctctgtctctctctctctctctctctctctctctctctctctctctctctctcattactggctccttcccagcgccttgaaacaggttcaagtctctcccgtcatcaaaaaataataaccctcagatcaccagccccagctggctgccacctcccctgcttcacagccccattcctgaaagccttgtccccacggcatcctcggtcccgcagcctcaccaggggctccccgacactcacgtcccaccaggctgagatcaggtcgtctccacatcccctgcagccagcactggccggccgaagggaggaggggtcagccccgagcaccgaccaccccatcctgtccctggcccatgggtgtcttaaccgcccatgcacacacaaggtcctgctggactgaggagacagtgtgtgttggagaggcgctagcttccctacaccacgcgggggctggaacttgccagcccagcccatgcctgtctgctgtgccatgctccagaaatggcctgacagcctgcgcaactagggctgccccgggaaggtcggaaccaggaacaccctgccagacagatgggacatcctgggagaatgggcagagtctggggcttcccagggtcacttttggctcaccaccccttcctgcctcagtggcttgggggcgccatgctccttggagtgagaccctggttcaaatcccagctctgccgagggctggttccatagctccaggcgagtcacgcatgctctgagaactccacaatgtcaaaccccgttagcaggattgtggggttctgtggatcatgtgggacctgcctggcatgtggaaggggcttggggtgcagctgtgtccctggccccagcactgccacacccctcggtaccttgacctcacttttgcgctctggagggcagaacctctgagccagctctcagggataccttttttcctcgatggccttttctgggaactgccctcgcctgctatctctgagccctgcctgcccttcccccaaagccatcatagacccctacctcctatccagatggagcctggccatggaatgcttggggtgagagggacccatagcgggctccgggcattgttagggggctaggtggtgtctgcagaggccccacctgtggcagggtttacatgccgccacccctgccctcctcttgggtagctggggtcagaagggcctgaggcctcactctctctgcatcttagtttcttcacatctaaaatgctattcatatgcctgcctgagggtggttggggcctccgtgcagtaagtggagagaagccttcagccagaggacccccatatgcttaaacatccagacaccaagggccactcacagacagcagccggcttgtgtttcgtcatcccttttgggtcaggaactggggacgctggactccagatctccaggaggccatcccagactaggcgggaaggaggcctcagccctgagctgaaaacctgaaattctagaataaaccccaggccccactcccagcatgggcagcggggaggggagtgttctgacatttctcagctgctgtggttgggatggtgcgcccaccctgagcatgtggggtcctgtgggcccctactccagcctggaggcagctgcaggggtcagagaccagcctggagccctcgggcaggttactcagcctcagctctcattggtaacccaggtaaaataacagtaatcccatcataaggttgctgtgggcatgaggcttccagccatgcctggcacataggaagctattgtcgtttgtttcactggcttcgcacttgggcagaggccgccgccctctctgctgccttctctacctcaccccccgcccccagcacggtggcactgtggctctggcgcctggtgacttctccctccccggcctcaggtttgcttcactcttccaagggccttcttggtgtgactgtcctgtcctggccacgtccactccaagcagctggtccaggtgtggggcagcccccaagctcagcagaggacagttttgagacttagaggaggacggcatcagatttacatgaagtcagccatctcaagggattaccacgtcaccgcctcctctcacaggtctgagagctggtcccctggagggtgcaggtctcatcctaggtagaacagtcccagcctagcttcaaagtgctcctgctgccagaaagggtagaaaaccatgctgaatgccttcactgttgcctggaatgggagcctcagtttcaccatctgtaaagtgagattaatgaaagggacccacagagggctgttagagccagtaggcggccaggcgcggtggctcacgcctgtaatcccagcactttgggaggctgaggtgggcggatcacgaggtcaggagatcgagaccatcctggctaacacggagaaaccccgtctctactaaaaatacaaaaaattagcctggcgtggtggcgggcacctgtagtcccagctactggggaggctgaggcaggagaatggcgtgaacccgggaggcggagcttgcagtgagccaagattgtgccactgctctctagcctgggcaacagagcaagactccatctcaaaagcaaaagaaaaaagagccagtaggccaggcgctatgtcttacacctgtaatcccagcactttgggaggcctaggcaggcagatcacctgaggtcgggagttcgagaccagcctggccgacacagtgaaactccgtctctactaaaaatacaaaaattagctgggcatggcagcacatgcctgtaatcccagctactcgggaggctaaggcaggagaatcacttgaacacaggaggcagaggttgccgtgagcggagatcacaccattgcactccagccccggggggacagagtgaaattctgtctcaaaaaaaaaaaaaaaaaaaaaaagcaagccagtgggcaaggacacacaccacgcccagcacaccagaagcatgcagcagatgctggctggtagccacagccatggtagtaactggcatcactggcccaagggggtctccctacccaatgtaccagcccagagggtgctaaatgacccatgtttgtgggcatgtgtaccccagtgctgaacctccttctggtagattttcaagcaccattttggagaagggaggcagggaccacagggggccagccagcctgtacaggttttttgtgttttttttgtttgtttgtttgtttgttttttgaggcagggtctcactcttgcccaggctggagtacaggcagtggcgtcatctcggctcactgcagcctcaacctcccaggctgcagcaatcctcccacctcaccttcctgagtagctgggactacaggcacacaccaccaaccctcactattttttgtagagacagtttcaccatgttgcccaggctggtatcaaactcctggactcaggcgatcctcccaccttggcctcccagagtgctgggattacaggcatgagccactgcacctggcctaccagcctgtaaagcttgagggctgggctccaactggagactcacctgcctttcctttctcttcatcagatgtgttccagctgccaagaagccggggccaccatcgggtgctgccacaaaggatgcctccacacctaccactacccgtgtgccagcgatgcaggtacgagcccgcccaggaacaggagggcattggagcccatccaagcagtccagggggaccctccctgggcacagctccccaaacccaggccccatctcactcttcagtttccctcctctcttgccccagcaattcttttatccttctgtctgcctagacctctgctgggcaatgccagggacatggaaatgaggcattccccaggcacctgcttgaggagtgcccagagcagtgagggaagatagaagcataaattacaatgtggaatgctgtctgcggagccatcattgccaaggggcagggaggatctcaggcctcagagagaaaggggtattggaggttgggcctttgaaggataaataggagttcactcagcagagacaaggggaaaggcactactacaacagcaaaaaccaactgagttgggggtgatgaggttcaaaacagactgagacccatggagcaattgtggaagttttgaagcagggtaatggggtatggaggtaggcccaggctccccgcatcctctccccggtccttcctctcactcatgtattcatttgttccgcaagcatttgttgagcccctaccatcactgggcacacagaatgaccgtgcatgggctggagccacccaagagcccttacctttatcgaccaggtggggaaactgaggctcagagacattccttatttcatccagagaaagcaattgcttatggtacaatattagtcattggggacaacaatattttgggagatatggggccaactttggcctggattcaaaccctagtggtggggggtggggtggttttcgttcttgtttgagacagagttttgctctgtcacccaagctagagtgcaggggtgcagtcgtggctcactgcagccttaacctcctgggctcaatcatcctcccacctcagcctcctgagcagctgagaccacagatgtgcgcagccatgctggctcctagtagtgtttttatttttatttatttatttatttatttatttatttatttatttttgagacggagtctcactctgtcaccaggctggagtgcagtggtgcgatcttggctcactgcaacctccgcctcccgagttcaagcgattctcctgcctcagcctctcaagtagctgggactacaggcgtgcaccaccacgctcagctaatttttgtattttttgtagagatggggtttcactgctttggacaggatggtctccatctcttgacctcgtgatccgcccgcctcagctgcctaaagtgctgggattacaggcgtgagccactgtgcccggcccctagtagcgtttttaatgtgtggtcttgagcaagttggttgatacctctgcacgcagtttccctacctgtatgatggagatgataatagccccttctctgcagagctgctgggaggagagtgaaataatgaacactacccacacggtgctgcctcagtcctattttgggtccagcctctgtgacctctccccacacggtgctgcctcagtcctattttgggtccagcctctgtgacctctccccgtcaccctcaatccctcccaactctggcctggaaagaggcgaagtcataacccacctcccagtggacagagtccaggcccccccaggctcccgtcgctctcctagcagccccagctactgcctcccgtcctcacctgatgccctgctggctttgcctggacaggggaccacagcctgtaccccacctgcctggtgggtccccagccagtgtcagcccagccaagctgccccagggaggacacagaggactctgagtgctgacagttgcttggcaggggctgagctgccgggacccagcggggaaggggcttgctggagcagggacgtggaggattctcactggcttcacgctcccactctgagcagtgtgagccagagtttaacatggaccctgccacttgcccaggcatgtggccgcactccccataatagctgccacgagtcacattcctccttccacagtgattaacttagcgcccgctccactcccagccctgctacagaaccatgttgtttccagccatcttcacagattggctgcctcacccacagcacacagcatggcgtggacagtcccaggacttaatgccttggctttcttgctccatgtcctatgttctttctcctaccccagcactgcccagccccccaaggggctcacccttgagtgggacggacagcaaaactgtggttcttggccacagttagggagaccagacgggaaggagagagtatgcactgtggaagaggttcatcctgtctgaacaagggagaaatctaggaagacttccaggaggaggtgacatttaagccaggcctcaaaagatcgggggagctttgtagcaactgtttagtggtgggacttgtatactaggctttgagcaagagaacttttatttcagataaaatcctagaaggattcctcatataacagggatccctgtagcaccgtgaagattgaggcaggaaagggactgggaatgctgcaaatggagacatacacctcagagactgagttggcacagaatccatgggacttgatgatgagggagagggaggtgacaagcctgatgcccagcttccccatgaaggggagaagtagggtgtggacgtgcaaatggagtattagctgctgctgcagagctactggcccttccaggcccagcttcatgtctccagcaccagcccttcattagttctcaaaagggcgtgagttggctgcaggctctgctgggagcaggatgatctagggtggccccagctgtgccagcttgtctttgctccatcaatctctcatcctccagcaggctggcctgggtgcgtcctcatggcagccccagggctttgagagagtggaggtcacagggccactcacagcctaggtcctggactttaccacgttctgttagccaaagcaggtcccaagtccagcacagagaagtgcaggccacctggggtgagctgcagagccacaccacaaaggacctgggtgcggggaggggactgggctgctctgccaggccatctacacacacggcagttccctttggccacacggcagtagaggcagctgtggacatacaaagtgtagatagctgggctcaggatcgagtctcgcccaccatcagcaggcgagggctcatcagagccctggaagggacaaaatagcagggttgtgttcaccatggaacagctggctgaggaggagggtggacccctgggaaactgaggaacagctgccagagaaggcgagggagaacaagtgagctcgagagtgaaggcggggaggacgggcgcttggggtgcagggagggcccccagcgtgactctgccagccaggcggtggggggggcgggggggtgggagtgagagggcactgagggagtgggctggtcaggctgatctgatgtctggccagggaggagccccaggcctctgtgtcaggcactgggactgcagggcaccagggctgcccactggctgccagcctctgccctgcactgcgctgtcctggcctactcatcctgcccccttccaattcttgttaaggaacccactttggagacaagcagtgactgaagagcaggcagaggctgctacaccacagtgtcctgtctcaacctttccccactcaggccctggggccaacctgtcagtgagtgcccaggttccccaggtgcaggcaccaggtcaggagccagatcactgaggactggccttgcccagtgactcccgccccgtgccccatgtggggtggtgctggggcagtgctgagggagccagtttggaagtggcgacctcctaccctcaacttcccttggtgggagtgcccgcagctacccaggcgtgccaggggcaggcctgggattttagcctagtgtctttggaatatctagttcagccccagaaccacatctggcttgcctgagccaagggaaggggaacagccgtggcacatctctagctgctggccctgaatggcagtttccaggtccgtggcactccagcttctggagacaagggcagatcgcctcagagaggcctgctaccgcccagccctgccctcagggctgcagagctgtccctgccctgccttctggccaccaccctgtcatgatgccattgcacagagccacctccagtgtgaacaggaagattgtgttggagagagcaccagcctccagctacttttgggtctggggtttgttcagaacagtggctggtgaggctttgggggaggggagccgagaaggggactagagactggggggtccctgggggaaaagccagcttctccctaggtggcagtaggcaggggagtggagactccctgagatagcaacacctcctgggcctaggtgggcataagcactggccatgcttggttgtcctctctgcccctgcctcctgcgcccactgcatgccacacatgtgcagggtggtttatttttaaattttattttattttatattttattttattattttattttattttattttattttattattttattttattttattttattttatttcatctcagacagggcctggctgtgttgcccaggcaggggtgcagtggtacaatcacagctcactgcaacctccgcctcccaggctcaagtgatcctcccgccccagcctctcgagtagctgggactacaggcatgcgccaccatgctggctaatttttgtatttttgatagagatgaggttttgccatgttgcccaggctggtcttgaactcctgggctcaagcgattcattcacctcatcctcccaaagtgctgggattacagacatgagccactgctgctgccaagatggtttctatacactcccatcctcaatctccatgataggcatacagtaggtggcataatgcccattttacagatgtggagactgaggctcagagaagtagcagatgctcaaatccaggcttgcaacaccactaccagtccgtccacaggggttcatgacatgctcactggaagttagtgagctcttccaggggctgggcatacatccagggaagaagacagagctggtgccctctgggagcttgcctgccagtggggaagaaacaaggagcaagacaagatcacacaggccagtctcttaggaggcagtgacaagtgtggctggcagagtaaggcgggagggagggagggactgagggactgcctcaagtgaggaggggcggcacgtggaactcagggggaaaagctctccgcggaggaggtgaggtgagtcaagactgccaggccaggggccgcacccgcgccgtggagtggagtggagtgtggagggttttgtgcagaatctgattaactctttgaaaagagcccctgcagtctggagcctcgcgggcagtgcggctcccctcctggctgcagacaaaaccccacagctgtggggcccccaccctgtcctaaccaccgaaacttctctttggtcacaggttgcatattcatcgaagagaacttttctttgaaatgtcccaaacataaggtaggggaccacagtgttttgtagggcgaggggtgtcaagcgggagaggagccccacctcgcacctccttcacagtcccctgggcccccttggctgcgcagccccgcagggcccagccctaggggagggagctctccccgcccacccccaggagcccccgccgccgtccagctcaggtccctgtccacttgcgcgccgccgccgccgaaaacccgcaggcgtcggggcatgggcagccaggggctggagggcgtccctgggacggcctccctgcagctccccaagataggtgacagagtggggcaggcgggggcgcgggacggtggcacggagctgaaggcgaaggtgaaggtgaagctggacggggtggggccagaaggggtggtgccgacggcctcgggcggagaccccagccgcgctctggggtcgcctgggtctggggcttaggcggggggcccacactgggggcggggcctatggactgtgaagtccgaggtcgtcggtaactggcgggcgggcgtcttttgcagaggctgccgtagtaatccaccccaacggccggaggagccgccggagcccgcctgcccgcccgccgccgaaggagaggagccgcctgcgcagcccccgggcctttgagctgctcccagcgctggtccagagccgatccttgatccgggtcccggatcgtggatccggccgcctagggctcagacttgcggccccgggttgggaggaaaacccgttccggagccgcctgctcccggaaccggacggcacagggcgttcttgcccaccccaggggccaggcttgcggagggggagcccgcggagcggccagactccccggggcgctcagcctccggcgagggtgggagacggctttgtcctggggacactttccctctggaatctcaagacgacgtggcacacattccacgtgggtgctgccgccaccccagtcggtcgtggcgtgcagctgggagccctgggcttgggggtgggggtcgaaacagtactggaagaggcggagggcggctcctagctccgtggactaggcgggggagaaaggaagcctttctgagagcgggctaggccggcactggagaggccggagcctttggaacaaaccgtgcggaacgcgtccaggggccttcccgcccagcctttgccagatctctcgtgcggttcgggcaaagccggggtagacctgggctatgctcagttaggggttgcgggatccccgagtgtgggcgggactgggacaccctttggcctctgtttgtcccctttccagtcctccaccccacccctggagcccagcctgggagcgcaaaacccaagaagcggccagaacgcacctccggctccggcggacgcgcgaccgttgtgcaccaccagggaccgccgcgcctactctgcacgggagcagggacagcgctagatttcgtgtacaaaacctgtgtacccctctatatatatgttacatagaatgtatatatgttgggaacatgctcgcttctcccgtgtgtcgccgccgtgcgtcgtgcgcccgcaacagagccccaaccgggcctttgccgggtaaggggctaccgcgacgccacttgtccacgcagccaccaccggcccgggccagtccctgccagtccgtccgcctgtccgtccgtgtcctcagctctgtccacgcttcgataggcctgacgcagcccccagcccagggccgccctagcaacttcctgtacatatgactgtaaaatggtaaacgtgtgtattatatctggcctcgttatatagtgtatatatatgtatacatatacatatatataatatatatgaagactgtaaatgttaagacgactagtgttcttattagtatattgcttcacactgaagattgtgtgtatcgagctgtttctaaaagatgtttattttccttaagagtaaaaaacagtcattgcattcagaaaaaaaaaaaaaaaaaagtcaataaagatacaacgattgttttggaaaatctgcagcccgtggattccgaccagattcagctgggagccgggccaggctttaggttggggaatgggaatgaagggaggggctgggggggggggcatgaatggagtcagggagtcggcctttcacagaacaggaaacctcccccgcccctgtgccccctctccagtgtggcggcaggtcgggagggaggaggcttctttgctgtgagatgaccaggggccgggatgggggaggtgagacgtgccagacttcttgcagggagacccaagctgtagctcctgtcacacaacaggtcctggaagtcagtccatcctcccgtgccacccagggacctgatggggacagagctgggaggtgagaagggacaactgaccccatggaggccctaagggttgacacagcccaaccatgtgccctgggagcagggggaacaggtaggctggaggccatacagccagccctccccactcctcccactaacaaacaaacatcgggaagagctaagttaaaagttgtgtaccttgtggccggagggggaggggaagcctttccctaggtgctgggggagggcccaagcactctcactagtcagcacatccatcagctgaagacacaaaacccagattataaataatttcatttttaattctctgtacaaaacttctcaatctatgaaaataaagtttgcaaaaggcaaagtagcacaggagcctcaggtcaggaggctaagcacgctgacctacactatgtacacgtctctctcccacgacggagagagaggcctctggggcagagccctgcttgcagtccgggaaagccaagttggcttccgtcagcacagggaaatgtacccctctcttccctgtacacaggaggaaaaaagccactaaggtgcctgcagagcaaggaggggggccccccaaaatggctcggcccctgcagtgccccgatcggccaccagaggtcagcaccatcatggccgccggtcttagggtcaagatcgcgcccctcgggccttccaccgcgaaggcacacagcagccgcaggtcgaactgtggaggccagagtctcttgcactgccttcggccttcaaagcttcgacgcaggacagaagctgcacgggaccaaagtggctagagacaggggtgctgaggccggggacacggggtctagctggaagtgacagtggtcccaccgcccaggcgcatgagcatctgctgacagtcgtgcagcagccggcgatcgccaagcttctcgagtgtgcgcgccgcctcagccagcatgcccacgcgctgcccgggcgccgacaggaagccggggggcaggtagcaggaggccagcagcaaggcctccgcgtgctcccgccgcgtgggccgcggctccagctccgccaccgcgcctgcgcacacgaggatgtgtcagggatgggtctcaagctggccacgcccccgcgggagccctgcccacacacaagccacggcaccagccgcctgtacctggcacacaggtacctggcgggggcctggcgggttcccctctccccaccctagtctcagcccacacacaaagtccacagactgagtcacgcacgtgcagtcatgtatcccacaaatgacagtcaccccactgattccttgtgaaaggaattgtcatcaggtaaccatcaagaagatgcttggtctttttttttttttgagacagggactctccctgtcactcaggctcactgcggcctccaactcctgggctcaagctgtcctcccaactgagcctcccaaagtgctaggtgtgagccactgcgccaggcctgtctgtcccgtctgacacacacacagcctcccttggtatcacatcccatgtgcgcccttccctgctgagcagacagcacatccctggtcagcagctgccccctcacctcctttgccaccggggcctgcccgccgcctcagactgcggtcgaggagctggtgtgtccgtgtggggctggcccccgccatcagccgggccgtggcctcatgtaggaacacctgggggccaggagagtggaggctcagggctctccatctccaccactgcctgactccccgtcttgaggacagggccatcgggcactcaccctccgcatggcgggccggaagctctgtgccagccgcctcaggctgctcaggtcccgttggaagccacgcagctcaagggcggaagcctggggcctgctgctggtgccctgggctgctggggccggggccgggggctgctgctgccgccacaggctggtgcgcaccacaagaagcaggtcacacaggaacagctgcacggcctgggggtggcaggcagggcaggggtcaccagggctccagctctgggaggggcaggatgggggcccgtggtgccaggggccggctccgggctgcactgccgaggcactgcacccgcctcacacacgtgcaatgcaacagcaatgcaccgcggggccgcccgcctctctcggcccccacacccgccaccggcccgggagcagctgtccagccctcctgatgcagggcctccaaagggatcctaccacaccatccacccccctcctcccagggatggggaaactgaggccagataggggcaacccctctcctctggacagaagccttagccaaaaagcagggtctgctggaccccctatcctgtgctgcttgggctaaccccatggtcttctgcagcccctgggggctggggagaggaaccagggaatggaaagctgaatcccccagccctgccaggcccctgaccccacccctcaccttgtcaatggagctgctggctggtgtggtagccaggctgtcctgcaggtacccactggccttctcacagatggtcaggctggctggaccagactctgccttggcacagcccagcagggcccgggcagccttgaaggagtgcagagctgccctgggcaggggtctcctgttgggaccagggcagaagagtgccagtcagaccagtccacaagccctggctgagtgccccccacttccctggctcgagttccctgaggaaaaaaggtggtgactcctcctgcacagaacaaaggctgagtgaggcacagtgcccaggggatgaggaaggctgagcccgggaccaggcaggaggaacctgccgtgcactcactcagactcctgcagcacccggggcaggtgctccaccagcgggcacagccgctcagccgcctcctcatcccgccgcagccagtggatcaccacagctgtcagagaggcccaccacttggccaccgggtctacgcctgcagaagagggagggtcccctgaaccctcagtcacgctgcacgggggagctgagaagggagccaggacaggggccggggactcaccggtggtggtggccatgctggaactgatggagaagctgtaggcaggagcccccgcagcatcagaacagctgttcagcagctgcaggtacccgagggcatccgagaattccctgtggaaggagagagctggctgtcggaacagatggcaggggtcctaggagggtgctccccacctgccctccagagtacagcctggcccctggctctgcaaagtgccactgtctcctcccacaggctggtggggagaggaaactcagagaggaatgaagcgtgcatggcacgcacggtagcccagctctgggctctctccacagggttgaggccagagctattctcagaatcccgccggaggggccttgcctggaggagggcacaacgacacttacttgtccccatcagctgacccagggctggggttgggctgggtcacacagttcagtgctcgctctaagagatgttcccggaatagctgagtcacctgggccagggggtccactgtggagaggaggaggtgagtggggtggggagcagggccccaccctcctctccaagctaagggctttttcctgggtgggctggggccacacctagggccactgggaagtgccggcatgcccctgggtgcagcccctgccaaggacaggggaaagcgggtggacataactatcaccagcaccagccttggccaggagacaacactgaggcctgccctacactgcttccaaaggaaaaccgacttgagaagatgccattgttggctccgcttccttactccacagcggcactgcctggggtcacttctccaattagccatctgcccatcaatccctgcatgtgcttctgaaagccccaatgggaacgagaggcacccaggcctttcccttcctgcaacccccacagcaacaacccatggcagggagaaggactggggtggccagagacagccagagattcaggcgacaagggacaggacaggaatgaggatgagggacaggagaggggacagggaaggggtaagagagcacctgggttcccggccaagctgtacaggctctcccatggggtactgagcacggaccagtccccatccacgaagaaacggtggcccacggggtggcagagccactgcatggcaggaggcactgagccactctgtgccaggcaggcctggcgggcactgctcaggaagaagcgctgtaggggagggtactgggctgtcacagtggacacagcctggggccagaccccgggccgagtcccagcttggcctggagtccccctggtaaccactgccacatcccgtgtagctcttacccagggagcctctggagagagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatccccccaacccactcactgtcagaaaatgcaaggcccgtgggagactggtcttcactctcaatgcagccgccacatagatctcggccagcgtcgccacagacacggcatcccctgcacactctgccaggttcagggcactcagcgccaggttggtggcagtgaggtgcccgcctgtgtgcttccctggaaggcaagcaggcatgaggctgtgggtggagcacaggcagcagggagcacctcggagcccgccccacgctcagtcctacccatggtgtgcagctggtgcagcttatggtagaccagggctgcgtctcgggcgctggcgctagcatccactcgcagagcacagtcctgctgcaggccccctgcccggcctgccagccagcggcccacccagagacgctgcagcaggtgacggatgaggttccagaggaggctacaagccaggtccaggtgggaggtgggcaggggccggcccagtgcccgcagggccagccacagctgctgggcagcctgggcaaagtctccctgtggatgagggttttccaggtgagaaaagtgaggtcagagcagctgccccaaagctcagaagagccgtccacagcaggctctggaggggtggtgggggtctgcggatgcgtggctaggcacagggaggacgggacagattcatggtgtgcacagggagcaggaacaagggttgacacccagcaccttcacagcctggggtccctgccctgcccactctgccggggccagccccttacccgggccaggtccaggtcagcctgcttgcgatgcctccagaagtacacggcggggcctgagtggggccgtgtgactggctcaccgtagacaaagagaagcaccaaggagacgagcaccaacagcccattgagcagccagaccactgggggcagcagccactgggcccagccagggccatctatggacagagggaaagctggggacacagctcccaggaaatccagagccccaagttcacaagcctgggggctcaccccgagtgtccctcccaaagatgcccaggctggccggtcccacctctgctctcggtgcccagcacgttgcgcccagggctatggtagacgctggtggtatctgaggggctgggaagcccccgggcccccagcaaggaggccaaggggttgcaggacaggcagaggaagacgagcgtgcacagggccaggcgggagcggtccagcatgccccggctgtgcagagacggccgctgctctggctttgcctggtggggttgggcagggtggtgagggcagaatcggagggaccccagagagcatggggctgggaaggggggggtcaggattctgcccaccttactgtgggaccccacgtggctccaggcctcagttattctgtctatgaaatgggaggtaggatctgttagggtcttcccggccctgtcatgaggctcagaggatatggctgggagtggggaagggggcaccgtggcagggcccaaccttgctgtcctcaaagactgggctgtcaggctccgagtcactgccactgccaccgctgccactgcccctgctgccaagggacaaggggctgctctggaaaggtgagccagcatccgaggggggtggggtcagtgtgtcctccacctcagtcttcacgccctccatgagcacgtctgtgttccctccactgccacaggccgacaccagatccttcagagattctgtgggccgaaaggaacagagccaggagtaaaggctggatatgtgaccccaaatcagagcctaggcccttggaggcctagggactactgtagctcctaaagctagcccaggacgctttgatggggctgggttagggccaaagggaggcaccaggtctctttcaggaccagaggtaaccaagggactagagctgaatgcagggctacagccaagggtgaggtgggcagggcagagggtgggccagaaccaagggtggggtggggctagggatggggtggggccgggaggtggagcaaggctagagaagaggccagactggagctcaataaagccaggactcactgcttttgtggacagcagtgcgcagacttaggttctcctgcttgagtttctggttgctgtgttgcagaaagcgaatgtagtcgatggccttgcgcaagacagcagatttattcagctgcacggtgtgggagggagggggagcgcacaggtggcctgtcaggtcgggggttgtggggttggagagccctagcaagggggtgcggagctgctttgcaacattactgcctcaggacctttgcacttgttccttctacctgaaccgttcctcgcctagtagcacccacctcccaggccgggcatagggttagaatgtaagatgcagacagcagggtctggctagctgctgctgtgcctgccgccatctcagggaggccttccctggctaccaccaggggaccctcaccatcctcttcctgctttctctgcaacgagccaaacgtggtggtctcgagcacttattcatcctgcctactgtccatctcccccaccagaaggtcggctcttctttgagggacaatttttgtctgtcttgttcattgctgcatccccaatgcctagcacagccccacctttattgaagaggcctgcaaaccagtttaactaaataaacgaggctggccaggcctggggaggctgaattccaattccctgcttgtccaggctcagtctcactccctctcttccttccagttgcccctgatctgttccttcctagggacaccccggtctgtgcccctgcaggcctctccacacctttgcctcagtgcccaccaccagatccttgagctcaatgattttgtcattgatggaggagcggtagcgcttctcaatggcgttgtgggctgtgcgcttctctccacggctctgggcagaggccggggccttgctgccagctgcgagccggttgataggcagcttctccgcatctacgaccagtgggactgttgccaagatggttccgccactcaccagggtctgcagggccaggcacatgttaccaggtgggcatgtgtgtgtgtgtgtagaccccactcccttatgccctgcccacgtcacccaccggcaaaggccctgtctgcacagtggtgccagagaccaggggactgagacctgccgccttcacagtggctccgtctgtcttcatggctgtcagaagcagcgagtctgccttgatgaagtggggctgcagcaggacctgagggtgggagaggcttggctgtaagctgtgtgtctgggctggggctgccccctccccaacccctggccagaccccctcaccgggacctgctggatctgcgaggtcacagtggtcgttacaggggctgccgtgggggcagctgtgactgtcagtagctgctgggggaccacactctggacctgggtgtgcaaggagacgggcgggacccctggcggggaagccagtggcaggccaggcagcggctgctgggtgttcccgggagggcttcctgcagaaataaagcatggggctgcagacacagacctccctctcccactttcaacctgctcttcaggtctctatcaccgactggccttggatgagtcattgccccatgtggcttcctatggacagtccctgcctgggctctgatgcaaatgcactggcttcaagccaggcctccagtgcgaggttgcgcctaccccggcaacaagcacaccaggactgctagtaacagggcatctcaagcagccgagtggagccccagtttctaaagcctgcacagacctctactcacatcacagcagaagcttcttcctgtgctcctggaagccccaccccgggtgtcccctcccgccacacatcccccttacctgtagagaagcctcccggagggctggggtagcctaacacaggggtggagctgaactgcggtggggctggggctgggaagctctgtggcaggagggcccctggcaggggctgtggggtgggggtctgcaggatgctcagtggcactgactcttccttgataccaggcccaggggagaaagcgggcatggacgggtacatcttcaatggagtgggtgcaggctggggaggggacaggggtgagggcgctgcctgcggcccgctcaggaaggcttcaagagaggagctcaatgtggcaggaggtggagacaagctgcctggggagctggtatcggggctggcagggtctgtgccccctgccccactcccagcatagggtgggtcaaataggccagggaagtcactgtcttggttgttgataagctgaagcatgtctgtgaaaaggagaagagggtgcgtgagtgaggcagagactgacccccaaacagggcatcacacacatccaaacacaaccttatttgcacaacccttgttggcacacagctgtatgtgtgggcaatgccaccaggacagaaagccacccacaggagctggtgttcccggacatacagccattttgcgagcacctgtgctgtctaaagcaatgcctgctgctgcgagtgcatcacaatacctggacaaggtgggcaccacaaggctcacaatcttgccccacagctaggctggggctgagcccagggtcgggcccaagactgcagacttcagagcctgagctcttcccaccatccggtatttgcccaaacatctagaaacatccttagtccacagcaaacagcaggctcacattcattcactcatccagtgagcatgtgctgagtgctgagtgcccacactatgccaggcactgctcccggctgtgaataagggaaatccctgcctagaactaagcaactttctggggagctgggagtgtcctgtagcttgatgtggatggtggtaaacttttactcctgtcttcatggggcatgcattctacaagacatccacctctgagtccacacacatcacacacacacacacacacacacacatacacactgcaccgtggactcagaccagcttccaagcatttgcccatgaggtgaccaacccttccagacagctctcctgccctctccacagtccatcacccccaaccccacacagaacaaaaggaatccagaggcccaggtgcagccttccctggctccacttggggcctgtttctcaatgtgtgaaacggggggcacgcctccatccacagatccagcagctccagtctttgggatggagatggggatggggagggaggagcagtctagggcagagggggtcttcatataggagcgataggccccacaccccaccattggccactcctggtctcatcctaaaacgcacccccagcaggatcctctgggcactgaatttgacaaagcaacttagaaactgctgaggagtgggtgattttcccctcccctcagtttacagggggaagaggggtgcagagagaggcaggattgccttgaggccctgaagaagtggtgggatcctctgtgaccaaggacca

SEQ ID NO: 1931 - DNA, 7363 bp, Homo sapiens
atgcagtcttttcgagaaaggtgtggtttccatggcaaacaacagaactaccagcagacctcgcaggaaacatcacgcctagagaattacaggcagccgagtcaggccgggctaagctgcgaccggcagcggctgctcgccaaggactattataacccgcagccttacccgagctatgagggtggcgctggcacgccctctggcactgcagccgcggtggccgccgacaagtaccaccgaggcagcaaggccctgcccacacagcaaggcctgcaggggaggccggctttccctggctacggcgtccaggacagcagcccctacccaggccgctatgctggtgaggagagccttcaggcttggggggccccacagccaccacccccacagccgcagccactacctgcaggggtggccaagtatgatgagaacttgatgaaaaagacagcagtgccccccagcaggcagtatgcagagcagggcgcccaggtgccctttcggactcactccctgcacgtccagcagccaccgccgccccagcagcccctggcataccccaagctccaaaggcagaagctgcagaacgacattgcctcccctctgcccttcccccaggggtggtgggcagggcactcctataagagttgcacagcaccgactgcccagccccatgacaggccgctgactgccagctccagcctggccccggggcagcgggtccagaatcttcatgcctaccagtcgggccgcctcagctatgaccagcagcagcagcagcagcagcagcagcagcagcagcagcaagcccttcagagccggcaccatgcccaggaaaccctccattaccaaaacctcgccaagtatcagcactacgggcagcaaggccagggctactgccagccggacgcagccgtccggaccccagagcagtactaccagaccttcagccccagctccagccactcacccgcccgctccgtgggccgctcaccttcctacagttccacaccgtcgccgctgatgccaaacctggagaactttccctacagccagcagccgctcagcaccggggccttccccgcagggatcactgaccacagccacttcatgcccctgctcaatccctccccaacggatgccaccagctctgtggacacccaggctggcaactgcaagccccttcagaaggacaagctccctgagaacctgctgtcggatctcagcctgcagagcctcacggcgctgacctcacaggtggagaacatctccaacaccgtccagcagctgctgctctccaaggctgctgtgccgcagaagaaaggtgtcaagaacctcgtgtccaggaccccagagcagcataaaagccagcactgcagccccgaagggagcggctactcagccgagcccgcaggcacaccgctgtcagagccgccgagcagcacgccacagtccacgcatgcggagccgcaggaggccgactacctgagcggctccgaggacccactggagcgcagcttcctctactgcaaccaggcccgtggcagccctgccagggtcaacagcaactcgaaggccaagcccgagtccgtgtccacctgttctgtgacctctcctgacgacatgtccaccaaatctgacgactccttccagagcctacacggcagtctgccgctcgacagcttctccaagttcgtggcgggtgagcgggactgtccgcggctgctgctcagcgccctggcacaggaggacctggcctccgagatcctggggctgcaggaagccatcggtgagaaggccgacaaagcttgggctgaagcacccagcctggtcaaggacagcagcaagccacccttctcgctggagaaccacagcgcctgcctggactctgtggccaagagtgcgtggccccggcctggggagccagaggccctgcccgactccttgcagctggacaagggcggcaatgccaaggacttcagcccagggctgtttgaagacccttccgtggccttcgctacgcctgaccccaaaaagacaactggtcctctctcctttggtaccaagcccacccttggggttcctgctccagaccccactacagcagcttttgactgtttcccggacacaaccgctgccagctcagcggacagcgccaacccctttgcctggccagaggaaaacctgggggatgcttgtcccaggtggggattgcaccctggcgagcttaccaagggcctggagcagggtgggaaggcctcagatggcatcagcaaaggggacacccatgaggcttcggcctgcctgggcttccaggaggaggacccccctggggagaaggtggcctcgttgcccggggacttcaagcaggaggaggtgggtggggtgaaggaggaggcaggtgggctgctgcagtgccccgaggtggccaaggctgaccggtggctggaggacagccggcactgctgttccaccgccgacttcggggacctcccactgctgccacccaccagcaggaaggaggacctggaagctgaggaggagtactcctccctatgtgagctcctgggcagccccgagcagaggcctggcatgcaggacccgctgtcacccaaggccccactcatctgcaccaaggaggaggtggaggaggtgctggactccaaggccggctggggctctccgtgccacctctcaggggagtccgtcatcctgctgggccctacagtgggcaccgagtcaaaggtccagagctggtttgagtcctctctgtcacacatgaagccaggtgaagaggggcctgatggggagcgagctccaggggattccaccacctcggacgcctctctggcccagaagcccaacaagcctgctgtgcccgaggcgcccatcgcaaagaaagagcctgtgccacggggcaaaagcttacggagccgtcgggtgcaccgggggctgcccgaggccgaggactccccatgcagggcaccagtgctgcccaaagacctcttgctccctgaatcctgcacagggcccccccagggacagatggaaggggctggagccccaggccggggggcctcggaagggctccccaggatgtgtactcgttctctcacggccctgagtgagccccgcacgcccggacccccaggcctgaccaccacccctgcacccccagacaaactggggggcaagcagcgagccgccttcaagtcgggcaagcgggtggggaagccctcacccaaggctgcctccagccccagcaacccggccgccctgcctgtggcctccgacagcagcccgatgggctccaagaccaaggagacagactcacccagcacgcctggcaaggaccagcgctccatgatccttcggtcacgcaccaaaacccaggagatcttccactccaagcggcggaggccctctgagggccggctccccaactgccgtgccaccaagaagctcctcgacaacagccacttgcccgccacattcaaggtctccagcagcccccagaaggagggcagggtgagccagcgggcaagggtccccaaacctggtgcaggcagcaagctctctgaccggcccctccatgcgctcaaaaggaagtcggccttcatggcgccggtccccaccaagaagcggaacctggtcttgcggagccgcagcagcagcagcagcaacgccagtggcaatgggggagatgggaaggaggagaggcctgagggttcccccaccctcttcaagaggatgtcttctcccaagaaagccaagcccaccaagggcaatggcgagcctgccacaaagctcccacccccggagacccccgatgcctgcctcaagctcgcctctcgggcagccttccagggggccatgaagaccaaggtgctgccaccccggaagggccggggcctgaagctggaagccatcgtgcagaagatcacctcgcccagcctcaagaagttcgcatgtaaagcgccaggggcctctcctggtaatcctctgagcccatccctttccgacaaagaccgtgggctcaagggtgctgggggcagcccagtgggggtggaagaaggcctggtaaatgtgggcaccgggcagaagctcccaacttctggggctgatccgttatgcagaaatccaaccaacagatccttaaaaggcaaactcatgaacaacagggccagtggcacacaaggggccagtgaggacaactctggtggaggaggcaagaagccaaagatggaggagctgggcctggcctcccagcccccggagggcaggccctgccagccccagacaagggcacagaaacagccaggccacaccaactacagcagctattccaagcggaagcgcctcactcggggccgggccaagaacaccacctcttcaccctgtaaggggcgtgccaagcgacgacgacagcagcaggtgctgcccctggatcccgcagagcctgaaatccgcctcaagtacatttcctcttgcaagcggctgaggtcagacagccggacccccgccttctcacccttcgtgcgggtggagaagcgagacgcgttcaccaccatatgcactgttgtcaactcccctggagatgcgcccaagccccacaggaagccttcctcctctgcctcctcttcctcatcctcgtcctcgttctccttggatgcagccggggcctccctggccacactccctggaggctccatcctgcagccgcggccctccttgcccctctcctccacgatgcacttggggcctgtggtttccaaggccctgagtacctcttgccttgtttgctgcctctgccaaaacccggccaacttcaaggaccttggggacctctgtgggccctactaccctgaacactgcctccccaaaaagaagccaaaactcaaggagaaggtgcggccagaaggcacctgtgaggaggcctcgctgccgcttgagagaacactcaaaggtcccgagtgtgcagctgccgccactgccgggaagccccccaggcctgacggcccagctgacccggccaagcagggcccactgcgcaccagtgcccggggcctgtcccggaggctgcagagctgctactgctgtgatggccgggaggatgggggcgaggaggcagccccagccgacaagggtcgcaaacatgagtgcagcaaggaggctccggcagagcccggcggggaggcccaggagcactgggtgcatgaggcctgtgccgtgtggaccggcggcgtctacctggtggccgggaagctctttgggctgcaggaggccatgaaggtggccgtggacatgatgtgttccagctgccaagaagccggggccaccatcgggtgctgccacaaaggatgcctccacacctaccactacccgtgtgccagcgatgcaggttgcatattcatcgaagagaacttttctttgaaatgtcccaaacataagaggctgccgtagtaatccaccccaacggccggaggagccgccggagcccgcctgcccgcccgccgccgaaggagaggagccgcctgcgcagcccccgggcctttgagctgctcccagcgctggtccagagccgatccttgatccgggtcccggatcgtggatccggccgcctagggctcagacttgcggccccgggttgggaggaaaacccgttccggagccgcctgctcccggaaccggacggcacagggcgttcttgcccaccccaggggccaggcttgcggagggggagcccgcggagcggccagactccccggggcgctcagcctccggcgagggtgggagacggctttgtcctggggacactttccctctggaatctcaagacgacgtggcacacattccacgtgggtgctgccgccaccccagtcggtcgtggcgtgcagctgggagccctgggcttgggggtgggggtcgaaacagtactggaagaggcggagggcggctcctagctccgtggactaggcgggggagaaaggaagcctttctgagagcgggctaggccggcactggagaggccggagcctttggaacaaaccgtgcggaacgcgtccaggggccttcccgcccagcctttgccagatctctcgtgcggttcgggcaaagccggggtagacctgggctatgctcagttaggggttgcgggatccccgagtgtgggcgggactgggacaccctttggcctctgtttgtcccctttccagtcctccaccccacccctggagcccagcctgggagcgcaaaacccaagaagcggccagaacgcacctccggctccggcggacgcgcgaccgttgtgcaccaccagggaccgccgcgcctactctgcacgggagcagggacagcgctagatttcgtgtacaaaacctgtgtacccctctatatatatgttacatagaatgtatatatgttgggaacatgctcgcttctcccgtgtgtcgccgccgtgcgtcgtgcgcccgcaacagagccccaaccgggcctttgccgggtaaggggctaccgcgacgccacttgtccacgcagccaccaccggcccgggccagtccctgccagtccgtccgcctgtccgtccgtgtcctcagctctgtccacgcttcgataggcctgacgcagcccccagcccagggccgccctagcaacttcctgtacatatgactgtaaaatggtaaacgtgtgtattatatctggcctcgttatatagtgtatatatatgtatacatatacatatatataatatatatgaagactgtaaatgttaagacgactagtgttcttattagtatattgcttcacactgaagattgtgtgtatcgagctgtttctaaaagatgtttattttccttaagagtaaaaaacagtcattgcattcagaaaaaaaaaaaaaaaaaagtcaataaagatacaacgattgttttggaaaatctgcagcccgtggattccgaccagattcagctgggagccgggccaggctttaggttggggaatgggaatgaagggaggggctgggggggggggcatgaatggagtcagggagtcggcctttcacagaacaggaaacctcccccgcccctgtgccccctctccagtgtggcggcaggtcgggagggaggaggcttctttgctgtgagatgaccaggggccgggatgggggaggtgagacgtgccagacttcttgcagggagacccaagctgtagctcctgtcacacaacaggtcctggaagtcagtccatcctcccgtgccacccagggacctgatggggacagagctgggaggtgagaagggacaactgaccccatggaggccctaagggttgacacagcccaaccatgtgccctgggagcagggggaac

SEQ ID NO: 1932 - protein, 1819 aa, Homo sapiens
MQSFRERCGFHGKQQNYQQTSQETSRLENYRQPSQAGLSCDRQRLLAKDYYNPQPYPSYEGGAGTPSGTAAAVAADKYHRGSKALPTQQGLQGRPAFPGYGVQDSSPYPGRYAGEESLQAWGAPQPPPPQPQPLPAGVAKYDENLMKKTAVPPSRQYAEQGAQVPFRTHSLHVQQPPPPQQPLAYPKLQRQKLQNDIASPLPFPQGWWAGHSYKSCTAPTAQPHDRPLTASSSLAPGQRVQNLHAYQSGRLSYDQQQQQQQQQQQQQQALQSRHHAQETLHYQNLAKYQHYGQQGQGYCQPDAAVRTPEQYYQTFSPSSSHSPARSVGRSPSYSSTPSPLMPNLENFPYSQQPLSTGAFPAGITDHSHFMPLLNPSPTDATSSVDTQAGNCKPLQKDKLPENLLSDLSLQSLTALTSQVENISNTVQQLLLSKAAVPQKKGVKNLVSRTPEQHKSQHCSPEGSGYSAEPAGTPLSEPPSSTPQSTHAEPQEADYLSGSEDPLERSFLYCNQARGSPARVNSNSKAKPESVSTCSVTSPDDMSTKSDDSFQSLHGSLPLDSFSKFVAGERDCPRLLLSALAQEDLASEILGLQEAIGEKADKAWAEAPSLVKDSSKPPFSLENHSACLDSVAKSAWPRPGEPEALPDSLQLDKGGNAKDFSPGLFEDPSVAFATPDPKKTTGPLSFGTKPTLGVPAPDPTTAAFDCFPDTTAASSADSANPFAWPEENLGDACPRWGLHPGELTKGLEQGGKASDGISKGDTHEASACLGFQEEDPPGEKVASLPGDFKQEEVGGVKEEAGGLLQCPEVAKADRWLEDSRHCCSTADFGDLPLLPPTSRKEDLEAEEEYSSLCELLGSPEQRPGMQDPLSPKAPLICTKEEVEEVLDSKAGWGSPCHLSGESVILLGPTVGTESKVQSWFESSLSHMKPGEEGPDGERAPGDSTTSDASLAQKPNKPAVPEAPIAKKEPVPRGKSLRSRRVHRGLPEAEDSPCRAPVLPKDLLLPESCTGPPQGQMEGAGAPGRGASEGLPRMCTRSLTALSEPRTPGPPGLTTTPAPPDKLGGKQRAAFKSGKRVGKPSPKAASSPSNPAALPVASDSSPMGSKTKETDSPSTPGKDQRSMILRSRTKTQEIFHSKRRRPSEGRLPNCRATKKLLDNSHLPATFKVSSSPQKEGRVSQRARVPKPGAGSKLSDRPLHALKRKSAFMAPVPTKKRNLVLRSRSSSSSNASGNGGDGKEERPEGSPTLFKRMSSPKKAKPTKGNGEPATKLPPPETPDACLKLASRAAFQGAMKTKVLPPRKGRGLKLEAIVQKITSPSLKKFACKAPGASPGNPLSPSLSDKDRGLKGAGGSPVGVEEGLVNVGTGQKLPTSGADPLCRNPTNRSLKGKLMNNRASGTQGASEDNSGGGGKKPKMEELGLASQPPEGRPCQPQTRAQKQPGHTNYSSYSKRKRLTRGRAKNTTSSPCKGRAKRRRQQQVLPLDPAEPEIRLKYISSCKRLRSDSRTPAFSPFVRVEKRDAFTTICTVVNSPGDAPKPHRKPSSSASSSSSSSSFSLDAAGASLATLPGGSILQPRPSLPLSSTMHLGPVVSKALSTSCLVCCLCQNPANFKDLGDLCGPYYPEHCLPKKKPKLKEKVRPEGTCEEASLPLERTLKGPECAAAATAGKPPRPDGPADPAKQGPLRTSARGLSRRLQSCYCCDGREDGGEEAAPADKGRKHECSKEAPAEPGGEAQEHWVHEACAVWTGGVYLVAGKLFGLQEAMKVAVDMMCSSCQEAGATIGCCHKGCLHTYHYPCASDAGCIFIEENFSLKCPKHKRLP

SEQ ID NO: 1933 - DNA, 23938 bp, Mus musculus
  misc_feature (1)...(23938): n = A,T,C or G
ctccaccctcaccgaccctgcagaggaccgctgactgatgctagtgaccggcggccaacgtcctcaggaaacctgccttctccttagcttgtgctcagtgtgggcttctgctctctgctgtaacccacagatgctcacatacatcttttccttcggggatgaggtatttcagctcttggagttgttaaaaggcagaggcgatgtcagagtcaccacagctctgacactagtaggttctcaggaagagctctaggggtgcaggctctcacttgacccggagctgtcccagagttccctctttccctgccacctgggcctaatcctaagccctagaactctcttccttacttccaaggtccccagagaggcacctgagccatccaggaatgtcaggatggtaccccaggggagcacagctctggctaaggattccctttaggctttctccattccttgccctttggagggatcccttagtctgtctcccacactcccaaagaccactcaggactgtacctcatcagatggcatgctgcccaaagataacactaaaccttttctctccatccctctaacaaccaggccagagctctgcccagggacctgtatgcccagggggccatgtgagccaagcagctctggagcccccctcacttgctcagttttacaggctttattaagacttgaagcaaaagggagacagctgagcggcttggccccgcccacccattctgttattcaaagtgggtcacagggtctcagctaaccaatcacctactctgagctgtggatccttggctccaacaaatgcccatttcgataaccagatggcctcagaaaccacagcttgaatctttacattcctgtagtcagcctagtgtgtccaccccttccagttcctggccggctctgaacttcctggtggccctcagattaaatctccttccttgaactaccagagttgactactctggccatttattgagtacctactctatgcctgcctgacatagttattctaatatccttctaatgcagcagttctcaaaaatgtggtcctatgaccccctgaaagattagaaagttttcatatctctataaaatgtcaatttgctcttactgatttactctcttatgaaagctgtgtatgtagcaggggacagtcatcagaatgaacacagacctgacaagcccacactgtcttacggtgtcagaattaacaatatctgtggcaagaccacgctttcttctaaatctgttctctctttctcacctcgcccagatttcagctttaatttctgacagtaaatactgatgggtccaacccacaaaaacaaactttagggccctctataacttttgtatatttgttttttatagttttatgtagcccaggctagccttgcacttttaatcctcctgcttctatgtctacaggattacaggagtgcagtgtggggtggggcagtgtctcacctagaacctgcctcgaagaccagactagctcaaacctcttctacctctgtctctgagagctgccatgacaggtgtatgctctcagctcagctcagcctctatgaacttttagagtatacttgggtcctaagaccaaaactgtgagaactacagctataatggaggatctctattgtgaaagtgagagagtgactcaggagaagatactcaaaaacacattggtagaaaatggccaagagggtatatgggcccaggtctgtggatgccaaatgctttgttcttttagcaaaaccagggtttttttatgttttactgtgcttagaattagctggagtgcttgttgtctttctcaactattcaattttggtttggttttggagacagtatcacgtttctcaaggtagccatgaccatggcctctgggattacagagcacacagctatacccaggtttagcattacaggggctcaaacccggggccttgtgcatgttagacaaggaatctaccagccgagcggctttattaatttgagacagaatttcatgtagctcaggctgaccttgaactgcagatcctcctagataccaggactacagatatgagacagtacaccccacgttcataaagctggtttgttctctttggtggtgctagaagttgtccctgggcctcacacacactaggcaagtgctccaccagggaacaatattctccacttataaagcatttttcaaagtgtgcaatccatggggctggagagatggctcagtggttaagagtgacggttactcttcctacggatctgactttgtcagcattcatacatacggtggctcagaaccatctgtaactccagtttcagtggatctgaacctctcctctggcctccacaggcactgcatgcatatggtgcgcagatatggagacaaaatatctatctatatctatctgtatatctataaaataaaaataaataactggttttgttgttttttaagtacataatcctgaccatggtgccacatcccaacaattgggaagccaacttgtatttcatgttctgggatgacctgggctatatagtgacaccttgtcttaaacagggctcactgagcatttactcaaagcagaggagggaggatctctgagaccaacctgatttacatggagcgttccaggccagccagggctacatagtgagaactgtctcaaaaacaaacaaaacaaaagcctgaagagactaaccaaccagcagccctaagaagggtctggaaccctattattgataagtcccccccaagagattcggatgcaagtgagctagagatatatctgagatatannnnnnnnnnnnnnnnnnnnnnnnnnnnnnnnnnnnnnnnnnnnnnnnnnnncacacactctagcttttgaccccaggttagctccctggcctttgagcctctggtgcaagagtttatcaagaacaatgctactatgttccttggacaccatcttacctacttccctaaggtcctctgttatattctgcccccatcaagttggctgtccctggctctgcactactggaaatggcttcacgccaaggcccacccaataggagactgggtaagtgcagagagcactgggcagcctagattgggagtagggagtcctgacccagccagccctcctgttgcttgcctcctggccccacctgttcccgagcagcagtgaacatgggctcctggatgtccgtgtacatgcggcggagggcattataccctcccgggacactttccaggttgctgagggcccggtcctggttccgcatcatttcttgcatcatggctgggttacgagcaagctccattgtctggtgaagggaaaaatatgagatgggccctggaaccagaggaacgccaagctaggaaaagggacctgaggaggagtctgcacaaaggagcacaggaaccactcagtgtggcagggagcgccgcaaaccagatcccctctctgtcgtaatctcggcttgatccttgcctccctgtggctttttgaaccgaggaacagtgttcccagatggagttaggcagcaatttctgggctagagagatggctccgtggttaagagaactgactactcttccagaggtactgagttcaattcccagcacccacatggtggctcacaaccatctgtaacaggatcttacagatctggtgtgtctaaatgcagctactgtgtactcatatacataaaataaataattctttaaaaaaaaaacaatttccatttctcaggctcagaggacctcagaggtgtcagagagcataggaagatgggggtgtgaagaggcacagggtacaacgcccccaagcacctggaactgtacctcttccatagtgagactcaataaatactcactagatgataaattattggataggaaatgacctcttgatcagagtcctgaaaggctaggtatatcagtctagtaaggtgtcttagaacagattaggatggaagagagaagtcctaggaagaggaataaagaacagtttacaaaagccgggcgtggtggcgcacaactttaatcccagcactcgggaggcagaggcaggcggatttctgagttcgaggccagcctggtctacaaagtgagttccaggacagccagggctacacagagaaaccctgtcttgaaccgccccaccccccaaaaaagaacagtttactaggtttatgacacccctaaagcttgacactgagagcagctaagtgacctagaattaaagtcatacccttctcacaataaccaccccaggtaaatattcccatctaccttctgtaagtatgaaaatggaatcagagaggatcatggaccggttgccccctaatacctgggagaaaaccatacaaacaggtttctaggccagtctcagcaaaccacactgttagtcctggtaaatcaaactgggtagagaaagggttcagcctggacatcctctactccctccttctgggtcttcagccaagccgagctgtccgaacactgaggctgagggctgtctgctttagagctgatggctcgctctaaggacctgctgtcagactcaggtctccataaccccgatgacaagaccacctagcttgccttctggcaaatacctttagtcccatcactcaggaggtagaggtagatctctacgagttaaggtcagcctcatctataaagagagttccaggacggccagagctacatagagacactggaattctggtttctttttaaaacacagaatagccaggtggtggtgatgcacacctttagtcctagcccttgggaggactagcaggtggatctctgggttcaaggtcaacctggtctacacagagagttccaggacaaaccagggacacacaaagaaactctgtctcaaaaaaactaaaactaccactaccaacaaaaacaagaacaacaaaacccccacaaatattataagaatatgtttcgttttaaccccaggcaggggcctatggagctgtggggctgcttctcagcagttgcctgtgatttgcctcgtgctcttgctgaggtgtaagattttgccagctgcagagagtttctgccactgtgtgacatttgggattttgggaagtttttagagggtagataaatgctagggccccaagaggtgggtgggtgggtgggtattggccccttcaggagggttgtttgcggtttattagtagttgtggtcaaacaacacaaaagaagaaaaaaaaattagattcatagatctttcttctctatcctttctctagtgatagggggtgaaatgggggtggggggtgtgtgaggaagaaaccataaggtagcaaaaaccagctacaagcaaagaagaaacaagaagaaagaaaagttaaataaatttagggatctctatctctttctcccctctattcttttttctctcctatctagtgttaggggataaaactggggtgtagggggaatggaagcaggggtggagggtggcaataaggaaaagaagaacccacaaagtagaaaactccaactacacactgtctaaaaaataaagaaaaagaaaagaaaagacaagaaaagacaagacaagacaagactatgatttccactggtgtcctccaccaggcatgttcagctgctgtgttcccaaacactgtctggaccttcctactgagggttcttggcctcgaacattatttttttctttccttggttcatatacagtcttcctttgggtcttagcttagtgacacttgtaggagaccttctataagccccagagcagggttggagcccttactatgttcctaaggcatcattatgtccagcactgcctgcacatctgtcccacttggcttagggtcaaggagttcctgacccatgtctgttcataaccatatcaagtgttcaaagcacaccagctcaactcaatgaacaagaagaaggagcaaaccggaagttcagaacagccaacaccagcgtccgccctccccagtcttctcccagacccacctgcctcatgagctctgggttgttgagcatgtggctgatctcggggttcctctccatcagctgctgcatctggggattagccatgatcatgtggcgcatcagatcagggtttgacatcatatcctggaccaaggggttctccatgatctgcgacagcatctcaggattggacatgagctgtctctgcatctgttgctgcagctccataaagttggcggagcccaggcccaggctgcccagtcccaggatgcctccgaagccagctgtgggaaggagcagggtcagagtctccctctcagacccttccaagatccagcagactttccaagatagaccctaattgcttctgacatgtccctccctcttcagtcactcccacaactccaggaaagagacctctataaaggcagggggcaagctaagcatagcattgaacagaagtagacccacctttctccattcccctctttacccaggactcccctcccccaacgccatctttccttttgttcctgaacttgagtccatctctgaaatcatggaaaccatcataagggctggtgagatggctcagtgggtacgagcacccgactgctcttccaaaggtccagagttcaaatcccagcaaccacatggtggctcacaaccatctgtaaggagatctgactccctcttctggagtgtctgaagacagctacagtgtacttacatataataaataaataaatctttaaaaaaaaaaaaaaaccatcataaaccgatcattcattccccaccccagcttggcttaagttccaacatctggaagagtgactacggtcatgggactaggactagggatcagggaccattcttcttctttatctttgtgcaccccactcccctggccaatacaaaattatgctctcccccgctaaaggcttacagaggatcgatgcagtagcacttgagggcccctctgcagccactggagagggcccccctccactgccagcatctgaagttgtattgccagagctgcagggctggacaggggcggcggcaggtgaggcaggcgtggtggagggtgcagaggcagagtcaggagtggatggaggagaagcagcagcagtcactggatcttgagccctgaggacaaagagtagggaaacctggctggagtgtgcacaagtgacaaggtggccttggactgacagctcaagccacctcctaagcagccttgttccacccttaccccaggctagcaggatgctggggagagggatggtatcagttatcaacagtctctaaggcaacctgggagtactgacaggctcccccagaggtaagaccttatccatctgtgccaggcctggctgctgaacaggtgagaaagaatgggaggtgaggtcacaatcaggagcaagggcagctcctgtctgtacttacttctgaggggttttgatgactaggtggactgtgagcccatccttgatgccgtgctggctcagggtgtccccatccttgaggatcttgcctgcgaagatcaggaccagctgatcctgctgagccttaaacctccgggagatctcctccttgaactgtggtcaagaggcagagatcactgcagaggccaactgcgccccgctgcaagacttgaccctcagttctgcccctctagctacaagaatccattcaattagttccatgacacagtatcccaaccctggaaagcccctgctgctatccacaacagcagcttctgtcccaccacccaattctctgaaagtgatacctcacagaggcatgggcagccctccccatcctaaatccttcaactagccttgggctcaggctgtctctcttcagccttctctctgcttttcagtcccagcttcctcatcactataacagataatctagagtattattgagatctattgaggaatctagtgtgttagttaccatctctacttaattaaattaattaaatttaattaattaattaattaagagacagggtctctgcatgtagctcttgctgtcctggaactttctatgtagacctcgaactcagatagatccacctgcttctacctccccagggctgggaatttaaagataaggatcagagaagaggtaatgtatccggggatataggaactcaggtctggacatcaatgtcttcatcagacacattctcaataagagctgttttataattcagcttttcccaggggacttaaaattctctaatgagagagcagcagtggtaccaacggctacactggggcgagttaaattttctagattctatcagctcctccaaaacacaacacaacacaacacatattctaactataaacagtgcacttgctaagcaaaagatccctctcttccaaccagatggcctattctaagccccgcctatgtgcaattctggagcagcttcaagcagtggggaacacaggcaatactccctcactcattctatattattttgttgagcacctactgcgctcagcaaatcctgtagagcagaaaactgaactacacaaccgtttcgatttgcgacaaggaggctctgtggagagagagagagagggagagagagagagagagagagagggcaccaccaccacgcgacactcccgggagagcatagccgcagctcgctcgggccgcacggtgccttagcgcctggaacctctaccagtgaccctggagcacactctcctcaagcctaggctccaaatggagcccgcaagcaaggtgtcccttcctcaagctcccccaccacgcccccagcccgggtagcgcggccaaaccggcccctacccgcgccacgctccccggactagccctggcagggcgccccctacccgcttctcccgcctgtatgcccctggattccgccccggccgggggcccgtccccggcgccaggccgaccccgaggtctccctctctgctctgaccccctcggtgcgctgctcccgccctcctgtctcctcccagccagatactacctccttgaccgaggcttgatcgcagatcacgatctcctccttgtccttgggggtcttgacggtgacccgaatctggggcctcgtctcagccccactcggctccgccatgccgccgcccggccgcccgccagcccgtccggctcctcctcctcctcctcctcccggcccgcccggcccggcccgactccggggcctccaactccccctcccgcccctccccaaggctccgccgcccactccggacagccgcagccacagcgccccgggcggcctgggggagcactgcagctggggcggcccaggcccgagcagggtgcgcagctggcccgggccggacagcgcggagggcgggagattcagggccgcctgcggctccctcctgttcggacaaaggactttcgttgtcgccgtcttatctccgttccctggggtcacttggttttcttgagaggcctgggttcgttcctggttcaggacgtccttaagacctctgcggattcgagcagtcgtggcctccggggaaccgccccgagggagccattaaggacggtttcagagacctggagtttgcctacgtggcttctctgagccttgggagtaaaagagcaagaccccacagaattgtgactagcgtacaatattgctttaaaaaatggtcaaggatgtgcctaacagatagatttattattagattgcgattgaccagtaggcacgaaggcgtccttcgcgtggaagatgttaaaagtctttccaccgttgccactgtccttgcgctcccgctctccccccccacaactccacaaccacatggtcccactggaacgctgaactatggttcccagaattccttgagcgatcacatgaaactacgattcccagaggccctcgcgcggggcgggaattgggccagagcctcagtagatgggcccggtgactacaactcccaggcgcctcgtagctgggctcctgggccaccggaagcgactgagggagagcaagaggctgcgactgtaggggtgtgttggtgcaggtcagggttaagagacgcaggcatgctgcgtcccaaggctttgacgcaggtgctaagccaagccaacactggaggagtccagagcaccctgtgagtgaacaagaacccaagcagcgagcgctggaatggggcggcgcgcggctgtctgcagtaggggtagggaagagccctacgccgggaggtggctaatgttgcaagctgcagcttcggaaaccctgcttgagggcttcctcggaaagggaaatggacagttgattagcgtgttcctggattcttgcttcctaaaagcgccagtagctggaattgggataggaactcagacctttcactcttcctgagtttgttgatatccttcccattcttgccaggctgctgaataatgagggatcgctgctggcctactccggttatggggacacagatgcccgggtcactgcggccatcgccagtaacatctgggccgcgtatgataggaacgggaaccaagcgtttaatgaagacagtctcaaatttatcctgatggactgcatggtatggagtaaagtaggctgacttcgaacttgcaatgattatcctgcttctgccacctcaaccctgagattgcaggtgtgcaccatcgcaccttgccaaataaaacatagatattaaaaaaggaagtgagagtacggtgctggcctatgtgagggtccatctcagtgaaaaggagacatttgttaaaagatccgaaggacgataggaaaggggaagagaattaagccatacagcaatcatttggggaaatatttctaacagtgcttgctatggtggcttatgcctctagttcagtacacgagagactgaggcaggctctcttcgagtatttgttttctttctttctttttctttttttgtttttcgagacagggcttctctgtgtagtcctggctgtcctggaactcactctatagaatcaggctgaactctgaaatctgctagcttctgcctcccaagtcctgggactaaaggtgtacaccaccaccgagcagactttgcaagtatttctgacaacagcaattgcaaagggccgagggcagagtgaggcttggacaaagatcagtaaagatggagcatcacagaatgggaaaaggttgtcgggagaaagggctaaagtcctctgaagagtggcagtgtgcagaactgaaaaaggtgtttgcagtggggaaggccccttgggaagctcttcactgtcatgctggcagcccattctttacacccctctcacccattgctgattcacactgggtactgagtccagggctggtgtcactgcagcctagctaagctctaagaaatgctttttaagggacagatgtggagctcagtggtagagcagttgcctagagtgtttgggattctagaacccattccaagaaacacagtttttatttttgagtcagaggctagtatacacactggagcaagttctgtgaaacatcacttctctcacatagatgtgccatgacatttttattgttattttcaaatgttgacccaccctaattgatccccattttgaaaagttacaccataggaaaagaagagacataagttgggttgtgtgtgtgtgtggggggagttgtttttacctttttaaggtttgttttattctgtatgtatgagttgctttgcccaggtggtatatatgtgccccatgtgcatgcatgatgcccccaaggaggctgaaagaaggcattggagcccctgaactgctgttatagatgattgtgagcacagtgttggtgttgggattcgaactcaagcctactgccagagcagcatacgagttgggttcctggtcctgacctgctgagacagttctcggcattagagaagagaaccccaagttctggaagacttggtttcccaggatagcttggttagcacatggctcagctgaggctggaatccagtttcagacccccatgtcttaaatgctgggcagagctcctagctgaacttcctgctctgctaagcttgggagacagtgtcactaggaccagaggaaccctggggaaggcaggaactaaggatgtcaagcagaatgccccaaagtatcatgtccttcccaccaggagggccgtgtagccattacgagggtggccaaccttctgctatgtatgtatgccaaggagaccgtaggcttcggaatgctcaaggctaaggtgagtatattcctctgttataaactttctgggctgtaacatctatgcatgcccttgctctgaataaaggacatggagactttaattaggtttattatgagctttgggcactatagctgggcagattctcaactattctaacccaaccatattggcttggcctatgtccatgacccattacctgtccatcttagtcatgtcctggtacctgcttcctcatctttgtccagctggcaactcctctcccagaattcctatctcttcctggaagtcccacctcctacttcctgcctttgctttttaataagctgatcaaaaggtgagcgagagtgtttacaaaatatgtagccaaatgaaaccaaatgaacccaaagtccagtctgcattaaactctgctggcacagaaatcggcatttgaataataatacaaagatgatctttacatagggcgcaatatcatcatcccagcactgatccagccttagttcctgttcactgtgttccttacatgtccctcccctctctggagttctcatagctcctcactccatgtctaggatgggctaaagagcagtgggggtgggctggggggggagttggctgctaagtgtggcgtggggagccagcgtggttcagggatccgtctaagcataagcgatgcatggactgactgtgctcctgcctccttgcaggcccaggccctggtgcagtacctggaggaacccctcacccaagtagcagcatcataacagcgtgatggaggctggagtagaaaagggatgatgatctggagggaggggcggggccctagaaacgccatatcgggcgaggtacaggaagggggggttgcttttttctgaataaattttcaactcttacctgtgtctcacctgctttcttgggaggaaagtgtggagtggtttcctcgggaggattcccctctcctgcaaaggtgggctctctcattccccatcaccaaatctctcagtggttcttggcagggctgcccagtgcccttggcttctccagtgctgtgtctcatcatactcctaattgctttttttttccattaatttatatgtttattctatttacattgcaaaaagctcccttcccatcctcccagaattgcttttctttaaacaatttgttttttggtttttgtgagacaggatttctctgtataaccctggctgtcctggaattcactttgtagaccaggctggcctccaactcagaaatccgtctgcctctgcctcccaagtgctgggattaaaggtatgtgccactacacccgtgtgaaaaaattgtttaggttattttatgtacatgagtgttttgactgtttgtgtgtctgcacttgtgcctgtaaagggcatcagatatccctgaaaccagagttagcaggtggctgtgagagagctatgctgagaacctaaccagggtcttctgcaagagcagcggtgcccttagctgctgagctcactcaaccctcagagcagaatctcacccgcccgttttgcagcacctgggactgatctaaaggagcaaatgcctgttcttgctggacacagaaaatagaggtcaccctttctaatttaaggagtgctcctgctcctttccctaccttttcatgatcctctctgcagcatttgttttaatttaaaaaaaaaaaaatcgtgtgtgagcacagcagactcctctgcattgcctttacttatttactgtttgcgtacatgacgcgtggataggtgtgtcccacatacaagcatggcagtcagaagattgacccccagaaggcctcaaggtcttcatctcagatcctgcacccatattcaccgcatccagctctttctgcccttgtctctgagatccgtccacgaaggtagtaaatctgtttattgtatgttaggaagggacccatctgggcaggtggcgtcccagctccacctgtgtgagaaatgctgcccctccctggcctggggctgttaaggaggggccggatgctgcgtgctggtacagctcccaaaactctgcattgtggggagatgctgtgcccagcttgcatttcttgccctgatagcccttcccctgatgccccccggtatgtgtccttaccaaaacctgagatgggaaagctggaggccggtacgtttctgccccaccccgtgtctacttcagcccagtggcagctctccttcttagaacccccaaaacccagcaatgtacactcgggctcgccgcagcctcacccactgttacctctgtgaccaggccctcttatttgggggagtgtgggccaagagcagacacctaacctgtttaacctgtctgacgtcatcatcgctccacccacctgtgccccaggtgcccagcggagctggctagctcttcctgttctcagcttccgtcctctcagctcccacagagtagctaaacgtgccagagctgagcctctggggctcttcctggcctcaactgagccctcttgtccttttcccccaatgagagaggagccaggtgcaggtctcttaaaagctgagagttgaggccatttaaacaataaacagactcgtgacctctgcacctgcaaacgtcttcactctccatgctgagccaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagttgacacatagggaagttgatacttaggtagttgatacacccggacaatgcattgactctccagccatctaatggattccacaggactcctgggctgcagcctgtgccatgcatggcctcttgtaccacacaatctttggacccagatactaggcacagggtttgctgggctgtttctgacagtgcacatgcatcctgcctgcttgctttccctcagctcctggtgtttggtctctctgtgggtctctagctctccttcttgaaggctaggtggcctggtggcactctcctttcctttgcaccacacccacagcctctcccaacctcagccccaccctggcccaagctggggagcctgtactcctggcattttcccaaggaatctggtggggctgtggccatggtatagtaactcccgtttgttgaggccctactgggtgccactctcacacactcatcttacagccctggtgtgagctatcaccgtgagtggttgcatggcctctctgccacttaccagttagctcagatggggtcccagtgccacttctgagaagtgtcgggtattctgtaatgattataagccaccacatgtgaagataagcaggaggaagcaggactaggcagaggatagtcacctgcctgccatgagagagagctcagagctactcagggaacagggagctttggagtagccttggaacactgtccctggggtaccacatggagctgtccagagaggtttgacatccccatgtccgtgagggctcacctgtgagctgtcactgctactgctttcctccctgcaatgagggggcggggcagatccttccccgaaggtagaggtgagcagcacatctatgtttagagcagtgtgatagacctactagctgggtgccttccttgtctataaaaatgggcatggtggctgggcggtggtagtgcaggcctttaatcccagcactgacgaggcagaagcaggtggatctctgagttcgaggccagcctggtctacagactgagtcccgggacagccaggactatacagagaaaccctgtcttgaaaaaacaaaataataataataataataataataataataataataatatgggctgaagagatggctcagtggttaagagcactgactgctcttccatccaaaggtcctgagttcaaatcccagcaaccacatggtggctcacaaccatctgtaatgagatatggtaccctcttctggtgtgtttgaagataactacagtgtacttacatataatataataataaataaatctttttaaaagtctaataataataatataaacaaaaatgggaacaataaaggcatttacctcaggcattgttgtggggttacataaagttttttggataatggctgatgtgatggaaacactctgtaaatgttagccactggcattttacagaggaggacactaagatgtagagagagacttaagttgtttgccaaaaagaagtcactaaaggggctggagaggtggctctgtgggtaagtacccacatggtggttacactcatctttaactccagttccaggtgacctgacactccaccaggcatgcatgtggtatacaaacacatgtagaagccacatgctcacttacataaaatagataaatcttaaaacaaaattaaaaggcctcaaagccagtagggacagctacctgcctagcattaaaaccttgcctgaggacagggtagcggatggatgaatgggaatgcttctcctcacaaaggagaggcagtaacacacatgcatgcaaaaaggtgcactccagcacctgcctctcacccacagaagtgtcaccagccaaccttaacctcagtcttccatggaaacacaccaaatacccaagcccttcttcctcatccttccaattcacttacagacatctgcatccttcccatactccctagtccagaaatgtgcactccaggccttccgtgcttttatcctttctcacgtgacctgtctcagtaacctttccacatgtcctctgccagcagcccacagctgttgctcttaactgcggtaccctgctgcctcagcagcccctgtctcgaacactgctggcccttctgttccccggccctagacagatgtcctatgtactgtggccaatcccctcagtgtctctgccagaagagacaactcttttcttgcttttctgatctcagttcctctttctggtgggacagactgtcgagctcaggtaggctcagagctgctctgtcctggctcagccctcctctctccactccctcagtggtgctgatcggcgagtcaggcgtgggcaagaccaatctgctgtcccggttcacccgcaatgagttcagccacgacagtcgcaccaccatcggggttgagttctccacccgcactgtaatgctgggcaccgctgctgtcaaggcacagatctgggacacggccggcctggagagatacagagccatcacctctgcgtgagcctaggcctgggggcattgtgaggaacctgggaaaccaggactctcctctggactaggtgtgggaggatgggaggcaggagactctgccgtgtgttccctggggtggaaatcacgaggaaacaagtgctgtgactgaccaacagggacagataggatgtaacgaccactaacacaagccatggccccacttactaagcctctcatgtgcccaggaagatacaaagcactttctacctggcattctgtggagctctttgagtaatacaggaagaatggatgcgctgtaatcctatccatccttgtttaaattggtgcgtggactgagagcgccccctcacttcagcacagtgctctactcttggcaacatgtctaatcacaagtgcccagggcgagctggactttggagtatgttttgtagaccaggttatcctgagctcacatgtagaactagaattcagtgtgtagtcctggctggtctggaacttgctatgtagaccaggctagcctggaactcacacagatccactgcctctgcctcctgagtcctggaggtagtactttaatggagaacatcaaaggaatgttccaccattcacagtcactattttttaaaattgtattggctgattgattgattgatgggttatatatatatatgtattgtacttggaattgaattcatgtactaggcacatgtactaggcacatctctaacttggagtattttatagtttataaagcctcagaaaattaggccttgtggccatatgcaaagtgactcctgaccagtatcaggttcagcggtctgaaatgtggtctatcatgtttggtggaagatagaaccgcaagagacaggaagcaggaagcaggggttattgctatgtacactacagggccatgcccatcctccactcttctaagacttggttgacttgttcttaaactaggaataagccagggatggtggttcatgcctgtaataccagctgaaacagaggattgccttgagttttgaggccaacctgggctatatcaagttcttgtctcaaaacaaagaatcattagataccattggtcttaaacctttgaactccgaggctctagaaagaggctaaatatctgcaggaatttaagccaggtactggtccaagaggcaggcatttggctcacctttggaacgatgccagcagatgaggctactatgtgatctatgtgggaaagacagcaagggacatacctgatcagcatccacaggggcattggtagatgggcagggctgaagtcaggcaaaggaccaagaaaaaggagtgtttttgaggagctggtgggaggttggagcagggaggtaaagcttcaaaggctctgagaccagtttccctgccgtacttgggagccttgagtgccctgaaggggtggcggtgggggtcctgcctgatttcgtacatactgatgtcaggcatttagcttggtgactgtgctccagggctgagcctgacagccctctctagtctctgtccatccctccctgcaccccatacaggtactatcgtggggccgtgggggcactcctggtatttgacctgaccaagcaccagacctacgctgtggtggagcgctggctaaaggagctgtatgaccatgccgaagccacgattgttgtcatgctcgtggggaacaaaagtgacctcagccaggcccgagaggtccctactgaggaggcctgcatgtttgctggtgagggcccctcccactctgtctgactccccctcccctgctcatacacttagggccatggatggtctgtcttccctcatgtggttcactgcttctagcccctttgggaacccatgtgtctccccagactccttggtgtgagactgtcttcattagcagctgttcacagttggttctacaatagccccaccctgaaatactcagagacccttgcagactcctggtggtcatctccccagatgtcccctgggtttgagagcaagcacttctatgcagtgggttagggaacagcttctggcctcctcttggccagttactagatgtaggccattggtgcaagttccttcttccttctccctgcatttctaggttcagctttcctaaatgaacctactttatagattgtatgaaggattaaataagctactatctaccaagggtttggcatatagaaaagagacctagaaagcagtaaataaatgttcttactgcttgttgctgaagatccataactaacatgtgcttcccttcctggcagaaaacaatggcctgctgttcctggagacgtcagccctcgactccaccaatgttgagctagccttccagactgtcctcaaaggtgagagagcctgcccattgggtacttactccattctgggtgggaccctgtcctaactcactgtggcctctagcctgctccgagccactggtcccacctcccatctctccactcatcctagggctgagggaagcaaccggagggcctcatgttttaggggactgagtctgggttccttgtttacccaggaagatagacaagacccaggtatcaagactactttgttccagcaaaaacacttcctcagggtggccacctgtgctccaaacagtgtgtcactagggggcgggacattaaacttctggcctgattatttccctctgtccttagagatctttgcaaaggtgtccaagcagaagcagaacagcacccggaccagtgccatcaccctgggcaatgcccaagctggacaggatcctggccctggggaaaagagggcctgttgcatcagcctctgacttcagctatggccagccctgtgtcctgccttcagctttcagatatctccacctcccttactgcaggacttctccctaccctggagtccctgatcactagcacgcagggtcatcatgccctaccatgtgatctgcccaccatattcctctccatcacctggaccccttacaggcgagggccggaaaataaagctgttttgtattgtgcctggccaccctgctgccttccatctgtctcttgttgggctgtctgtgccacccttccaactttgactcctcctctgagtccctgatccccttctccactccttttcttgtcacccctacaatatccactcctcccccccccccccgcctgcttctggagtttcatggggtctggggacggtgccaagggggcaggagttgcctacccatccctctgccaaccccttgggcaggtgggggatgaagattgtgtggaggggaggggtatttggaaggcaaaacaaaagaaaccatcctccggctccatctggtacctaaagccctggtgccaagaactgaggtcactccaatgccaggggcagtggggaaggtaccagcctggtatgtgtactgaggaggggttcctaagactgagaggtagacatcccatctagtctttttcctgttcctaaacagttggaactgaaattggaaaagtagggggtgggggtcaacgtctttttccagaatgccaagatatagccatccaagtaagggatgatggcaggcaaccctggagatatccacttcccaccccagaacaccaccaccccacagcaatcactacccaagatccagctggcacacagtgaaagacaagagccttaagtaataatacttttaataaaattaacttctcaatagcacatttaatacattaaccctcccccttcttggtttctctgcattgtgtgcaacatcactttgacttgattaattcatgggtctgttttatttcccacctttactttgcatttgaaatcttccttggtgatttgtatgagtcactggatgcctcaaattaagtctgaccacgatcctactctactttctacagtggagagaccatcttccctgccccagggctgtctccacccaaccactcgaccctctgagcactcaccctcgagcatgctagggaaatcctccccattcccagatgctaccatctccaactactgagggtcctagggcaaaaagggcagggggacttctagtctctagatggggtgagaagagtaaactgcggagagggagaagtgtttgggctctagggtcaagaagtggcaatgtcaatcactggtgtcccgcttgcttaagctaaagccaagaggcctctcccattcccgatctgattgctagctggggctgatggaaagaaggcaagtgcttaaaaatgcctatttctcacatgcaaagccaggcttccggatttctgtggggaagatgatgtgatgtggccctaatgggtgattcttatctgaacacagctgggagctgtgacacaagggttgcacagaggccacccaagttcctgcacttttatctgttcttgggggtgggatggggtgggggagttctcccaggctcataaggacaatacttgcactctacttcctgagtcggaagtctttcgtggaatgttaacttctttgagactccatgaagccaggagtagtggtgcgaaccttgtaggcccagcaactaaaggcagcaagatggctgctagtttaaggccagactgagctacagaccctgtgtcaaaaaacaacaaatgaacaaaatccccactacagatgtgaagggaaacagcgctagaaactgcaatgccgctctcatactgcatgggtgctggaggctaagctgatcagcagttgctggctcattcacagaatagctccacctggctcttgaacccactggtagcaagatggaccgaggtgacttcaaggacttcctcagggtggcctgggagggttggacattaggagtaggggcttcctaacagatggccaggctcagccgagctgcactgagcttcggatgaccagtgtgtacccttgcaaagaccctgggacagagcctctcctgtacttatcccacacttaaacccaaggattctcagaatcaaccccagcagactggaagctcccaatctcagctagcagcctgctctagccctgtccccagggatagggcagctcagccactggcctctattctttttcttcccccatacttttatacattctaccgggctcaggggcccacaatgctactaaactttaagctatcttgagtatcgtctactaagtaactagtaattctttttctttctctaggattatatgaaataaatttgaattattttgtagtattctcttcttttaaacccctcggtttttctttctcatttttttttttttaattttttggttaaaaaaaatctatttctcttaaatctcacacctctgagggtttcagtcggccaactaggcctcagttctggttttccctcctgactgcccctggcacagggtaggggaaggagggacactccaggaccctcagtccttagtcccaaagctgcttcctttctggttaatcccttcctttgtttggctctgccggctcccctgagggggagggggaggggagcccacagaatgaaatccaatctactggtgggggccccagaagggaccaactccctatcccctctccaccatccaccccaggatgctcccccaagaaaagcaaatgacatttctccccaaaaagaagtgggggaaaaaaaagaacataaacccgaacatatattaaaaactttttttaagatttaactctgaatacaaatgtattttttttcttctctccctacatatattctaaaccttctaaagtttttttttttaaggatcactttatcataaaataaaatatccttttcatataataaattacctaataaaaagtctttttttcatattagcccaggttctttgctacatttatacggtaataaatgcctttattaaaatagaatattaaattataaagaactgcttttttttctttttttgctatttttgtttcctctcctctgttggtcgcccatctcactcccccattgctttgttttgctgctcgctcacttttgcgcttgtttctaggaaaggctcactcagcaagggtgggattggatctgtggagcccctagtgtaacagtcttttgcctttgtgggtaaggagtggagagggggaggggactgacagacagacatcccttcttcccacccccctcccatcccctgcccctgggcaacccagggtgcccatttggtttggtttctattgtacagacatctcaagatggctcacattgatggaaaggagggaagctgccacaggccagttttctgggctgtgacctccttcctctcccctcccaggctggtggtctggaggggaaggctgaggaga

SEQ ID NO: 1934 - DNA, 601 bp, Mus musculus
ccaccggaagcgactgagggagagcaagaggctgcgactgtaggggtgtgttggtgcaggtcagggttaagagacgcaggcatgctgcgtcccaaggctttgacgcaggtgctaagccaagccaacactggaggagtccagagcaccctgctgctgaataatgagggatcgctgctggcctactccggttatggggacacagatgcccgggtcactgcggccatcgccagtaacatctgggccgcgtatgataggaacgggaaccaagcgtttaatgaagacagtctcaaatttatcctgatggactgcatggagggccgtgtagccattacgagggtggccaaccttctgctatgtatgtatgccaaggagaccgtaggcttcggaatgctcaaggctaaggcccaggccctggtgcagtacctggaggaacccctcacccaagtagcagcatcataacagcgtgatggaggctggagtagaaaagggatgatgatctggagggaggggcggggccctagaaacgccatatcgggcgaggtacaggaagggggggttgcttttttctgaataaattttcaactcttacaaaaaaaaaaat

SEQ ID NO: 1935 - protein, 152 aa, Mus musculus
PPEATEGEQEAATVGVCWCRSGLRDAGMLRPKALTQVLSQANTGGVQSTLLLNNEGSLLAYSGYGDTDARVTAAIASNIWAAYDRNGNQAFNEDSLKFILMDCMEGRVAITRVANLLLCMYAKETVGFGMLKAKAQALVQYLEEPLTQVAAS

SEQ ID NO: 1936 - DNA, 23694 bp, Homo sapiens
  misc_feature (1)...(23694): n = A,T,C or G
gctccaaaccctacctctacacactggctacttcagatggacaggcctcagtttacttctggtcccccttgccctaccatgctcctcactgtgctccccaggatatctcaggtccataccccatgggatggtgtgcttcccaaaggcaacaccggaacctcctcccctccagcacctagcacagagctctggctgagggagtcccagactcagttttccctactcagcctttcttgtggtctaagagctcagcagctctctttcctgagttcccaggtggtcctacctcagcccctccccaccgtagggtttcatattgagctgcttttcctgttcattgaaagtgggtcatggggaccggggctaaccaaggattctcctactctgagctgtttccttcacctcaccagatcctgttcagataacagagctcacaggccagggttcatgcaccatggtttcagcctctgtgcctgtttcagatttcttgttctgatacttgcctagcacctcaccccaccttgttctgggctcgctttattcttcctggtacactctaaggacgaaatctcttttcctgaactacccacagtgataacaaccatcatttattgagcacctactatgtgcctgacacatttattctaatgcttataatactcctctaatacaacagttctcaaagtgtggtcctgggacccctgcaagcattaaaactgttttcataattctaagacatgaatttgtctttttcactcttattctctcatgaggatacagtggagttttccaaagtctacatgacatgtgacattgcaaactgaatgcagatctgagaaccagctgtcttgtagtaagctagacatcaaagagaactacaaaaatgtaaaacaagtccatactttcctctacagttttgtttgttttggaaaataaagttatttttcaaaataatgttatttatgttaacttgtaataattttttttttttgagatggagtctcgttttgctgcccaggttggagtgcaaaggcacaatctcggctcactgcaacctccacctccagggttcaagcaattctcttgcctcagcctcctgagaagctgggatgacaggcacccaccaccacacctggctaagttttgtatttttagtagagatggggtttcgccatgttggccaggctggtctcaaactcctgacctcaggtgatccacctgcctcagcctcccaaaatgctgagattataggcatgcgccactacgctccaccaacttgtaataaattgtcattttaaatgaaacaaatattttaaannnnnnnnnnnnnnnnnnnntaatcccagcactttgggaggccgaggtgggtggatcacctgaggtcaggagttcgagaccagcctggccaacatggtgaaaccccgtctctactaataatacaaaaaaaaaaaaaaatagctgggcatggtggcgggcgcctgtggtcccagctactcgggaggctgaggcaggagaatcacttgaacccgggaggcggaggttgcagtgagctgagatcacgccattgcactccagcctgggcaacgagtgaaacttcgtctcaaaaaaacaaaacaaaccaaaaacacaaaacatttttaaaggttgtattaaaaaaaaaaaaagcagccaagtgcagtggctcacacctgtaatcccagcactttgggaggccgaggcaggcagatgacaaggtcaggagttcgagaccagcctggccaatatggtgaaaccctgtgtctgctaaaaaatacaaaacttagccaggcgtggtggtgcaagcctgcagtcccggctactcagaaagctgaggcaggagactcgcttgaacccaggaggtggaggttgcagtgagctgagatcgcgccattgcactccagcctgggcgaaacagtgagactctgtctcaaaacaaaagcaagttaaaataataagaccagcatggtaccacctcatatttaaaaatatgataatatatagacgtttatagacatatacataggtaataaaagaatcagaatgataaaccccaacttcaacttcagcatactagttacctctggaaagaaaaagaataggagaggggaggggtttgtaaaggctacaactctacctatgtcttatttgcaaatattaaatatgtctaggaaaataaacaaaatactaacaacattagttaccactgaggtagaaaagagctggctgggagatggaaacagagggatcccttctgtaaacctttttttagcctgtatacttttccatacttttttggaatacccttttgtttactttgtgtaacttgtgaattttttttttttttttttgagatggagtctcactctgtcgcccaggctagagtgcagtggcacgatcttggctcactgcaacctctgcctcccgggttcaagcgattctcctgcctcagcctcccaaatagctgggactacaggcatgtgccatcatgcccggctaattttttgtatttttagtagagatggggtttcaccattttagccaggatggtctcgatctcctgacctcgtgatccgcccacctcagcctcccaaagtgctgggattacaggtgtcagccactgcgcctggccaacttttgcattttcaaacatacaaacatagaatgtgtttaatgtaaaattaaatttttaaaaagaaccatggccaggcgcggtggctcactcctgtaatctcagcacttttggaggccaaggtgggcggatcatgaggtcaggagatcaagatcatcctggctaacatggtgaaaccccatctctactaaaaatataaaaagttagccgggcgtggtggcatgtacctgtagtcttagccaccagggagaaggcaggagaattgcttgaacccgggaggcggaggttacagtgagccgagattgcgccactgcattccagcctgggcgatagagcgagactccatctcaaaaaaaaaaaaaaaaaagaaagaaagaaagaaccaaaagggcactgaaattatatatggcaacatgttagggcaacattgattaaaaacaaaaaaaaagaatgttacatttttatctatttttttgtgtgtacttgaataggattcataaagcatttttaaaagtgtataatcctggggcccaaccccagaaatggattcaataagtagctcaaaggtggggaccaggattctcattatcaacaaggtccccaggtgattctgatgcaggtgatccatggaccatacttgagacatgctgtatcagggctggcgtctgacctcaggcctgccacgtgacctttgagcccctggtacaagaagtttgtcaggatgtcaagttccttggatgctatgcctcaaccacttccacaaggacctctgcttatatttgtccatgccaaaatggaccatccccggatatgtactgttgagaactgccttcaagccaaggcccacccctcaggggactggggaaagaaagaagagcaggcccaggtttgcctggggtgggggtagggaatctcgagcccagacagcccaacccactaccctggcccttgatcccacctgttcccgggcagcactgaacatgggctcctggatgtccgtgtacatgcggcggagggcattataccctccagggatgctctcaaggttgctcagggcccggtcctggttccgcatcatctcttgcatcatggctggattccgagcaagctccattgtctgatcaagggagagagacaaaatgggccccggaaccaggggagcaccaacctaggaaaagggtgggccttgaggaaggggggtctgtatcaggatcaggaccagggcccaggaactgccccacagtgacagggagtagagtaaactggacttccttcctctactgtaatcttggctccaagcccgcctccctgtgggtattttggttggctttttctagtggaggacaatgatcccagctgaagtgagggcagcagcttccctcccttaggctcagagtgtccaaagaagtgtcagggtgcacaaggaaactgagtcagaagagacacagaaagaaaggggaggaggcagaagagaaaattaacatctactgagaacctactgtatatgggcacagggccaagtagcttacggaattcaagtcatgtaatctccacaataaccatctcaggtgtttatttctgtccctattttgcagatgagcaaataggctcagagatgttaattgacttgctgccctgggacacacagtcactgagtggtgaagacagtgttcaaagccaggttggttggtctgtccaagaccatactgtgattcctggtaaatgactgcaagttggggaaggaaagcgttcaagctggaataaagctactgacaccctgtaattcccacccccaagtctttgctctgcctgaaccttgagaaacactgaagatgggggctttcttctatggagccaatggcacaatctcaataaggggtggctatgtcaaccccgggggagttcatcacagaaaaataagtataactacttgttcccattcaacttggaataccttccctctccttcccaaatgtgctccacacttgccttttctaagactcctttataactgatatgcccagcttcccagaactctgatctcttgttccgtaattcattcattcaataaatatttactgcatgactaccacgcaccaggcactgttctagacagtgaacaaaacactcacaagtccttgaccttacataaattatcttctggtgagtccagcactggtgtccacagccctgctgggaagatcatctaccttggtcctctggtggagcggaccatgagctggaactcccaaagagcaacatcacaacagtctcccctggttctccattcccaactgggccctgcccagccacagtgctccccaaacaacctactatctttcactcccaggcctttatatttgctgtccctcagccctgaatgttcttctttctttccccctggttcgtcttcctcctttgggtctcagctcggtgacatttcttaaggcctcctctaagccttagggtagggtcaggagctcttctctatgctcctagaggatcccatgattatccttctgatagcaatggccacattgtattctaattgccggtttacttgtcctacttccctttgacacctggaattcctgaaaagctaggcctgtcttttcatccctgtacctccagtgttcaaaactgctgaatacacgaatgaacaaatcaatgtaggacaaagtaggaaaggctgggcagggcacggctgggcaccagtgtcctccagctctccagccctctcatactcacctgcctcatgagttcagggttattgagcatgtggctgatctcagggttccgctccatcaactgctgcatctgggggttggccataatcatgtgacgcatcagatcagggttagacatcatatcctggaccagggggttctccatgatctgtgacagcatctcaggattggacatcagctgccgctgcatctgctgctgcagctccatgaagttggcagagcccaggcctaggctgcccagccccaggatgcccccaaagccagctgtgggaagggggcagggtcacagtctgccacaagaacagtgtcctcacttagccagagccactgaattcagatctccaggacacgccccaaatgcttctcacatgtccctcttcctgtcattcccacagcccggccctgatccactgctggcaaaaaaatgtgagcctactagactgaggctgtgccaaacatagaactgagcagagagaaggcaaccagcaatggtctgttgaatgagtggcccatgtggctactgctggatccaacttttccccagactcacagggtcttccattccctttacctagggttccccacatccccaaccccatttctcccctcactcctaacccttagccatggtccccacctctgagaactcctcagactagtttcttccccagcttgactcaagtatcaatgtctggaactctgtcatggggtcccctatccccatcagaccaggagcaggaactcctgtttctccctcctcttggctttccccaactccccaaccccaaacaagattgtgctctcctctctgagggcttacagagtatggacgcagtagcactgggggatccctccccagcccccggagagggccccccaccactgctcctccggcttccactgccagcatctgaagaggcactgccagaggtggagggctgggcaggggtggcgggtgaagcaggcgtggtggagggtgctgaggcagggtcaggtgtggagggggaagaagcagtggcagcagctggatcttgagccctgaggacagagaaaggagaatcctgttggagtgagcactagaagagggaaggtaccgtgacaatctctgtgcttgctatgggacaactattttaacccaagacccctcctgagcagtcctgaggctggagtggggtgatggcgggagggcagtcagtaaaccagcagagggagaaaggagctagtattatctgtcttcagggcattctgggaatggtaaatcaggttcccttcccctagagatgagatcatattcatccaggagctacctgcctgggcctcagcttaggccctctgggtacagttaagcaatgagtgagaaagtatcagatggggaggcccaatcagaagctggatctgctctgctcctgaacttacttctgaggggtcttgatgaccagatggacagtgagcccgtccttgattccgtgctggttcagtgtgtccccatccttgaggatcttgcctgcgaagatcaggaccagctgatcctgctgagccttaaacctccgggagatttcctctttgaactgtgatcaagaggcagaggtcactgtggaggctgcctggactccccctaccagggaccctgactctttttcaacaccttctgcactctcttgctctcatctctagtcatgggaagtcctttctgtagtctcgacgccattcctccagctgcaataagcatctcctttcttaacaaaggagatgaaccagtgagaggctcttctctcagctccatcccagagtctcccaccctagaaagcccttgctgctatctgcctcccagcttcagtccctccacctagttctctgtaaggcagagcagcctcccatcccaactccttcaacagctttggaccttcagccttctgagacccaattttctctcctctctattcccagtattctcttaacaactacaacaaatagatgccagttattgagcactacctattcaccagttaaagatatagtatattgttattttcattttattattatttttatcttgagatggagtctcgctctgtagcccaggctggagtgcagaggtgcgatcttggctcactgtaacctccatcttccgggttcaagtgattctcctgcttcagcctcccgagtgtctgggactacaggcacacaccaccatgcctggctaattgtatttttagtagagacggggtttcaccatgttggccaggctggtcttgaactcgtgacctcaggtgatccaccagactcagactcccaaagtgctgggattacaggtgtgagccaccacgcccagccgtatctccattttaaagatgagaaaactgaggatcagcgaggtaaggtaacttgccccaggcagaccagaactcaggtcttgacaccaaagtccaggctcttaactaaacacactgcctctcaatgagagccgttttcaaattcagctttgtagggaacatacagtatttaaattctgaaatttagtaattctatgtggttagggagggagcaaggatggagttagacttcccaaattctaccagcccctccaaaacacaacacaaaacaaaacacaacacacactttaagtaaaaacagtgcacttgttaagcagaggctgcttccagatccctctcttccaaccagatggcctatcttaagccccgcctatgtgaaattatggagcggccacagggggtggcgaacacaggcaacagtccgtcattcaacaagattttattgagcacctactgcacaccgtgtaaatctcagaagagctgagaaccaaatgtaaccacgtcgatttgaaagagtgggaaggatctgggcacagggaaatcctcccccgacagccccgtcgctcagagaacactgggcgttctctgaggcacagagtaggcgccggcgctctccgcctgcccccggcccgttctctcagttagcacctagcccgggcccccactccggcacactcccctcaaacccagggtccttcccccttcccggtgcaaggtgtcccctcctcactctccaccacgcccccaggccacaaggcaaaacccgcccctcaacacgcgccacgctcccccagatctcccctcgcagggcgccccctacccgcctctccttgccttcagctcctcggagtcccagccggcccccgccctcctctccggggccctccgggacgccggaccgtcagagaggccccccatctcttcgcagacccctcctccgcgctccccccgccccccgcctgctgtactacctccttgaccgaggctcgatcgcagatcacaatttcctccttgtcccttgggggtcttgacggtgacccgaatggggggcctcgtactcggccccgctcggctccgccatgccgccgccgccacccgcgccgcccgccagcccgacccggctcctcctcctccccgctcgcccggccggcccggctcggcttctgccattttttttcttttttttgagacaaagtctcaccctgtcacccaggctggagagcagtggcgcaatcttgcctcactgcaacccctcccgtgttcaagcgattctcctgcttcagcctcatgagtaactgggattataggtgtgtgccactatgcccggataatttttgtatttttagtagagatggtgtttcgccatgttagccaggctggtcttgaactcctgacctcaggtgatatgcctgcctcagcctcccaaannnnnnnnnnnnnnnnnnnnnnnnnnnnnnnnnnnnnnnnnnnnnnnnnnnnnnnnnnnnnnnnnnnnnnnnnnnnnnnnnnnnnnccccgggagaccgcgacccaacgctgcccgcccgagccgtgccgcggtcccctccagcccaaagcctccccgccccctccgcggctaactcggctccgggacaaaggactttctgtgtcgccgctttatctccgttccctgtgataacttggtctttcttggaagcccaagtcccttccaggccaggggactttccccgacttggaggttgggttttcccaccaagcacgtccacctaggttctcagctctgggactgaccctatagccccgagggtcgcggcctgaatggtctattaagaacggttccagggagctgggttttggctgcgtggcctttcagagccttggtttcctcaagataataataatagtacctctcgcctcatcgcacagaattgtgcataacggagaaaactgttttgaaagtaaccaaaggcgtgcctgacaaatatgaggatgtagtataattattgaatcgtggactgccaagcggacacgttgattcctttctccccgaaggggttaaatgtccttccagcgctgctgctgtcctttcactcccgttcttttccgccccccaacaaccgcgtggtcggcttggaaaggcgaactataattcccagggtgcctcgcgaggccacaaagaactacgattcccagagccccccgcggtggggcggggttgagtcggaaccacaatagccaggcgaagaaactacaactcccagggcgtcccggagcaggccaacgggactacgggaagcagcgggcagcggcccgcgggaggcacctcggagatctgggtgcaaaagcccagggttaggaaccgtaggcatgctgcgccccaaggctttgacccaggtgctaagccaagccaacactggaggcgtccagagcaccctgtgagtgcagaccacggacccgagcggcgagcgctgcagtggggcggcgcgcggctccctgagggaggggtggggaaggatcaccaggaagggaggaagcggcagagggggcagcggctggggataccggccgggaggtcccctgtcgaaaagggaagccggtgtgctgggtgcttagggcatgttccgggacacgctcaggccagagccttgctggatgtgcccttggtgggacttgggatggaaacccagacgttttactccccgctctgagcacatcgctatccctccccgcccctcaccaggctgctgaataacgagggatcactgctggcctactctggttacggggacactgacgcccgggtcaccgctgccatagccagtaacatctgggccgcctacgaccggaacgggaaccaagcgtttaatgaagacaatctcaaattcatcctcatggactgcatggtatggagaggggagccagacttcccctgtcccccaaaggggatcccaagggggcgacctggaccccatcctggatggttggaggggcagggacaggatctccggaagattactaagagttggtctgcagcagcatttgtaataggcaggaccctattcatcaagtggtggtgaggaaggatccctggacctgagaggtctgacttgggttctggtctcagccatccacttatcagttgtggaaccttgggtaagtcgcttaacctctctcagcttccttacctcatgtttaaggagaagacaataatttccctctccccgctcccctcatgggttgttgtgaaggtcagatgaaataatgggtataaacagtagaatgacgtgcaaacacaaagtgttgtcatcccagtttcaccgactcacagaaccatggcagtctccagaccctagtccaaccccttaagctttcaaagaaaggaaaatgaagtccagaaaggggaagtcaccattagattgtgaacttcttagtatctgttcggtcgacaagtatttaggtccttgcagtattctcaggactagggaaaaaatagcaaacagaaagacaaaacccccagccctaataaatcttacacagtgatacaatcacggctcactgcagcctcgacctccctgggctcaggtgatcctcctgccccagcctcctgagtagccgggactacagacatgcaccaccacacctcgctaatttttgcatttttccagagactgggttttgccatgttgcccaggctggtctcaaactcctggctcaagcgatctacccacgttggcctcccaaagtgctgggattacaggcgtgagtcactgtgcctggccacattttttaaaataagtaaaatatatagtatatattaggtattgaaaatgcaatggagagaaagcagggaagtgaaagagtatgagtttgttgggtgtatgtgtcagggacagtctcactgaaaaggtgacatttgatcaatgatctgaagaaaggtgggggacaagccatgtggttatctgagggaagaatattttggacagaacagcaagtaccaaggccctgaggcagaattatgcctgctcaaggatcaacagggttggttggtatggctggagttacgtgagatggaggagggtagtaggagatgaggtcagagaggcagggagtgcagtgcttggttcctggcatacaataaatacctagtaaaagtttgctgaacttacttttgtttttttcaaattggccagaaggtgaactctccaggaaggatcttcattgtaactcaactgcctactctcccctaccccctgcacaaccaatgccatttttagttcaacatatgactcctactggatgcctagagctggtgctatagggcaatagctttcaaacgttttgaccacaacccagccataagaaatacattttaaggggctgggcatggtggctcatgcctgtaatcccagcactttgggaggccgaggcgggcggatcacaaagtcaggtgttcaagaccagcctggccaacatggtgaaaccccatctctactaaaaatacaaaaattagctgggcatggtggtgcgtgcctgtaatcccagccactcaggaggctgaggcaggagaatcacttgaacccaggaggcagtggttgcagtgagccgagatcacgccactgcactccagcctgggcaacagagcaagactccatctcaaaaaaaaaaaaaaaaaaagaaatacattttaaggctgagcacagtgcctcactcctgtaatcccaacactttgggaggctgaggctggaggattatctgaggccaggagttcaagaccagccttggtgacctaataagaccccatctctacaaaaaaaattttaataaataaataaataggaaaaaattttttaagaaagacattttaagtcagagctcaacacacacatagacccactaaaacaaaagtcatgaaacaatacttttcctactacatgtaatatacttcattttttcttttttggtttttaatgctgatcaaccttcttaatttatctcctaactgtggggtcaaatctgcaatttgaaaaacattaccatgggaaaagaggagaaataccagttgggttaccactcccatgcccctctcagtgtctgtggggtgagctcacagtaataacatcactcatttggacaactgttggcagatatgaaatttcatggtattagcaccctcaccaactgggatgaggtagggattacagaaagaaaaactgaatttctgagagactaagtttcccagagtaacatggttagtaggtggctgtgctgaggctggaacctgggctcagaaccccatgttcagggctgtggccaaaagcttttccgctgaacttcctgctgtgcccagggcatgggaggaagatatagtctctctggggccagagaagcctttggggaaggagggtgctaagggtgccaagcagaacatcacatcccatcatatcacccccaccaggagggccgtgtagccatcacccgagtggccaaccttctgctgtgtatgtatgccaaggagaccgtgggctttggaatgctcaaggccaaggtgtgtatgtgcccatccctccatagccctgggcccagccttcgtgcttctacactgtgttcactcccaccaggaccctgtttctagagttctcatgtctactcagtccatttctggtgtgggccagctcccaagagcaggtgggggttgggggctggttgcttcctatggcactgggagcagacctggatttggggtccctaatgccaggctgtgtgcgggactgatctctgttctccctctgcaggcccaggctttggtgcagtacctggaggagcccctcacccaagtggcggcatcttaacggcattggtggaagctggggtcagaaaagagaaatgaccatttggaggggcggggcctcctagaagaaccttcttagacaatggggggaggatgggactttgttttttccaagaataaacttcaactcctgtcatgtgtcttggctactttcttggatgggaggaatcagagaagataggaagaagcaggcatcgcttctaggattcctcatgttctgcaaggatggacttctacccaccccttcaccatgaccttctgcgaacaatggttcttggcagttacgccaaatagtccttgtcctcaccaatggcatgacctcacctagaccctgctgctcagaacagagtcttacccacctcataggcaaaactgggagtgagctcagaggtgcaagggtctggtgggggttgtgttgcacagagaatataaaggccctgagaggttagtgtctatcatttcaggtttgggggcgtgcgtgccttttatttttttgagagggtctccctctgttgcccaggctgtaatgcagtgacacaatctcagctcactgcaggctcaagtgattccacctcagcctcccgagttgcctggattataggcacacaccatcatgcctggctaatttttgggtttttgttttttgtgttttttaggggttttttttgttgtttttgttgtttttggtagagatgaggtctcaatatgttgctcaggctgttctccaacttctgggctcaagccatcctcctgcctcccaaagtgctgggattacagatatgaaccacttcgactggccagtgagtgccttttctattcttggggttgggagggtgcccctaacagcctagaacaagctatccctttcttcttcttccaggtgtttatgtgcttacacagaccctccccagatcttgaagccctttgtagacaagaggcctttgctgtgaggcctcaggtcctgtacagggagtagaagtaacccagacctcccaaaggccttcatctccagaccctgctcctacactcagaccactcaccccagctgtctgtttctgccccaggtctctgcctacccaatatccttaaagcaggtctgtatagggagctaccagcccccttccccagtgccatataaaggaacccatcccagagaagtgggtaggtttcgagtcccagctccacccaagatgagaaacactgcccatcccaggccctgggctgtcaaggaagggcagaagttactgtggccatgatactcccacagctctgcattgcagcagggtgactggtgttctatcagcccctggtctaatatcccttactctggttcccccagtgtacccccctaccagctctgaaggaaaagcaggccaagtgggtttcttcctttttttttttttttgagatagaatctcttgctctgtcacccgggctggagtgcaatggcacaatcttggctcactgcaatctccgcctcccgagttcaagcaattctcctgcctcagcctcctgagtagctgggattacaggcgcgtgacaccatgcctagctaatttttgtatatttttagtagagacagggtttcaccatgttggtaaggctggtcttgaactcctgacctcgtgatccgctggcctcggcctcctaaagtgctgggattacaggtgggagccaccgcaccaggcctctttttttttttgagacggagtcttgctctgtcgcccaggctggagtgcagtggcgcgatctcggctcactgcaagctctgcctcctgggttcacgccattctcctgcctcagtctcccgagtagctgggactacaggcacctgccactacgcctggctaattttttgtatttttagtagagacacagtttcaccgtttctaccatagagccagagagggccccctcctgtttttttatctcttaccaagacctcctggggctcctcattccttcaggatggtctcgatctcctgaccttgtgatccgcccgcctcggcctcccaaagtgctggaattacaggtatgagccaccgcacccggccttttttttttttttttgagaagcagtctctgttgcccagactggagtgcagtggcacgatctcagcccactggaacctctgcctcccggcttcaagcaattctcctaccttggccgcccaagtagctgggattgcaggcgcccaccaccatgcccagctaatttttttttttttttttttagacggagtttcgctcttgttacccaggctggagtgcaagggcgcgatctcgactcaccacaacctccgcctcctgggttcaagcgattctcctgtctcagcctcccaagtagctgggtttacagccatgtgccaccacgcccagctaattttgtatttttttagtagaaacggggtttctccatgttggtcaggctggtctcaaactcccgacctcaggtgatccgcccacctcagcctcccaaagtgctgggattacaggcgtgagccaccgcgcctggcctcaagtgggtttctgaggggctatttcttgctcattagttgggggaccggccctcaccacagattccagaagcccagcaatgcacactcagccctcagtgggctgtctctgaaggtcctgtccctttttcgcttcccccccgctggagctgcttctcccgcttgcgggagcccaggctgagagcagacacccaacctgtcgaacctgtctgacgtcatcatctctccacccacctgggccccaggtctccagccaccccgctcttcctgttctcagcttccgtcctctctgcttccttacagcacccccacctgccagagctgatcctccctaggccctgcctaaccttgagttggcccccaatccctctggctgcagaagtccccttacccccaatgagaggaggggcaggaccagatcttttgagagctgagggttgagggcattgagccaacacacagatttgtcgcctctgtccccgaagacacctgcaccctccatgcggagccaagatggggaatggaactgaggaagattataactttgtcttcaagggtgagttgggttccctgaagcaagaggaagcctgagagacccagaaagagattgaatagagccagagagggccccctcctgtttttttatctcttaccaagacctcctggggctcctcattccttcagaaagaaagctgcagggagtgggggagggtctggttgcaggggcaaaagtcagggagcttctgagtatgctctactgtggtaaataatgatgttgattcctccttaagagtgctgagttaggctcctctgccccgttcctaatagaaacccaaatccctggtgtcagccagtgcagcacaagagatggaggtcagacttcagaaaggacttccctcttttatttttttttctgagacggagtcttgctctgtcgcccaggctggagtgcagtggtacaatctcagctcactgcaacctccacctcctgggttcaagcgattcttctgcctcggcctcccaagtagctgggactacaagcacctgccaccacgcccggcttatttttgtatttttaatagagacggggtttcaccatattggccaggatggtctggaactgacctcatgatccgcctacctcggcctcccaaagtgctgggattacaggcatgagccaccacacccggccaggacttctctcttgagaagaaagggaaaccagcaaacaagaggaagaaagtcatcttttctgggcaggtgtacagggaacgagagaaaggagagacacatcccattatagggtggggcaataaatacatagggaagacagaaaatatcatgaatttgctgcagagtctgatagaatccagaggactcctagggttgtagcctcgtctgcctggcccttggctgactcactggacctgcataccaggcactgggctcaactttgctgtccctggaagcatgcatgtatctttctagcccctgtgtttggtgcctttgctgttttccaaccccaccttcatacttcctttagggcagggtggactctccagccaccctaccccaatgcctctcccaacctcagcccggcccctcccttgagctgggactctcactccagaacccgcccttgagctggggaacctgtactactggcatcttttccaggaaggaaagggttagcaatagtctggggcaataatatgaggaactaccatttattgagcacttactatgtacctgccactacctcattaataccataacaatccccgaaagtcatattttattttgaggggcagtgtaacattgtggtcaggagccagactgggttcagatctcagccctgccacttacaagtattgcgggttggtcagccgggtgcagtggctcacgcctgtaatcctagcactttgggaggccgaggcggcgggatcacttaaggtctggagttccagaccagcctggccaacatggggaaaccctgtctctactaaaaattcaaaaattatctgggtgtggtggcacgtgcctgtaatcccagctactcgggaggctgagacaggagaatcacttgaacccaggaagcagaggttgcagtaagccgagactgtgccactgcactccagcctgggcaacagagcaagactctgtctaaaaaaaaaaaaaaaaaaaaaaaagtattgagggttgggttggggtccctagaagcagacgctgagaagaagttggggtgttcaatgtttgtttgttttttgagacggagtctcgctctgttgcccaggctggagtgcagtggagcgatcttggctcactgcaatctccgccttcctacaacctccgcctcctgggttcaagcgattctcctgcctcagcctcctgagtagctgggactacaggtgtgcaccaccacacccagctaatttttgtatttttagtagagacagggtttcatcatgttggctaggatggtctcgatctcttgaccttgtgatccgccctcctaggcctcccaaagtgctggtattacaggcgtgagccaccgcgcccagctcaatgtttttttacaaatcagcacctgtgaaaggaagggagaggaaacataattgggcagagggagaagtcaaacagcaacacaggctggacaaacctgggtcaagggcggggagctctgtgattgcctcaccttgcttgagcactgggtgtaggctgcccagaaaaggcatgacttccagtgaggccgctgtctgcaccagaggcagacgctgaaggagctgacagctggagcctgtctgcagcctgcactccctgcagcttggggcaagtccttccttgaaggctgatctggccagcacatctctgtgtttacaacactagccctgttatcttgggcaagtcatttgacctccaaagcgccttgtctgtaaaaacaggtaaaatagtaatgggattcatggcattcttatgaggattaaatgaggtaatatgtgtaaagcttttaacgacactgcctggcacatagtaagcattcagtacactgtaaacatgaaccattagtatctccactttacaactgaggcttagaggcaaagtagtttacaaaaggccacaaagtctgacttcaattcccttgccctaagcacctttgtggtatgacgctagggctgagagcccacccactgagagggatgagggagatgtgcccagtaggggagaggcaggaacacacacacacatatacacacacacacacgcatacacacacatcctcttacccacacatatccatattatttccagcttttccatactgtcctatgcaaataaggaatgtttaaatatatattttttatttttattttttgagacacaatttcactgtcacccaggctggagtgcagtgatgccatcacagttcattgcagccacaacctacggggctcaaacaatccttccacctcagcctcttgagtagctgggactacatgcatgtgccaccacacttggctaatttttttttctttttctttttttttttttgagtcggagtttcactctgtcacccaggctggagtgcagtaacacaaactcggctcactgcagcacccccagggctcaagcaatcctcccacctcagcctcccaagtagctgagactacagacacatgctaccatgcctggctaatttttgcattttttgtagagatggggtttcaccgtgttacccagggtggtctcaaacttgtgggctcaagagatactcccgccttggcctcccaaagttctgggattacaggcgtgaacctccacacccagccaaggaacttttaaagttggaggaggcctttataagttgtataagcaaggcaactgagactgagaaaaggtgagtcacttgttcaagttcacacagttagttagaagctgagcagggaccagagcccacaatatgtggctcccagtccttgggtgccagcctgcctttccagaaccactctgggtggcctcctctaattctgtgtgcttagttcagtgccagtgcaatttgtgggctctactcacatcagccccctacactctaccccagcccccagctcatccacatgggtaagactgggccctggatgctgcccaccagtctaaagggtcttcatggcccctcaggtggatccttgtctctgaaaacccaaaggcaaaaactctggcctgctaacaacaatcataccagtcatgatttttacacttactatatcctgggcaatgtctcacttacttcctacaataacccttaaggtagatactaatgtcttccccatttttcatatgaaaagaacagctcagattggttaaataacttgccgaaggacacatagctggtctaacacccaggcccatgctcttaaccatgcgggactgtccctccttagggacaactggaacctaacttcttacacacacatgagcacacatgccttcctctcacccacagatgtgtcaactgccaaactttctccttacccacactttgattcacacctctgttccttatgcaaacacacacacaccaaacctcccacttgtcctcccagctcatatatatagagacaagtgcaatgttctcatactccaagtcctagtccagaactgtgcaccccctgacctcccaccatccctgtccatattcacacacaacagtaatgtctccgcatgacactcataaagagcccacagatgtcactccctcaccagagatgcaggctgactctgcaaccatgtatcaacagaccaggctataacccgtcaagcccctttgtttgttttaaactcttggctttcctgcccaccaggacagatgcattatgcagagttgcagactccagtctcacaggagactccgttccctaatcttttttctgagctcagttccctttttctgctgggcagaccctccaagctcaggtggggttggagctgctctaccccatgctcagcccttatctctccactccttcagtggtgctgatcggcgaatcaggtgtggggaagaccaatctactctcccgattcacgcgcaatgagttcagccacgacagccgcaccaccatcggggttgagttctccacccgcactgtgatgttgggcaccgctgctgtcaaggctcagatctgggacacagctggcctggagcggtaccgagccatcacctcggcgtgagcccgggcctggggggctgctgggtggtgggagttctggggaagtcgaggaacacttctggaggagaagtgggggaggaggaggcaagggggctcagcagtgggctctggggggtggggatggagatcacagaagataaaaggtactgtaaacagaaacagcacaagccaggatatagtaacactgactagtactactaaaagcaggaatcattgccacttactaagcctttgctatgtgcccaggaagggacaagttactttacatttggcattttatgtaacccttaaagtaccacaggagtaaagtgctataattagttaatttctgtataaatacaaacaaggtgaaatcagggtggagctaggatgggggcgagctgcacggatcgagagcgccccctcacttccgcacaatgctctgcacttggcaactttcatctaaccacagaggaccaaaagctgaacccagcatctgcattttatgaagactcagaggacacacaggaggttaggcctcctgacaccacatccgaagtgtctcttaggccgggtgtgttggctcacacctgtaatcccagcactttgggaggccaaggtgggtggatcgcttgagctcatgaattcgagaccagcctgggcaacatggcaaaatcctgtctctaccaaaaatataaaaaattggccgggcttggtggtgcgtacctgtagtcccagatacttgagaagctaaggtgggaggatggcttgaacccgggaggcggaagttgcagtgagccgaaatcgccccactgcactccagcctgggtgacaaagcgatactgtgtctcaagaaaaaagtgtcagctgggcgcggtagctcacacctgtaatcccagcactttgggaggccgaggcgggcagatcacaaggtcaggagttcgagaccagcctggccaacagtgaaacccccgtctctactaaaaatacaaaaattagccaggcatggtggtgggtgcctgtaatcccaactactcgggaggctgagacaggagaatcactcgaacctgggaggtggaggttgcagtgagccaagatcatgccactgcactccagcctagcgacagagcaagactctgtctcaaaaaaaaaaaaaaaagaaaaagaaagtgtcttccagtcagtgtgaggcctaagcatgtgaaatggggtctgtttgtgtgtatatggggtggatagcacttgccagggggcaggaagcaagagtcaggggctttggttacacatgctcctcgttacctgatctcttatgagcctcagttgactcatcaatgaattgggagttagacatcactagtctgaagacatcccatccaactccaagagggagactggatgctttcagtgatgccttgaatggtcaggccagggactgctgcaagaggtaggcattcagctaatcctagaaagaaggccacgggagagaacaggccactgttaaggagccatgtgaggaagatcttgaaggtggcagagttggctaaagcccagatgtgcactggtggagagtaggggctaaaatcaggacgagaacctgagaaagtagaggggctggctgtgaggaagccaatagagattttagagcagggaggtgaaactttatttatttagttagttagttgagacaaattttcactcttgttgccgaggctggagtgcaatggagcgatctcagatcactgcaacttccgcttcccgagttcaagcaattctcctgcctcagccttccgagtagctgggattacaagcatgcgccatcatgcccggctaatttttgtatttttagtagagatggggtttctccatattggttaggctagtcttgaactcctcacctcaggtgatccacccgccttggcctcccaaagtgctgggattacaggcgtgagccaccgcgcctggccgagggaggtgaaactttacaggctccaagactagtgtccctggaaggcagaggagccttgggctgctctgttgggttctgggcccctggccgcaagtttctgtatttcctgatctctagtactctgatcccgggtgttccagcttgacggctctgctctgatgctgggtccaatgcctctgatcgtatctctgtccatccttctcattcccacccaggtactatcgtggtgcagtgggggccctcctggtgtttgacctaaccaagcaccagacctatgctgtggtggagcgatggctgaaggagctctatgaccatgctgaagccacgatcgtcgtcatgctcgtgggtaacaaaagtgacctcagccaggcccgggaagtgcccactgaggaggcccgaatgttcgctggtgagagcctgccactacccaggctgactcctccaagcttagccc

SEQ ID NO: 1937 - DNA, 497 bp, Homo sapiens
gcgggcagcggcccgcgggaggcacctcggagatctgggtgcaaaagcccagggttaggaaccgtaggcatgctgcgccccaaggctttgacccaggtgctaagccaagccaacactggaggcgtccagagcaccctgctgctgaataacgagggatcactgctggcctactctggttacggggacactgacgcccgggtcaccgctgccatagccagtaacatctgggccgcctacgaccggaacgggaaccaagcgtttaatgaagacaatctcaaattcatcctcatggactgcatggtatggagaggggagccagacttcccctgtcccccaaaggggatcccaagggggcgacctggaccccatcctggatggttggaggggcagggacaggatctccggaagattactaagagttggtctgcagcagcatttgtaataggcaggaccctattcatcaagtggtggtgaggaaggatccctggacctgagag

SEQ ID NO: 1938 - protein, 134 aa, Homo sapiens
MLRPKALTQVLSQANTGGVQSTLLLNNEGSLLAYSGYGDTDARVTAAIASNIWAAYDRNGNQAFNEDNLKFILMDCMVWRGEPDFPCPPKGIPRGRPGPHPGWLEGQGQDLRKITKSWSAAAFVIGRTLFIKWW

SEQ ID NO: 1939 - DNA, 42095 bp, Mus musculus
  misc_feature (1)...(42095): n = A,T,C or G
ttcatatgtgcaatactaaagtttgaatcagcccaagaaaatttaataagttgaattaaacctggaaaaaaaaaaagacaacaacaaaaaaggtaacatctaaatgacagtctcagaacctcccaactggggcaaaaccactatgagacacgcgatggggactcctggttttagagtaggatttggtaagtctgatagaagtgttgtcaagccatctgctacagatcacccatgctacttgcctgtgtcaactgggggaggcttgcatgttgttggtgagtgggagtggcagaacgttagaatatgatgggtctgatgtaaggagatcctggagttataggaatcactctcgaaaattattaaaaacaaaaggcaaacctggtctccgtcgccaccttgtggctatgtttgggattgcaccctctgagacactcccaaggatccaccatccacactatctttagcatgttcacgacaacccactcctacagggttccttgatcctgtgggccctgctaggcacactctcccatttctgcaactgaacgtttaatgaacatacctgtaatcccagcacttgggaggtagagacgggaagatcagggtcacgggtcacctttggctacattggaagttcaaggccagcctgggctgcctgcgacccccatctcaaaacatctttatgaccactgacctgtttctatccacctcttcccaccatagtggaaaaactatctcagtgattcacctgtgtcccaaatgcctgacacagagccaaacatagaccacacacacacacacacacacacacacacacacacacacgaggcttcacgtgagtaaaatcaggagagcacaagagtcttggtgtcctgcctgctggctgggagcagcggctccctcagtcaccccaactagagaagaagcactgtggctacaaacactgctgcccaggaccaggaggccccctccctccctccctccctccctccctcacacagggaaactagggttaggcccaggactctagccccagtcagcagacctcaaggctgtctttaccagttggctcaatggtctggttggtctgcacctcttaagtccaccctagggggctggtgagatggctcagtgggtaagagcacccgactgctcttccgaaggtcaggagttcaaatcccagcaaccacatggtggctcacaaccatccgtaacaagatctgactccctcttctggagagtctgaagacagctacagtgtacttacatataatcaataaataaatcttaaaaaaaaaaaaaatgtccaccctagggcctagctcagcagggacagtgggttgggacagtcctggaattcaagaacagtggttgcaggccttctgaccagccacttgcctcgttgcctgactccctgggcatgagtcaccaagagggctggaaaggcgtggccacggtgtgcctggcttgaaaggtgtccctgccgccctgccgatgagcagtcgcttccttttcctcccattgtgtggctcgcttcctttgtctgtctgctcaccggctcatttctcagttaccctgtgacattcgggctgacctggatttccaggccattcccacacatagctttaaggttgccgagttgtctaaatctgaatgagcacgtgtgtgaatgtgagcctctatgtttgtggcgatcagaggaaaacccttccccaggcgccttttctttgagacggtcttgcactggcttggaactttcaccatgtaactaggctagctagccatgaactcccaggacacaccacctctgcctgtccttccccgtcactggcctcacagacctgtgctaccactcccagattagggccttttctatcagccctgggttttgaactccatgtccacacttgtgtagcgagactttaccttctgagtcatctctcctgcctggtccactgttataaaaagaaactgctaaactttttgagacaggaagcctgcagctgcggtccaaacattgagagcccttactgctcctccgaggacctggattcagatcaactcccagtaactctagttcccattcaatattcccttctggtctccttgggcaccgggcattcatgtgatgcatgtacatacatgaagacaaagcacatacataaaagtaaatccaaggggctggtgagatggctcagtgggtaagagcactgactgctcttccgaaggtcccggagttcaaatcccagcaaccacatggtggctcacaaccatctgtaacaagatctggcaccctcttctggagtgtctgaagacagctacagtgtacttacatataaataaataaatcttaaaaaaaaaagtaaatccgagagagagagagagagagagagagagagagagagagagagagagagaaagagagacagatccacaatggtagaccacatcactcacctagcagcaaacagaggtcccaccatgtttgacacaggtttgctagaacctagaggtgactcccccacgaactgcccccttatgtgtctctgtgtgtacaccctatgctttcaggtgcctgcagaagccagaaaaatgccttggatttccctggagctggagtaataggtgattgtgagccacctgctgtgggtgctgggatctgaactctggtcctgttcagctggagtgtagatgttaactgctgagccaccgtaccagctctgccacaccacactttgatttggtttgagtcaggcaacaggttgtcctgtggctgtcctgaacctgctgtgtattcaaggatgaccctggccgcccgatgctttctcgccctcacctaagtgctaggataacgggtgtgtaccaggccaggcttgccagagtcccgacttctcacaaacccagaggctctccctcctagaagcccactgatttcctgcgtgctccttgccagccaggagggaattctcaggccagctcatgatgcaaggatatgagtttccatcagcccaggaggcctggtctggcctgcccctgcctgctttgtttccagcctccctcctagacagggggtcttttgaagaattcctaggagagaggcaggagaatagcagcgaaccactaggtgtgttggacaagcctggccagcagggggcctcctggctaaactagaattctagcccagttctaccgctgacacctggggattccgccctgtggatgggaggcaaatcttggctgcacctactgtgtgccaggcctaggggcaccatccagtaggaaaaaaaccccagcgacactttggtcaaggagggcctctttaaaggggacgtttgagcagagtccagagccaggcagcagcctggggaggtctggagtaagtagagcagagtgatagggtaatgggtcctgggtgggggctggaggaggggcaggtgtgctgccagagcggagagcaaagggatggtgtcagaggagcttaaggcagagatgccagggggatgtgcgggggccggggggtgggggtnnnnnnnnnnnnnnnnnnnnctccccccccccccccccgtgtgcagttggggaagtagagccttggagagacgctctgccttgattcccatgatggggacacacagctggagctgagcccagtgcctctggcctacacgactgtacctatcccatggccttcagtgggttgaggagggactgctacatcgccaagtcctaggctgtatggtacatggtccctgccttgaggattgaacaggaggtgggggcagtgcaggaggctgaggagagagtctaggctgcctccccgtgttaaccttccccggggtcccagcagctgaccagagaacacacatccatcttttatcccctgtgagcctgctgagagtctagcttagtcctggtgtgaggaacatgggtatgcctcgaaagaccttgttcttcaaatgcctcagggtggcatagtagcccaaggcaggcaaggcgcctgtgatgagcagtggaaggaaaggcccacccagcttaggggtctaagtgcaggggacccaaaggacaaggggaggtgatggggacagttcagagcaaaggggactaacaagcccttgggactgacattttgggaagagatggaaaagttttagggggaagtacaagcaaaaaataaaaataaataaacctctcctcctgagacagctagttgcagtcatacttttctcaaatgagaagggatggtgtcacccaaaagtccctaaaggccttccggagttcctttgcagaggtgacattcaagaaacatgcagggccactcaaagcccaaagctagaccattcaaggccagtggttggactgtataagatcagagactgtaccaattaaggtcagagcctggaccaaccaagttcagaggctagactaggtttgttggtcatgacctgtgtctcattggggacatgtcctgacctattatggagctgtatcctgttgtaaggttagcaatctttgggcagatgtttgaagagggtggaagaggtcctaaccttgctttaggacactagaaaaatctcagaagggtcatttagagaagaccctgagggatgtctaggagttcacaaggacttttcagaggatgtaacattttggctggttcttaaagaataaagttcaccaagaaagacagaaaatatcttctgggaactgggatctcctgaaggactcccataggccactagcgagagatcaaggcatggcctgggcccaggtctttcctctgcagtgtggggtaaagggaatacatggctcagctggtgtcctggctaggtgactactgccccagctggtgtgtgagctccccgagatcttggcatctggctgttaagtctgactgtgtgccttgctggggtcccctatgaagagtccctggtaagcacccccttattggcagcccttctcttggccgactcagcagctcctgaagatgtgcggacctgcaggttcccaatggttgagacaaagtggttgaagtttggagctggtaggggaggacccagtgacaaacagctgctcacctgcctgacctaagtcacagccatgatatggcagtgtccaccatatcccatccccgtgggaagattatggggtgctaatgggcttcaaaccgagtgtgtgacctcagggtttggagaagcctctagggcccttggcacgggggccttggatattcatgttcattaagaacaaggttcccctagccaggcagtggtggtgtatatgtttaatccaagcattcaggaggcagagacaggaggatttctgtgagttcaaagtcagcctagtctacagagtaagttcaaggacagccaggactatacaaagaaaccttgtcaagaaagaaagaaagaaagaaagaaagaaagaaagaaagaaagaaagaaagaaagaaagaaagaaagaaaggaggttctccatataccagctggataaccacacacacacacacacacacacacacacacacacaccccagcttgtccacccacaagtgggcatgtcacctttttttttaaagatttattttatttatatgagtacactgtagctgtcttcagacactccagagagagtatcagactccattaccgatggttgtgagccatcatgtggttgctgggacttgaactcaggacctttggaagaacagtcagtgctcttaaccgctgagccatctctccagcccataatgtcaccctctttgtgtgttcttgtaggtttagtcaaggtcaagtctttagcaccagacccaccccagagaagagctagagatgtgtctgtacttattgttttgtttagaaaccagtctcattctatagcccaggcctgcctcaaactcaaagcaatcatcggctccctccaaaatactgaggtcccagtatgcaccaccatgtctgacttgacttatcatttaggtttctgagacaaggtctcactatatagcccaggctggccaggaacttgaagtgatctgcttgcctcagtatccctatggccagcatgccacactatggggatcgaggacacaggacactgaggagttagaggagtgactctttaggcccagattccaaggtcagctgggcaggccgcccattgaggataataataatattctccccagttcagaggctaactgtgcaccctgtaacttactctgttcccacagcctggggatggggagactctaaatgcccatttcacgattgtgccaactggggccaagagaagtggggaattctgggttatacaggcaggaagcgtggggtgacggttccatggcctggtggggattcatccccactcccatgaccctggagaaggactcacagtatccatgagaggtcccagctccacctgggatagtcatgtggccccatgctggccacctcccctcagtgtccccttctgtaaacacacttcctacccttgcttggtgaggataaagttcccaccatgggaagcctacgtaagggctcccattggcccagctgcctgtcatcaactgctaagcctgcccttggggcgtggtcaccacagtgtctctggtgtccttgtagcagtcctagaacaggcacagtcagacagaccagcccctcacttgagcctcagtttacatagagactatgattgcctaggatccattaggcacacagtgggtgtttaacctgcaggcttgtggcttgtgtggtgcctgcctgtctaccagctgcccagcccagcctaggcagcagacacttggtagtggcctgcaaatgtgggtggggacccccggggcagccctgccctcatggctgccactggacagaggcctcagtgtaagcagaccgggaacctttcacaagcctagacccatgacggggtgtctgagaatgctgccattatccgattcatagaacacaaaggggccacgtgggggctcatataggcaaggcgcctgccatgagcccataagggctcagggtcttcaccctgccctgtaagtcccctgaccacagaggtcaaggacatgcccagagttagcagagggcactgacacacaggaatgagaactatttcctccagccccactggacaacaatgaaagagcaagcctctactggatccctaggggttggggcgcctaggtagcaggggagggaccctccagagaccaaggaagcaggggctgatacatgacaagcccctgtaggacatcagcagcaacagtgaggtatgcctccgaacagctttatccgtcggtcccttctgggaaccctaaggggtcacagtggcagtggcctgaggataaggaattgtactgcgtgacatcaggaggccacgggagccctcttgagccttggcatccatgaatggtaactgacatccaggccccagatgacatctggcacacatatctgctggggcctagaagctctcccgagggaccaggaggagtagggagatgaaccccagttccagaggtggcaggtgggcagaccccaggcttaccggaggccagcggctccaacatgtggccggcttcgttcctcacagcagtgctgtggtttggagtccatgcctctcttcagatttgaaactgaagctcctatccctgtggtcaccaggaggttacaggcaaggctgaggttggaacttaggggtgtgaactccagggtgaatggcagaggacacagtggctaagagctgagttgggacactgagcaggctgtgcagcttcaggcttatgtccccacctctctgacccttcccgtccccatgcaggctcatggtgaggaaggactggaagggnnnnnnnnnnnnnnnnnnnnnnnnnnnnnnnnnnnnnnnnnnnnngaagttgaccagggacaacaccacatgccaagctggaaaccagctcccctagctggaagcaggcaggaacttaaacgacggttctgagtaaattctagaaggtgtaagcttgtggtgctgaccgagcttgaaaccctctttctattcggcagggacagtgacaaatgctagatgctagagagtcattaaagacgctttagccccagacagagacttcttgatggaatcaggaaccaggagcaggaggggaagggcccagtcatcagtcgctggcagccgaatggctggatgtgggtataactacctccgtcagtgtgctgggtgccatctacctgtctcccaatggatacccaattttatttatttatcctgggaggacccccagaatctcagcaaggacttccctccccactccctcctcacatctctgcccacccaggagtaaccttggtcttagagagaaaactgagttccagtcctattgctgatgcctcagtttctccgtctgtgaaatgggctcagtgacccctgttttgtcttctggtgcaaagaaggttgtgagatagtggtggcagaactgtgggtggtgtttacccccagataacccattaactactatgggattcaagacataaaacaggcaggagccatgatctattgcctcctcttgcccttcctcccgactttagcaggggctgtggggccatgactcaacctagcagtagtgtgctattatatggtccacaggaaacaggctcagagagggcaagcaccttgctggaggccacactatacttcctacttcagtttatgtgaatatattcagaccctagaattcaggtcccaaacgctgaaggtggggtgatggcagaaatctaccagcttagcaggaagtttgtccacaatacacaaaacaatccatctggccagctaaaccgagatgtcataaagcattatcctcgaggctcagtggggggagctgcaggatgcggcaagaaagcaagagagggacaggaaggaagcaaggagggggtggggagaggatggagaatgagaccagagatactgtgtgaagacagagggtagagagagggagagagacagagagggagggcagaggaagacaagcctataatctgtgctggggctgtccagtggagtggagggcctgtggctcacagggagagcatgactcgggccttccccaaacagaggtagaggcaagtcccctgggtgctcagttgggggtggaggcaggacataagtctccaatttcctgccaaggaacactcctgaccatcaaagccaaggccatgaatgggctggaacatggcaggcaagccggcaggcaggcacagggacaggaaggttggggtgggggccagggaaatggggatggctgggctctgagcccttgctgctgacccttcaggcacagggaaagcccctccccatccttccttcctatctggtgggagcaaggtcaccctctgagagagggccactaggcctcaagtgacagctgcaagctgctaggagaccctgactgagaacttgtagctggaactgtggcttcaaacaatgggtctgtgtcccaccttcccccttagcggtgtattttgggctttacttctggggcctcagtttccatgcacggaaagtgggttgagtctttgtaaggaggttagcatttggtgtggtcctatgtgggcactcccatgctatggagaggatcacctgggtttctatgaccttaggaaaatgactccttgcctttatcccagggcctacctgttcctttgaaggtcaaaggagtccggtgcccagtgccagctcatatgtggaatgactttaggtttctcagaaccttggcctaagggcaaggtcctgggggtctgcggggtttggctctatccagaaagtaaggccctgtgtctggtgttctgctcagcccagcctgcccttgcaagaggaatgaacttcctctcaacacagtttcctacttttgctgtgggattgtcaagtttgtccccggagcctgctgcttgcaaactccctttacagagcagttcggggaacagnnnnnnnnnnnnnnnnnnnntggcggcagtgaaccgcctgtaccaactgtcgagtgccaacttgagcctggaagccgaggcgaccgtgggtcccgtgccggacagcccgctgtgtcacgccccgcagctcccgcaggcctcgtgcgagcacccgcggcgcctcacggacaactacaacaaaatcctgcagttggacccgggccagggtctggtggtcgcgtgcggctccatctaccagggtctgtgccagctgaggcgccggggcaacatctcagccctggccgtgagctttccgcctgccgcgccgaccgcagaaccggtcaccgtgttccccagcatgctcaacgtggccgccaaccaccccaacgcgtccactgtgggactggtgctgccgcctacctcgggcaccgggggcagccgtctgctcgtgggcgccacgtacaccggcttcggcagcgctttcttcccgcgcaaccgtagcctagaagaccaccgcttcgagaacacgcccgagatcgctatccgctccctggacgcgcgtggagacttggccaagctcttcaccttcgaccttaacccgtcggacgataacatcctgaagatcaagcagggcgccaaggagcagcacaagctgggcttcgtgcgtgccttcttgcacccggcggtgccaccgcacagcgcgcagccctacgcgtacctggcgctcaacagcgaggcgcgtgcgggcgacaaggacagccaggcgcgcagcctgctggcgcgcatctgcctgccccgcggcgcgggtggcgacgccaagaagctcaccgagtcctacatccaactgggcttgcagtgcgcgggcggcgcgggccgcggcgacctctacagccgcctcgtgtcggttttccccgcgcgcgagcagttcttcgctgtcttcgagaggccccagggcgccccaggtgcccgcaacgccccggccgcgctttgcgccttccgcttcgacgacgtgcaggctgccattcgtgcagcgcgcaccgcctgcttcgtggagccggcgcccgacgtggtggcggtgttggacagtgtggtgcagggcaccgggccggcctgcgagagcaagcgcaacatacaggtaagccatagacctgaggggcgtgtgcggggatacagtatgcacgcagatatcccagaggattggttactgccagcggtgctggcccgggagcgtactgggtcacaggtgcgcacacctaagtggggaggtctaggttgtcaaggtacccaggtgttccccgaagacagcgcacctacaaatcagctctgcaggtgggggccacaggtgtgtgctgaactgagagaggggagtgacaccaggagagtgtttagggagagtgcaggtgcccttaggacatacctctgcactctggcagatgtgtgatgggtgtggcacctggcactgaagataaagggcatgtgggtcggaagggctgagtatgtgacagggacacccatcggagatcccaagagtgtagacctgcagggatgtaaactcccagtgggagcccgtgccaggggacactgttatttgggaagtgattggttccctagtgaggccacctggttggcaaacaggtgtgtgctcaaggccacctcaacaaatagcaaatgagcagctagcaggtggtgtggcagacctgtgatcacaaatgctgtgggtttttaacttaagccagccattctcaacatgtgggttgtgtgtgacccctttggagccagacaaccctctcacaggggctgcattatcctgcatatcagatatttactttgtgattcataatggtagcaaaattacaattatgaagtagtaacaatgaattcattttatggttggggggtggtggtcttacccagccttagaaaggttgagaaccacagacctagtgtgtggtgtgtcaaatgtcttcagcaagtgtgttctcatccctttgtacatacagatgaagaaatgggtgtaagttttaagggatgcacaaacagctgaaaaggagcagaggtggggcttgcttgaacacaagttgtttggccccctcatgtgttcatggtgctggggctttgcggccttacagatgtggaatgggggcatccaggcagtctggccggacaaatggaagatggaaaaggagtgaatctttggtggagaactatagggctgagggtgaggcggggcctcagggtgggcagtagcaagagagccaggctaggggatccccaagtgaattggccttgggtacagccagtcccctctaagaatttcacaacagaactcattttctttcaaccccaaaatgacactgagtttacaaagggctaagcccagccttctgggctcactgaggctccctgccttgtctctctctctctgtggtcctcaggggtagcaagactataccgtgggcgtgcccaacactggggctttgagcaagcacagattccttctcttggcaaagactccctcagccgcctaccaccctgccgactgacccctcacaagaaaggtcatagcgggtgagaggcagaaggactgtctgaagtttgtggcgctgctacccagcagggtcaggccctgtgcagttctggggtgaggacagccactgttcttctctccggagccttgccatggctgtgccttggctgcatctgaaggctgagagagtaggaagagggaagctctgtgggcaagggaggcagcccttcgtgggcccctggctgatgaagggttctgtgggattcctcaggccgcttctcccctccccctccagttagatgtgtcctgattcccacggtccttggtgcccccctgggccggcacagtgactcacccagctgaaggcagctggattgtcgtcctccctatgggggcagggcctctacagggaaattagccccagggcagtgtagttaaggcctgcccctcaccccaaagccacacagtctctctgctagcgctcttctaggttcgtctgctgtgttctccccaatgcccagctgtggacacaggctagggccccctggcaggaggacctgcagcaggccacggtgcttgctgtcctttccaagctgctgctggctcccctacacgggcttgaagtccctctcttggtgcctggctaagtggccttgacggggcaacagaatcttctgaagttccctaaagctagggtaatgcacagtcgccttcccacagaggcattaggaccacaaacacagtcttcccacagaggaccaaatgagcaaggtaaccacaaaggcaaatgctcagtgcccagcgcacagcagtcattggttggttgagctgttctcacccctggggatgcagttagctcttagctgggctctaggctgtcctggaaacatgtcctcatcaggcctgctttgcagctataagacccccaccacttgcactcgcagcctcctgtgggtcccctgaacattttaccaaacccctaatgtcatgagacctctgctttccggggaccctcatgcgactccctggtttctggccttccggacaatacagagacctaaggatggactgggtctcatgtagcacgggtcagttttaggctcactgagtggtggggttaaggatatgtgccaccaaactcagtgtgtgtgtccttgagtattaaacccaggctctaggtgaatgctagagaagtgtggcaccaactgaactacatcctgtctcaaacagagtcctcttcggagcacctagggtcagggtgggcactgccacacactgtccactgccaagcacaggggctggcaattatgcgatctagaaagcccacggtggctggcaaggaggaggggcccataaggaacagcagtcaagatgctcagggtaagatatcctctgacgtctgccgtgcgttggctctgcacccctgtgctgtcaccacagggcaatgggctggacctatgtgcctccactgtggcgtgtccagcagcaggtggaaggaaaagaggtgggattaggtggggtttccttcctcacaccgcagcgtgttcagagggaaagtatgttggaccgttatatgctgttggtagagaaactgaggcagggaatgacaaggtagagctggctggatgcgattcctttctctgaatcttttgcctgtaaatgaccatgatgtgtgtgtgtgtgtgtgtgtgtgtgtgtgtgtgtgtgtgtacttaagttgcaggacagcacagcaaatgccaggtctgcttatttttttttcccatggtgtctttttatagtaatggcaggggaaaaaaaaaaacccaggcagtttttaaagcaggcgtacagtgggtggcacacagctcaggaaggtattttctacaccaatttcagggctgagatggcaggtggtggcggtggagggagagagcttccaagacaggctttaggtttgggaaaggatttgaagtcagcaccctgtgtcaaggaggcaaacagagacccttgtgggattgaggagagaggctggctgggatagcctcccctggaaagacagctgagggccacgctgacaatgtctggctcccgtgtacccagggacaaagttgacagagctctgccctgccctgcccatgtgctgtgtaatccagggccagtcagttaccctctctgtgcctcatgcgttctcattctaagtctgtgtttcctttcaaagatgtgggtcaaaaaaaaaaaaatcccatatgctgcacccaggaaatggcaggtgcaggtaccagggagagaatcggcatctgagcccagcgtgctggtgtgtggagcagacagcaggtgctcagaagagggtgggctgggcccttacagctgatgagctcacaccaggctctgagggaggcaggatgaagcagagaactatggtgagagtgtgggcaggccctatccccacaggagctcagtggggcacgcagactgaaagctagccaggccagtgcctgctgtgcaccaactctgggaggttggggcaaccgaggaagctgaggcctctcagttgtttgtttgttcgtttgttttgtggggtgtgttgggcagccccagaacctgctgcctactgctggaggggtgcttgccactgtcttgttctgtctacccacactcggtcctcacacagtgaggcttacagtgggggaaactgagagaaacccagacagggcaagggacttgcccagggtcatacagctaccctgtgggttccaggtcaccagagtgcgggctgattgtggcctccctgtgaccagccttcactgaaggatggcttggccagctgagagctctgggctcggggtgtctaggttctcccatgactgtaatgaggtcatttgggcaattccctggtgggggctgggcaccacagctcctgagagatagatgggtggggtgaagccactgggcatgtgcagaagggccgggtgctcaagtctcctgggcacagaagaggcctgagagcatctggctgtacttccctctgaaaatgcagcctcttagccaggtgcgaccccagcacttaggaggccgaaacaggagggctgtcagttagacgccagcctgaactgtgtagggaaaccttgtcccacaccaaaaccaaaagtaaaggaacaagaacatcccttctctggaaaggggtgagggccccagctcctgggagtatggaaatgcagttatcagacagtaggagcgcagactaggcaggttccttttgttttttccagtggggtcctgagttacttgtgttgaggtcggagtggagagacttctcagggaagtgcagatggatttcatggcccaggacacaggcacagtagagaacgtttctatttggcaggctgggtagccttgttcatgaagtttagggggcaagtatggggttcaagttctggtggctgctgcgggatctggggatctgatctgagccagaccatgtcttgacagagtccctcattcagccacccaaactgcaaatgtccctttgtaattaatgaggtgccttgagagtttgtcctgtgccagacatttgcaaagcaccttagagcccagctctccttgcccaaaacagtaagatggcgtttatctacatctacattgatgcacacgcttggagaagccacagctcagtgtcccgagttggcctctgtcactcaaagacagggtttctcattgaaccaggggcttatttcctagactggctgacagtgagctccaagtattctcctgcctcagcctcccagttttgagattataggttcaagcagccagacccagcttttcacgtggcgctgggatctgaacccagagccttgtacttgtgcactgagcactttaaaaaaaatgaatccattttaaaggtgggaaaacggagcctaagaatggcctaagatggcaggcagtgagtgctcccagaattgtttcagtctagcgtgagaacctttcagccactcccagatgtggggcttctgcccttcccctgggctgccatcttctgtggtttgtcatgtcctgcatcttaattcctaggggcatcccttagggaggggactaggcctgttgcatagcccaaagagagaaggtatagaccctgccccagtatcccagaatcccagaaaactcgggacctgtgctgagcctcatccaataggagggctccctggaggtggtggctctgggcagcacctggaggatggctagacagggaaggaaggaatcatggcagggacaaggtggtggctgacttagccagcagggctgagactgagaacatagagtcctgtctgtggaccaagttcttagataccattctgccggtcctgaggagccagtgtggcctgagaggctgaggacgcatggctcatttggctctggaaaagtccgagctgctaccagttgctggctagtttcccctgtgatggctgcaccaggtgattcccaaggcctttccagctcctgacaatggtgtgagcattgccatggaaaccagctgtccctgagtggggacaatcccaagagtgtctcggagcgccagaacaggaaccaagctaccccagaacatagcttcctcttgtcaaagtccatgttggggccacccaggtgggcatctggtggccccactgaagtagcttcctctggtgctgacacgtgatgtcaccaagctcccaggcagccaggcctttgctctcccaatgcactgtcctcagctccaaaccccataaatcacataagatggaggatggatggaggaaggaagcctgcggctctagtccaaggcctgtgcagccccagagggccgatcacagcagcactttaggctcaatcagtaaataacagaactgcaggtagtaaccttgagtggaagcctcgggctggagccatgctgggcgctggctagctgcccgaatgggtcatctcagccctgtttgcctgctgtgttatgatgcagcaggcctcagtttctccacctggcttttgagggcttgctagcaccaagtggctgtgatggtggcagccgttgggagccacagactgcagaaccagctgacctgcctggagcctcggaagccccaagtgtgtcagtacccaagggactggggactacagaaggccagagaggaggaaggctgcgctgtagaggaggtgtgagactcaggctgttcctagccctcaagggaccggtagtggccagctccggagacacagctggtcccctgcagtgaggaagaagcagaaagccatcttgctggaggaggcctgcctactggagctagctggggggcagggccttgggctggggagaaacacagtgctgcttatactacaccacactgtgttcctgggggacaagttgggggggggcggggaggatgctggggactgggccaggccagggaatgagaaacagcctggagaagggggagctgggtgcctggctggctgtggtcagctagccaaacaaccaccgtctgagtaagctctgcggggtccaggcagcagccgctcaggccaccaaacccggactgtgcaggatgctaagaaactcacgcagacacctggctgctgttggtacccagcggtcagctggcagggcttctccattcttgggcaccctgactctgccgatgcccccaaagccacctgggaacatttactgagcagctgtgagcttagcacctctagtagtcctgtgtggcaggtgctgttaccgtcccagcctcacagataaggaagccagccaagggctgggctgtgttgtgtgtcttaaggaaggccctgcctgcctctgtgctaggcagctcctggaggtatcgtgatggccttgggaggtgcatgggctcctgggcaggaacagtttcctccgagagaaccttccagaactgaggctgtcatctcgtcccctggccagagctaatacatagtaggttttaaggaatctttgtgcctcggtttaccctcaagtgagacattgcgtccgtggagctgccatgtcccaaagggcagcctgtgctgaagctgggagtggggctttaaggctggatttcttagaggtgaagttctgcttctgatctcatatctgtgcaggctccagacaatttcttttattcctgagacaaatattaatgccaagggcagagagccccaagcggctgggctctgcaggaagctgctgcctgccgaggtcgccctttctcctgggcctgccacccccacgtcctcaggagaaccctgccccatccagcctggatccctgtccttatccttctgcagagatcagggcttgggagtctaggaggtgtgactccgcgtggggcagagatgagggaggagttgcccagaacacagatctcagaccagccacaggtcagggtcgctttgagcgagcccttgatggcttatgttcatactgacggaatgctgttgaactgcagagaggtcatggtctgctctgcagctgtgtgcgaatgtgttttaataagcatcatatttgaatgactttcaacttacaggactgtaagttatgaaggctggaagggtaatctttccctgtgtccctctccccaagtcctctttgctagcattccacactaccacaataccacacagtattgggccccctccgaccctcagctaagctgcagaggctcccagtgggatggggtgtggctctcacagagcccctgtctaacagagcagtagaggagaaaccctcccattggctgctgtcagggtcgttaagaggggagtctggacatctcagtcgcctctgtcatcccacagtcagctatgtgacacttctgagcagttgtgagccttccgttctgggcctcagacaggaaggtgtccctaggccagggacagctgcacagtagtaggcacctgggatggaacctggagactacggctgccgtgtctcatcctcctctgagtgcctgctgcggagctgtagaggtctggcagggtctgtgggaaggctatggcgggcatactgtaagccctcctggagctggcttcctgggagagaagagctgtattcagctgcaattactgaaggagtgaaatcaatagggcagccctttaatggagagtgggcagcactgagcttggccccaggaggcagctggctcaacagggaggggctgcatgctctcaaggaagagctgaaatcagtggccattacctactccatttcagagagggacaaactgaggctcttacaggaaacagagctagctgctagatttcgtgctgccccaaacacctgcctgccctgtgctacccacacaataggcaggccatgaacctcccttgctttgccggctcgccttggctgaattgcctttcatcactgcttagaaaggaagcggctggatgggatgtttacaccttagtcaaaattaatttcccttctttagtaagtattcacccatgagctctccagagggacccgtcatgcgcctaatacacccgaataaagagaagtgctggccgttacagtattgtctacacacacacacacacacacacacacacacacacacacacacacacacacagaatgagaatgtgtctgcacacacctatgggatggatgttcacatgcatgtggaggacagagaaccttgggtgtcgtcctcacgggctttccaaagtgggccaggctcgctggccagtgagctgcaaggatctgcctgccaccgccaccctacctcctgagttctgggagtccaagcctctgccaccaaacacaattgttttttgtttgctttaatcatggtttctggggattaatctcaggtccttatgccttcagagcaagctcttgtccaacagagccatcttctcctccctgggcttgtctttttaagagtctcatattgattgactagagccttgcaggctgggttacctggagaggaggcatggtggagctgggcctaagggcccagacactggctgctaagggcagggccagtagcgggctgtgggacatgggtggggatgtttcaagaactgcggagaaatggcgtggttggccttaagtgtgggtaatgggcagaatggaggggagccctgagcattcggtggggtgaaatcctcgcacacagcgaggacactgcagctgtatcatgtggacggtgtcatagggacggtggcgtgctctgtcccattgagctaggaataggctggggttgtgtgggccacttcagtgaatgaggtgctaggggagaaattccaggctgtggggcccatggccctgatcaccaagttctgcaaggccaccctcagggcctctgtgggtgtcccagccctactcctgcaggagccacttgtagtctgagggtttctggcccaggcaggcagcttccctccacatagatcattccagcccctgttgctcacttctcctttaaaaaaaaaaaaaaagctttttttttttttttttttttttagattttatttttaggataagagaaagagagaaaaaaaaaaggttgggggaaaggctttttcgaaaattccttcggcacagaattaatggcttgtgaacgtcagggcaggctgcgggagtcagttcccagcctttccacagcctcccctctcacggcggcccacaaatcactcccagcccagcaatggctctgcctttcccaggacccacactctggctggacagccaggcagggctcagcgaagcacccagagccgactctgggggtctctcggagctcatctcccaccacagggatttacaatattttaatttaaaaagcaacttatttaatgacaaaagtaagtaatctgtattcagcgaaagttatgtaagttgtgggagaccattggtctcagtgggacaggacagctgtagcccttgtgctgctccgggacagctggggaggagccccagcctgggggtcatctcagctcacgtaagtccaggacaaaggcaagtgggttggggctgaagctcgctcaggtcaggagtcagagtgcacagtgactctgtttgcagtctcacttactctcggtcagccaaggtctaagggtattaatggaaaattccagaaataaacaattcatgatcttgaaattgcttgctgtgctgagtaccacggagaaatcttgtgttgtccatccctaccctgcctctgagtctgggctctgtccagcgtttccaccctgcctaagctacccacctggtagctgcttagtagtcatggttcctgatagcctgtccccaaatgccagagcttggtttgcatggtccttacttttcttaaagtgcaaatgtacggtggtggcaatttgatacatctcggaaagccatgacgtgcctgccttgggagaaggggtggaaattcttgctgccgaggtctgtggtgcaagattgtgagccagagcccacacttactgtgctccattgcggtgttcctcgattgtcccactattgcctcccttacagagacgactaataaactctcattgggagagactatgggaccaaactgagtatataggatttggtccttgtgttttctgacattccccagaggccttgggatgtgttcctgtcaggcgctgctgtgcaggaacctgatagacagggacaggagcagagacagtggccctgaggcaggaccggcgtgtgaggcacagatacaggttagatggtggcatgaagacctgagagagctgagctgagggctggggtcagagaagccccattgtggtggccacaagcttcagagtaggcagcttctgtgtgcggggcaaatattctgccatcgaacttatcccagcatctcagactccacccatgtaggagcgtgtgtctgggggtcagaggacaactttcaggagtctggtctggagttctactttgaggaagtggctttcttgttgctcatgtgaagttgggatgagtctcctgtctctgtctaccatctctccataagagtcctggggttaagaggtgacacactcaggtcattaggcctgtgtgacaagcacccacccgtacccctgcaccatctcattagccacccccccccatcccattcacctttcttttttttttctttcaatttttggtttttatttttaatttttttatttaagttaatttcatacaaaatattttgatcctattcttttccctcccacattcctcccagatcctcccaatctctctacccacccgggtcttctctctcactagcttggaactcaccaaacatccatgatggttggctagtagttcccagggaaccacctgtctgcccctgcagcactgggatcccacgagtgcaacactgtatctggctttcaaactctgtgtcatcacgcttgtgtagcaaatactttacagactgagccattccacagccttcacatccattccgttattggattagcaccagtcatagctgacagccagtggtacctgcttaagtctgacccagcaccagctgaagaccttgacctctgcaaactcagtccaccactgatcttgtctcaactcccaaaggggaagtatgtgcacacgcccattttatagctgagtaaagtgaggctcagaaaagcaaagtaacatgccagggtcagccatagcaaccctcaaggacacaatttacccatgggttttagaccagggcacttcagccccaatccatagctgtgtgtgtgtggggggggggcggggcgggcgggctggcctactccaaaattgtcccaagaaacctagggaatgggaagagatgctagaactgtgggggaaacacagtggagatggaagggacgcctcttgggtgtcacttcagtagtgaactaaggcaaggatgacctcagtgaccagatatgggctcttctggcctctctgctgtgtgtggccaggaggaatgctgtggccaggtatgtggctgtgccgtaatgctcaggctgggctgaaattcccagggtcagggaagtctcctgcctcagcttccccagtgtctgggactgcaagtaatgtacccctgtacctttggtcacttaaaaggtccagtttaagaccagtcttgccagcttgtcttgcctccctccctcccttccccacccccagtctattccccacatatcttaaacaccagccatctcctacgagtagctgtgtcacccaaggtcaaggctagacctgggtagcatctggggatctatttaaccgggcctctgtttgtgtcaagcagggtctgagagctggggtctgcctgtgtgaacaagcagggagccagagaaggttccagagctgagtctaacctgcctgtcttcacagctgcagccggagcaactggattgcggagcggcccacctgcagcacccactgaccatcctgcagccgctgagggcatcgcccgtgttccgtgctccagggctcacggccgtggctgtggccagtgccaacaactacacggccgtctttctgggcaccgccacagggaggctcctcaaggtaagggtgctccacgggagctccctgggaagggccacagagggccagagtccccctgctttcttcagttttccctctgggcctccacagcggcctgtcaaggagggaggaactgacctgagcgatgtctgcacattgtctgctttcagcatctcctagcctggggcctgctgcctgccctgccgcatcttgacctttgcagtgcacaggctccccctgggcctctgtttctctactggctgcagttgttgggagacaacagagctgctggccaccccttcaggggtccactttctggattaaccatgaggccttgcaagttccagagctaagggagggcaaggagctgcttttcctacctgagagccgactggacacccctgctcgccgcctctccacctctctgtcagacttgcagccaggcccagcctaattgattcagagtccataatctaattccctttggcagctgcctgggtgggatggggttggggcttgggcctcacaggcctagaaccacctgtggtgaccagggagaaggcagggccccggttactcagccttgacccacccgggctcagctttggtggccagatgtgtagcttctgcttttaactgttactactcgctgtgtgacctaaggacatagcttatctcctctggactccgggctctccatccattgaggaggaatgagacagagcaggactgtggtcagagccctctcccgcttctacccacaaaactgcagtcattaggcacctgctgtttaccctgtgcctcagggtacttcacaggcaccgcgtcctttagctctaacgtcgagccaaggattctattccacagaaacaggccgctgaggtccttcaacaaagtgactagagatagctagagatggggtcgttgctttttcatttttaattgatttctatgtgccatgcttgggatgggatacagagcctcagctgggcccccaggactcagtgaacactgaggaagtggaaatgagttggctgtctgtttggtgtctagggtaggcgggcatggtgtgagccacggccaaggccctcccagcatcccaagaggcttcctggtaacatctcagaggcctagcccgagcctggggggacctggggagggcacagtgttgacctggcacactccagaataaaaagggtagagggctgtcgggaaggcgtgtggcaaaggtgaggcaggcctgactaggcaaggtgtatgatgtgtaacagtggaagcaaagtgggaatgaggagggggtgtggctaggggtgtggctaggaggtgtggctaggtggatcctcaagccatcaaatgccacagccagtttctttctgcagggaacctctgcaggttttagaaacccagagaaaggtgagtgggaggccccataggtgtccagactgcagtagcgtcttggagccttgagcacccagcctgtgaggatgaaaggggacacagacagcggggctttgccagtccctggagaaccatgcagaggggcctgggacctcgcccaggactctgcttgtcttatctcctgtatccccacagccccgtggaacgatggccatcctgactcttattcactggggaaactgaggctcagggagggaaaccaactcatttggattatagtgcatgtcagaaatagaattcaagccttgctattagccatgacaaccagcagcctcccagagaatggtttgggaactacagcccacacatacctgggggagatgttggagtctagcaggacgggagtccctgatgggggcgctgttgagtcagtgagaatggcgcatgcgcactccacttaggagccccccctttccctttcaccctggaacatctgagcaggaggggagaggagactccaaccctgggaaagcctgacctcgtgggtggcagtccccggcaccagtaggtgatggcctttccttccacagatcagcctgaacgagagcatgcaggtagtaagcaggcgagtgctgactgtagcctatggggagcctgtgcatcacgtcatgcagtttgaccccatggatcctggttacctatacctgatgacatcccaccaggtgaggaaccatagccagccagctttggtgccaggcctttgcgcatgctgaccctcctgtcggggacacctccttccccacctccatctttgcccacacgctgcttcaaagaggctatatttcccccacgtaccctctactaatacctccagagttagctaccctagcctcacgagggagaggtggctcccttgctcagctgggccccctctgcctacagatggcccgagtgaaggtggcagcgtgtgaggtacactccacctgcggggactgcgtgggtgcggccgatgcctactgtggttggtgcactctggagacccggtgaggcccctcagccgacggcagggcagggagggctgtaggggcggtggccgtggcctaggacctgaccccacggtgcctgcaggtgcacactccagcaggattgcaccaactccagccagccacatttctggaccagtgccagtgagggccccagccgctgccctgccatgacagtactgccctcggagattgatgtgcaccgggactacacagtgagtggagccacaccagcctaaagcccacgggcacaaccagcggcagccaggctttaggaagctcacagcaagggccaggcaccatctccggctgggccacctcttcaaggttctgccttggcctcttgcaagacctagtcaacagttaggaccatgcaacctgagtacatagcagtgcacagggccactgctggcgtttaaatggcagtttctgaatatgctgacttgggacacccagatagaaaattaacccttcttgtcttcttccgggagtgttagtggccatcacttatccctgatatgggacagacagggctggtggctagttcatgcctgcagcaaggtgggtggcccaacagctagggccctcccagcccctcctcactgactcctctaaggacagggccatcctatgtcaccccaaggggttccagtggtccaactggtctactccaccaggtcacatgtcagtcctgccctggcctcatccctgggcagcctgggataggcacagtcactcatccccttgtccattcacattgtactgagcacttactgggtgccgtgtgagtacatactctggggaccaacccttggcctgggaggagctgaagtgctcttgaagggagagaataggacaggtaaaatatagaggtgggattgcatgcagaatagagtcaggtggggcacaatggtaggcaagaaaacggtgcccaccagccttgctctgggagagggtgtggagtatgaggaagatagcttcatagcaaactacagtccaggggccctaaggtgggagtgaggtccacgtgtctggggttggagagtgggggcctagcaagcgtgtgctgcagaggccttctgttttgagataccatagcccagtccagccttgtacttgtagcaatcctcctgccccagcttcccaagtgctgggattgcaagctgtgtcgcaacgcctggttgacagagcctgtgtgacctctgagatgaggagcctcaagtggaaacactaaagccccagggtgtcgtccgagtagagagccttggcttccctcgagacaaaccgttgtgttttttgttttgttttgtttttttcggagagacactcaggcaggatcagacagatgctctgcgataggatctgtaaggggcacaacctgggcctcacctgagggcatctctcccccagggtatgatcttacagatctcaggaagcctgcccagcctcagcggcatggagatggcttgtgactatggaaatggcgttcgaacggtggcccgggtacctggccctgcctatgatcatcagattgcctactgcaatctcctgcccagggcccagtttccatcctttcctgctggccagggtgagtgcctggctgtgatgccagcccaagggtgggaccctgccagcatcacctgtggatgacgacatttgtatctctgattactttccagaccacgtgaccgttgagatgtctgtaagggtcaaaggacacaacattgtctcagccaatttcaccatctacgactgcagccgaattggacaagtctacccccatacagcgtaagtgggcagcgggagggggaacaggccccacacaacttggagaacagcttcagaccctggaacacacaacagacgggatgcagtacacacaacagacaggatcccatacctttcccttgcatgtagcaagctttgaccagccaggccctgcaaactgacaccagactggcagaggcagactaaaagagtctacctgtttctcccttgcatacctctcattagtggaaagctcactaccaagcaagatggcccatctgccccctttctccaaggcactagggtcatcctttctgagggaccccttgtcttccagctgtaccagctgcctgtccacacagtggccttgctcctggtgcatccagctgcattcatgtgtctccaaccagtctcagtgccaggactcgccaaaccccacggtaagtcttgtcttgggtctaccccacccacggctttagtacccacttctcttgattttaaagttaccatagtcctggcattgcactaacagcccggggtggggtggggcaggggactgactcatcactgcgtgttcagccagtccctgtggctgggcaagctggtggccttttttcctcccctgcccttgaatctctctgggtaactactccaggaaagctggttcttagaggcgacacttcagggctacagtgtgaccttctggaaagtccgagccaggctgaagctgtgcccttcatccacagcagatactaagggtggaacattgtcatcccctgtttacggtttctcagacacttcaatcttttgtccctatggctgtaagaggaggtggcttattcaagaccacctacctgggaggccttgaacccaaatccctctgcctttctttgaaatatagagttaggtactaagacccatggctctgttcccatggtatgtcaccttcaccctggaaggctcctccctctttcaggggtcacacgtgaaattcccagaccttagcaggggagtagcggtgcctcgagcttagacatacctccccttgctttatgtcagggctgtgcaccctgggaggggctgccacagcctcagccggaccctcaggccagccttcagcagcatgcagaaaccacacccagctcacagagtgcacacagaacagggcttctcactgacaggcccaggagtggcctatggtcatactgagagacgctctgggtgttgggatatggttagtctaggcccattatccctgtggctctggggttggggggcatcctagttatgacatgtccttacctacaaccctaagctgcatacacagcagggacttggtggctgctgaagaccagaagtatccattgcatctgcctggtacatgccaaccctgaaggaccaggggcccaccttacaatccaccagcgctcactgagtgctgcttgtatactgaagtctgtgctaagcactggggaaaagccaattagatgtagttctgtctttcctaccacaggctcaaagccttagctctgacctgtggctgtgtgatcccaggcaagctgctgaccctttctgtgtctttctccctctgtaaagtgaggcccacagcaagggctaaattagatatctggaattactccaggaggcaccagccctatacttggcacctagatgattttagaatctgtggctactgtgcatgggtgcccagcagagacatctcctaaaaggattttgtgtgggtcttgacacctgcataggagctcagcagctgggaggtgtgtctgatgctggcagtcggcttgttctccaggtctgcagctctccctcagggcaggagtgggccagccccagaggggctgtcggagagcattactgtaatctggcaggagaagaggcagcttcaccaaggcctgtgcaagggtctgaaccagtgctcgacttggcatttaattaagtgccagttagctgtggaggcgccaggcctcccaggcagacggcaggcaagagggtctgcatatcctccgggacccctggctcctggaaagggggccctgaaggttgtgcttgcagccacgtgcacgtggtcccagtggctcccacggggaggctgctagggttggctccggggttgggatgagaagaggcaggaaggtgccaggtgttccggggccagtgttgcctctcagagcctagtgctcccagggcaacatgatgtcaagctctggaagcaggatgggaagcggtagctggatcagagcctggtgtgttccaaaccacagggcggcacagtgctggagccagtggctgagtggcttgatgggtattgacagccatcacagactgcgggctggaccacagcaagtggcagcaggccaggaggccctggtcactgggtctattgatgcttgttggctggcttgggatgccagcgcttgccctcttgagcttggagacactgtaggagtctgggcactcctgcagctccatctttccaggagcacgtttgggatcctagccacctagcattgcgccctggcagttccagctaggcgaggagagatctgtgccaacctgtgtgaaccagagcaggctctgtgcacacctgcacgatggtagccgctgacctctccccgtctcctgtgcactcatccctgtcctacgtgtaaccatacacagcttcccgagcctgcaggtcaggtcggcaaatgggaaaagccgtctgatggcctgggtggaaacaggaaagggaaccctgtaagggaaaagcccagactggctctggccatggagttaatcagctaatgcctgtgaacagtcaccttcaggcaccgctggatccaggagctcaacggtggtgtaaggggtttctcaatagactcttcgctggtctagcttggtcagtgttccccttaaggggaatgtcccctgtgttattaggaaaggaactagtagtaacatgaaatatcccatgactacctatctgtaatgtcagcaccagggaggctgaagcaggaaatggcaaatttgaggtcagcttggcccctgtggcaagcacatagcgggaggaagctagagaggctgatgggagtggcagcccgcatgtgggaccctagtacttgaggccagcctgtctgagcaacatactgagacgctgtctccaaagggagagggcaaaagggaggacagaggaaaaccagtaccccaggagatgtgtccttgtcccagagggtgacctcatatacacacaggtgtcctagcactaattcttgccttgacagatgtgaccaagagacccctggctagagtagccttggggtatggggtccctgtgacgtctcgcccctgtaggtcagatatcgaggtggcaataggtagaacttcaaagccccagcactgatatttccccagtatcctgctgaggaatgtggagagaacatagccacaccctcaccttctctgcccctcccctgtacagtttcctctgtacagtgcggtatggtctctgagagcctcagaggcaatttttaacccaggtctggcctagtgttagtgtcctgcaaggttgaatcccaaagaacccagccacggaagcgcttacctctgcgcagtttctaggcactctgggtctaaggagcagatccaggaggaagactctgcctagatggaacatgttatctgtctccttatctagaaagtggggctgcaggcattgctatggagactgttggcaccctggggaggcacgactgtctggtgggggtggaggctctgaaacatcctatttgatccccatcctgtgtttggtttgcagagtcctcaggactgtccccagatcctgccctcgcccctagcgcccgtgcccacaggtggctcccaagacatcctggtgcccctgactaaagccaccttcttccatgtaagtagaggctgagcagggtctttgtgggtttcaggctatcccagcgcccataatggtggcccagcttttttctctgagccccattccagctgtgtaagacttggagcaggcaagcaaggctgatgggggacagcaggcagccagcagctgccaagggaaccctggcccaggccccagtactcctaccctggaggctccctgacatagtggctcagccccctgcctagtgccacagtccacgggtagatgaggtccacatgggctctgcccgccctgcccaggctgagcaagaccctgggtgctccaagctctgtggaacatactggcccagttcaaggctcccatgtctttcccagagatggccagaagaggccatgcccctaattctcatggtctagaggggacactgatggaggaagtgttctgggttaggggatgtggccatctctgccgcacccccaccccaggaggagtgtgtactgggggggggggttgatgagttttggaaggatgccagctctcctaattcctgggacgtgccatctgtcactgccactcgggagttgaggcccgtaacggttgtcacacgtgggggccacgtgccaggcatctgggatgtgtcagggagcctctatagggtaggggctcttgagagccaggttagagctgccttccaacaaaaagcctcccctgccaaggcctggtgggccacaggagcagggtggggaggccctagcccccaatttggccctggctgattctctccagctgtgtggcactcttggtgcattctctgcttttggcagacacaggaatcccgccctccttgctacctgatccctggtgctatccacccacttgcctcaccctgaccatgtttctaaatcaccggggggtcaggactggggcctggacactaggcagccctgctacaggctgttctgccatgtgctagggaggggacccacctgcagctccgcacactgggaacagaaccagcatttggcctgtcagcagcctctttcctgtgttagcttccggctaggaccccaggaaggagaggttgacctgcttttttttcctcagggtgttacatctgccaacagcaggggcataaacaggaagtaatggcgcacggctgctagggccttggtctgtctgacacatgagacccaagtttatcactcagtaaatatttatggatatgactcttgagggagcaagaggagactgaggagttaggcccagcttaacgtgttaacatttattgagcacttcctgcaagcacacattagacacctgtgcatggaagcctctaaaacctaggatgctttgcccagaagacctgtttatattcacatgcttgcatgaggccacacagtggacgagtaaaggtgggatttaaagctaggcctatgtgaggttgaacccaagcttcccaccaacttttactgctcttaggggtatagaaagggatggcaggcagctaggaccttcaccaatgggcgaagagaaaggtgcaaacagcctaagacagccaacaggacattttgctggacagggcaggctttgggagtagaacaggtcccacagctcatccctttgctgctggggcaggatggggtatgaggtatcctgatccaagggggccttggggtcccaggggctctgcagctgggtttggacactgtggtgagtctcactggtgctaaaaaggagaccggcccaggcagaggcctggtacgtgccatacagggatgcctagggtttacctctgcagggcagaggccaggaactcagcccaaggatcaggcaaagtctcctggagctggggcattaggaagtggtttaagtcactggtggggtctcagatgcctcttagatgacagccatcattccaaatacagagggtcctcacggcccaggcactggggagagtcaggactacccatagcacagttgtggacacaggatggcgcggtaagcctaaggagagacaactctagagtcagcatccatagggtcatagccagttcctacctatgctgccagtgtccccagtatctttacagtccctggcatgatggccaggaaggagattctggcagcaaaagcctggtggagtccctagcccccctgtcaatgtagaggctgcctctgtgttctgacacaggtatgggggatgggttctaagaaggctcctctgtcctgtgtctgcagggttcctccctcgagtgcagctttgggctggaagagagctttgaggctgtatgggcgaataactcactggtccgctgcaaccaagtggtggtaagtggtaaggcccagcagggcaggagaaacccattcggcctccttcctctcaccctgcctgcttctgccttttgcttctacccccgtcccccccccccccgcacccctgctctcatccatcttggtgacacccttgcccctgcaagagacaggccccacccacccttgcccttcctcattttgcagctgcacacaacccagaagagccaggtatttccactgagtctgaagctgaaggggccgccagaccgattcctagacagccctaaccccatgacaggtgagtgtcccgtctatcccacaggccaggaggtagggcccagccctggcagccacaagcaccatatcccataggtggccagcactcactgagacagccttacaccaatgaccgttgtaaccccccagaaccttacttccctctctgagccctcttgtccccgaattaagtgaggtcacaagcctttactgcaagattcgccaggactcagtgagccgatccctataaatcgtgtccataaaatgggggagtcagtaattcctccacacggggtccctccccatgagaaggactgttgatgaggctggggcctggacacagggcagcataggtaggagctggccatgaaccttatggctgccaaccccagagtcgtctcacctcaggctcaccgtgctgtcctttgtccacagttgtggtctacaactgtgctatgggcagccctgactgttcccagtgcctgggccgtgaggacctgggtcacctctgtgtttggaatgatggctgttcgtctaagagggcccctgcagccactccctggcacctgcccagcccctgaaatccgagcggtaagcacacaacacgccaggcacacacaacattcctggctcataggttacctcccgtggctaatgtcttagtggggcacagacactgggaggtggaagtagaggaagctaggctttgatccattgatatttcacagccacccaggaaacctctgaccgggtgacagttgaggatttcagcagctcagcagcctgatttggttagggggaaaaaaaatcttaggggaggattttgattggcttagcatgggtcaagtacccacccttagcccagtcagcttctggcttagatgctgaatcaggcatagccatcaggaaccacgtggcatcatcagccttgggacccatgcagcccagccacctgttgccccaggcctctgctaagcagagggtctgtgtggccccacctcctgtgggcacacatgacagtgagagagacacccaggcttcagaccttcccttgccttgccccccatcgcccctggcagattgagcctctgagtggccccttggacggtgggactttgctgaccatccgtggcaggaacttgggccgtcggctcagtgatgtggcacatggtgtgtggattggcagtgtggcctgtgaacccctggctgacagatacaccgtttcagaggagtgagtgtcaggcattgccaacctaatccttccccccagccctgtccctcacccaacagggcacactgctgtgcctgggcctttctattgtctctgcctgggccactcctttatcctgccagctctctgctgcctcctcagagaagccctcggggctctgcctcctgccacataagcagagctttgatgagaaccactttgctactagtaaagtttggaggggggaggggctggcggggtataaaggtcagggtgcaacagctgccccaacaggggatgtctgcaagaaggtaattagctgggcttcctgttggaaggctctgggccaggcttgcagataagggcatcaggtggacagccaggctagctgggcaagctgcctggtatcagagaccatctgagccttgtctcagagccactgatctggaggaaacagcagaagtggtgtgcctctcttggccaaacctacggtgaccatctacggagaacattgttggttcggcattatggccccagtgggaatgggaggcagaggccatgggcagatactatttggcactggttcaccttctgcccatttgcctgccccaccttcaggatcgtgtgtgccacagggcctgccgcaggggccttctcagacgtggtaacggtgaacgtctccaaagaaggcaggtctcgggaacagttctcctatgtggtaagtaggccaccacctctcaccacccagctcattccccacaagcctgcagccagagcccaatccctttccttctccccagctgcccacggtccactcactggagccttccatgggcccaaaggccgggggtacaaggatcaccattcacggcagtgacctcaacgtgggctctatgctccaggtcctggtgaatgacacggacccctgcacagatcttacgtaagctttccccacagcctgtcagctaagcatgccttgctctgtcccttcttggcttggggtggatctgggaaggaaggagctggacgtagcccaagccagcgcgtggcagtgggaaggagaaactgtttagaatgaggaaacacaaggctgagggacctgcagtgggtgaacaacagggaagggccacaccctgtcacctgttcatcaccccccccaaacaggcgcacagccaccagcatcacctgcactgtgccagggggtaccctgccctctccagtgcctgtgtgtgtgcgcttcgagagccggggctgcgtgcacggaaacctcaccttctggtacatgcagaacccagtcatcacagccatcagcccaggccgcagccctgtcaggtgagagccagagccacccctgcccaccctgcctccctgtccaggctgcagggagcctgacaggtcctgatattccctcagtggcggcaggaccatcactgtggctggcgaacgcttccacatggtgcagaatgtatcaatggctgtacaccacattggccgggagcccacggtaaggagacagggtaggtgtgggtgtgggtgtgtgtgggggggctttggaggtgagatggtcctatgcagccagggtcctgaagtctctgcctgtctactccacttgccttctccatctctctcttcgttacccactcccttcacttctccactcccgtggcctcatcgtaccctgcctgtccgtgcagttctgcaaggttctcaactccacactcatcacctgcccatctcctggagccctgagcaatgcttcggcgcctgtagacttcttcatcaatggccgggcatatgcagacgaggcagccgaggagctgctggaccctgcagaggcacagaggggcagccggttccgcctagactacctccccaacccacagttctccacagccaagagggagaagtggatcaaacatcacccaggagagccgctcaccctcgtcatccatgtgagcacccgactgggagcacgggtagtgggaggaggaggcagctgacctgggaaccccacccgcatcccaccatcccatctgcacgcacagaaggagcaagacagcctggggctggagagccatgagtaccacatcaagattggccaggtgtcctgcgacatccagatcatctcagacagagtcatccactgctcagtcaatgagtcgctgggcacggctgaaggacagctgcccatcacagtgagtgggcagggctctgggggtgggcccggcttctgggtacagaaatcgctgagtcatcattcaataacgctggtcaggaaagtagagcttcatatccttgacagatggagaaactgatgcccaagtcattggttagtgccagctgctattacacaattggctcccatgtgttttggtgtcccacctacagtgaggcctgctagtcattgtgtagaatgatggagtagagcagaggcagcccagagggcagggcccccactgagttacccctcacctgctctaggacagcatctctgaagcccttcctaggcggtcattaccacatacaggtcattacctgtactgagttggcctctgcaccaaactctggatcacagtctgtctggcactgcctggttgaccaggagtccctgtggtcgactgttgtctgtgaggctcagagcacacaacagtaagaagagctgagacattgctctagcaaagcatgatgtgctgccccctaacccccactgtgcgcagatccaggtggggaacttcaaccagaccatcgccacactgcaactggggggcagcgagacggccattgtggtgtccatcgtcatctgcagtgtcctgttgctgctgtctgtggttggtaggtagcctgcgctagggagagtcgggaggccatacctgaatccctctgagagtggcagtgggtaaggggtggacatggttaggcaccctggggtgggacaggtagaaggtggcagatattggtaggatcctctgtgctcgggccattggctttggatgtgaggcagacgaatttgggagctactaaagaagtttgtccaggggaaatgatcctgtgtgtctaatatactcaatgtggcataaagatcagagccccccctacagtgctggggggggggcaaaggtacacttgcctccggaaatggcctgtcatttcctaaaagcccttaggttaggtatagatggctcagtaaatctacacctgggtatctacccaagagaaagaaaacacgtccacataaaatttttttcacagaggtttgtagcaatattacctacattaaccaagaggtcacaatagcccaatggccatcaaatgataagtgggtaatttgggtatggtatagccatacaatgatgttttcagccacagaaaatagtgaatttccaaaagatcccacaatctagatgggctttgaaaacatggaatatgaaagagatagacacaaaaaagatgcccaactgtttttatttgaagtttacagaataggcaaagccatagagacaaacccattagtggtcgtctgggtgagggagggaatgggaacaactgcctactgggtaaggctctcccttggaccataagaacagtctaaagttctgtgctgctggtcacatggtgtgtgagtgaactcagacacctggcctgtaaatggatgggctctacagtgtgtgcatttgggggccagaggtgtcactcctcagtgtctgtcacctgttttttgagacaggatcttgcactgggacctggagctcaccgattttatctaggcttgccggccagcaagctccaggcagctacctttctgtcttgccagcactcacattacaggctcgtgccaccatgccctgcttcttatgagtcctggggacctccaggtcctcacatgtgcaggagtgctcccttgctcccatgtcttgttttaacttaaattactatgttcaatataaaaaagctatgagagagaaaataggaggaagaggaacaccctggatgtttgttcctaaaaatactactacatagatatcatatatatgtatgtatatatgtgtatatgtgtatatatatggtgtatattatagaatacacacacacatatgtgtgtatatgtatatacatacatacatgtacacacacatatcaatggatgctacatccctgccaagaaaggcaggtactatatactgcctttgaaaagtttaactcacaaactacatcagggcagaagaagcaagttacccataatttgtctacccagagaaagcccccaatgagtgctgcttgacacatttctctttctaagagacatcagggttgtcctgctagctggtgttgtcagggagggacagacggcagaaaggctaaggacacctgctcccctcctacccagaggcactgaggccagtgagtagagcctgtccctccaggcctgtaacctgcacacagcaggtgttcactgatgccttctcatgggtcctggggacctgagccgcccctctgctgcccacagctctgttcgtcttctgcaccaagagccgccgtgccgagcgctactggcagaagaccctgctgcagatggaagagatggagtctcagatccgagaggagatccgtaaaggtaagtgccagggtcgggtggcgctgcccacagctgggcaggatcactcacagtcactggtctgtcccacaggctttgcggagctgcagacagacatgacggatctcaccaaggagctgaaccgcagccagggcatccccttcttggagtacaagcacttcgtgactcgaaccttcttccccaaggtacacaccctccctcccgcatttgctggtcaccacagggagtttgggtcaaagcaccttttgggagcctgtctgtccacacccatcctggttccctcccccactttccttctctgctgatttgatgttcagctttctgtatggagaaccgctgtcctggctccatgttgacctgcctctcccctcactgacggagctgagcagaggggcaaggactctcccaggtccctgccagacgtcctggtctccacattgctttttcctcttggtgtcaggatcagtgggatgactgtcccccttgtgcagtagcccaaggaaacacaggctctaccatttaaagagccccgcccctgcttttctcaacctcagaacacagcagcttgcctgcctccatctcccctgccacacattcagtggcccttgttcacccttcaggtcccttgctaggctacaccatagtctatgcccctctagggccctgccacactcctccacgtgtggnnnnnnnnnnnnnnnnnnnnctgccacactccttccacgtgtggcgactctaggtatcaagcaatctgtggtgctaaagcagtggtttctctccgcagtgctcttccctctatgaagagcggtatgtgctgccctcgaagaccctcaactcccagggtggctccccgccacaggaaacccacccactgctgggagagtggaacgtgagtatcccggccccaagggcctccacgcaccctgtgatctgaatcattagaaggtagttaccttcccttctaggaggcattcactcagccgttcagggtgctgttgttccctcccaccccaccccccgacctggcagagagcacggacacatgatcacatgatgtcatgccaccgctggttagatagaaactggcacagagtggatatggggctccctgccactgtccttgtggccttttgtcaccttgctgctcctctgactcttcagtaggagaggttaaggggggacactttgtggcaggtagtgaacgtcctattccaggaggcagctacacagccagcatgggtactggggcctcctgggacacaaaccatagggcgtttccttccactcccacagatccctgaacactgtcggcccagcatggaggaggggatcagcctgttctcctcactgctcaacaacaagcacttcctcatcgtcttcgtccatgctctggagcagcagaaggacttcgcagtgcgtgacaggtcaggctgagactctggaccccacccccctccccaggcattcctcattggccacaccggctcccagcggaggcagagtcctctggccgtctgtaggaggcgctgtgcactctggtccagggggatgctcagctttgctgacactgtgcgtgcaggtgcagcctggcgtccctgctgacc

SEQ ID NO: 1940 - DNA, 2060 bp, Mus musculus
tgaaccgcctgtaccaactgtcgagtgccaacttgagcctggaagccgaggcgaccgtgggtcccgtgccggacagcccgctgtgtcacgccccgcagctcccgcaggcctcgtgcgagcacccgcggcgcctcacggacaactacaacaaaatcctgcagttggacccgggccagggtctggtggtcgcgtgcggctccatctaccagggtctgtgccagctgaggcgccggggcaacatctcagccctggccgtgagctttccgcctgccgcgccgaccgcagaaccggtcaccgtgttccccagcatgctcaacgtggccgccaaccaccccaacgcgtccactgtgggactggtgctgccgcctacctcgggcaccgggggcagccgtctgctcgtgggcgccacgtacaccggcttcggcagcgctttcttcccgcgcaaccgtagcctagaagaccaccgcttcgagaacacgcccgagatcgctatccgctccctggacgcgcgtggagacttggccaagctcttcaccttcgaccttaacccgtcggacgataacatcctgaagatcaagcagggcgccaaggagcagcacaagctgggcttcgtgcgtgccttcttgcacccggcggtgccaccgcacagcgcgcagccctacgcgtacctggcgctcaacagcgaggcgcgtgcgggcgacaaggacagccaggcgcgcagcctgctggcgcgcatctgcctgccccgcggcgcgggtggcgacgccaagaagctcaccgaccgcctcgtgtcggttttccccgcgcgcgagcagttcttcgctgtcttcgagaggccccagggcgccccaggtgcccgcaacgccccggccgcgctttgcgccttccgcttcgacgacgtgcaggctgccattcgtgcagcgcgcaccgcctgcttcgtggagccggcgcccgacgtggtggcggtgttggacagtgtggtgcagggcaccgggccggcctgcgagagcaagcgcaacatacagctgcagccggagcaactggattgcggagcggcccacctgcagcacccactgaccatcctgcagccgctgagggcatcgcccgtgttccgtgctccagggctcacggccgtggctgtggccagtgccaacaactacacggccgtctttctgggcaccgccacagggaggctcctcaagatcagcctgaacgagagcatgcaggtagtaagcaggcgagtgctgactgtagcctatggggagcctgtgcatcacgtcatgcagtttgaccccatggatcctggttacctatacctgatgacatcccaccagatggcccgagtgaaggtggcagcgtgtgaggtacactccacctgcggggactgcgtgggtgcggccgatgcctactgtggttggtgcactctggagacccggtgcacactccagcaggattgcaccaactccagccagccacatttctggaccagtgccagtgagggccccagccgctgccctgccatgacagtactgccctcggagattgatgtgcaccgggactacacaggtatgatcttacagatctcaggaagcctgcccagcctcagcggcatggagatggcttgtgactatggaaatggcgttcgaacggtggcccgggtacctggccctgcctatgatcatcagattgcctactgcaatctcctgcccagggcccagtttccatcctttcctgctggccaggaccacgtgaccgttgagatgtctgtaagggtcaaaggacacaacattgtctcagccaatttcaccatctacgactgcagccgaattggacaagtctacccccatacagcctgtaccagctgcctgtccacacagtggccttgctcctggtgcatccagctgcattcatgtgtctccaaccagtctcagtgccaggactcgccaaaccccacgagtcctcaggactgtccccagatcctgccctcgcccctagcgcccgtgcccacaggtggctcccaagacatcctggtgcccctgactaaagccaccttcttccat

SEQ ID NO: 1941 - protein, 686 aa, Mus musculus
NRLYQLSSANLSLEAEATVGPVPDSPLCHAPQLPQASCEHPRRLTDNYNKILQLDPGQGLVVACGSIYQGLCQLRRRGNISALAVSFPPAAPTAEPVTVFPSMLNVAANHPNASTVGLVLPPTSGTGGSRLLVGATYTGFGSAFFPRNRSLEDHRFENTPEIAIRSLDARGDLAKLFTFDLNPSDDNILKIKQGAKEQHKLGFVRAFLHPAVPPHSAQPYAYLALNSEARAGDKDSQARSLLARICLPRGAGGDAKKLTDRLVSVFPAREQFFAVFERPQGAPGARNAPAALCAFRFDDVQAAIRAARTACFVEPAPDVVAVLDSVVQGTGPACESKRNIQLQPEQLDCGAAHLQHPLTILQPLRASPVFRAPGLTAVAVASANNYTAVFLGTATGRLLKISLNESMQVVSRRVLTVAYGEPVHHVMQFDPMDPGYLYLMTSHQMARVKVAACEVHSTCGDCVGAADAYCGWCTLETRCTLQQDCTNSSQPHFWTSASEGPSRCPAMTVLPSEIDVHRDYTGMILQISGSLPSLSGMEMACDYGNGVRTVARVPGPAYDHQIAYCNLLPRAQFPSFPAGQDHVTVEMSVRVKGHNIVSANFTIYDCSRIGQVYPHTACTSCLSTQWPCSWCIQLHSCVSNQSQCQDSPNPTSPQDCPQILPSPLAPVPTGGSQDILVPLTKATFFH

SEQ ID NO: 1942 - DNA, 71292 bp, Homo sapiens
cctcgtgcaagtccactccatcagcctgttgcccatgcagaccttggcttgtacagccacctccaccacataccaggaattcccatgtgtgtgcatgtgaccccaatatgcaccccatgcacacgaacacacattatacccctcctcacatgcatggcaccccatctttgcacagaccaccccctcatgcccacatgcacacacacaatggggtatccctgagacaggggctttcacaggctggtacaggctgtgcaagaagctcactacagggcgggacccctaatgcctctctcttggtggctgggagctgggccagtgtgctgcggcccatgtgctgtggcccctgcccttcctggacagctctgggaaggttcttcccccttcagagccatcagcctggggtggcagcttccacttctgtgagcgtgcacagataaacaatccctgtggtggctgccaaggggaacccgcacccagtggagcccctgtgcccagaggctgggctggtggttgggaccctctcaaagttaacacccccaagaacgagccctggatcctccaccagcctgctgctggcctctcaccctcctctgctcgcctctcaccctcctctgctctgcccacacgggcctctgtcctccagggctccgcccttgctgtgccctgcctggaaggctctcttcaccctcctgactctgctgcatcctgcagatctcagccccaggggcccgaggaagatgggctggagtccccttgggagaaacttttccagaaccacctggtatggctcctttgtaagatgggtggctctttgtggttgtgtaattatttgagttatttggttaaagattatttgccccctggggtagggctgaagacaaggaccatgcttgtgggctcactatgatatcccagtgcctggcacatagtaggtgcttagttaagggttctttctgaaggaaggagaaaggaaggaagaagggagggagggagggagggagggagaagaatgaccctcagtgttctattccgcccagggttttgcttgtgtgtcatgagatgagggacaggaccctcagaactccaccagtaatcaggtgtgaacggtcaccttgggggccagtgggtgtcccagatgaggcaggaggtgcaggagggctgatgtggcctgctcttatgaggggcagtcagtagggccaatggacagtggggacagggaggtcgctttggcagcatctgcctggcactgcccggggagggggtctccagcagccaacatgaccatcctgcctgctgggggggcatgtcctggggtggtgctggcagccatctgcccagcccaacatttattagtagtgatcgtgtgttccaccctggaagcgctcccagtgcactggggaagtcacgtgcccttgcactgggtgatatgaggtttgataggaggagctctaagtgggtggaggaactcctaatactgctttgaggctcaaggaagtcttctcagaaggtctttagactaggtcttgagggaggcctaggagttcactaggaaagactttccagagaaggtgaaattgggttgggtcttgagggatacaaaaagttcactcagaaaacaagagaggaaacaccttttctggacactgggttctctctaggggctcatgtaggccatcagaccagtaagaccacagtattccgggaccctgctcacccatgccagcctctcctgtacgccctgtgtgtgaccgtatgggtgagggcccctccactgccccatcctagagcggttgggattgtgccagtgtggagtgtgctcggcacacagcaagtgcttggtcggagtgggctctcagaatcgtgcagctggtccgaggtggggccatgtctagggtctgcagcttgcatactcgtgacaggcactcaccctgccgcaggcagcccttccttctccagacccagcagcagtttcaaaagatgagtggggccttgtcagtccccactgagttggctggaaccaagtggtgaggttggggccactggaagggaaaggcctggtcgggaagcaggctcacctggattttagctcacacctgcccggcctccctgaggcttccaaggatggcttcattcccagccaggtctctcaggaagcatggaaggtgagaaaacagttctcagaagtttactggggcataaagggagccaggaagccttacagggtggaaacgggtctgaagtggggtgtatgtgccagcccaagacttaagagaaccccttggggcccattggcactggggcctggggccatggagactcaagttcattaagaacaggactcaggccgggtgcggtggctcacacctgtaatcccagcactttgggaggccgaggcaggcagatcacgaggtcaggagttcgaaaccagcctgaccaacatggcaaaaccctgtctctactaaaaatacaaaaattagtcgggcgtggtggtgtgtgcctgtaatcccagctactcgggaggctgaggcaggagaatcgcttgcacccaggaggcagaggttgcagagctgagatcgcaccacttaactccagcctgggcgacagagtaagaccccgtctcaaaaaaaaaaaaaaaaaaaaaaagaacaaggaatctggaatccaggttctaccacgtactagctggtgacctcaggcaagtcacctcacctcctgcctcagtttccctacctgtaaataggtatgttcacggtagggttattgtgaggtttaaatacattaatatatgcaaggtgtttagaactgggcctagcccatagaagggcactagaagtgtccgttgttttggtacctgctatgaagcataagctcatgcacttgctctgcaggggtgggggtcggggggcactgaggaggctgaggtacctgggggagcacccactaagtgacagactccagggagccactgaggaaagacccagcccctgctgtcagcaaagaccaaacttgatcagccaactctattggaagccagaggcctcatctcattttgcagaagaggaaattgaggtccagaggagggtgcaggtctggagggggcaggaagggtcttgatgtgaagccctgacgggggcgggggcagaagagctggcctgtgtgcatctgataaaacacgagccaggcctgctccgtccatcccgagggcagggcagggaagcactgggaagtcagagctgggggatagtgggagcagcaacgcctccccctccaatgattggaagcaaatgtcactgactatttgccatgagtcaggggctggctaaatgtcctacagggatgacctcatttcatccccacagtctgcagaggcagtggctgtcatacccattacacaggtgtgggaatggaggcctggagtgtggaagagactcacctgtcacacaggcagcacgaggctgggatctgaacccagatccagggccacaggatgatgactccacagcctcgactggggtgccacctgcccctcactgggctccacccctggagaacagggaacagccagacctcagtgaaaatcccagctccaacttgggcggctcggtggccccaggcaagttgcttcctgtggggcctcagtcccctcctctgtaggtgggcctcacagtccctcccttgtgaagacggccttcatcctggattctcagtgacgttgtacacggccataagcctgccccatgtgctcctgctggcctggctgtctgatctgcccctgtgtattccctcagccctcctgccacggggtgtggtcactgttgtgtccctaaggcaaacagtaggttctcactcaacatccactggattagtcatggtcagacagacaccggttcaaatccaggaccagggcctcatctcctgagcctcaatttatgcacctatcaaatggggtcagctgcacagctgtttgatggcttttataaggactggctggcaaatgtttaacacacagaaggtgctcaacccacacaacgcccagtcctcatcagccctcggctttccctgctccttgtagctcctgtcattggggatgtggtcattaagcacctactgtctgtgcagggagcgcctgcctcccagcccactcaggcggttgtcgcctggagatggcagccagggaatgtgggtgggggcccccgcggcggccctgcccctctgaggcttctgctggacagaggcctcagtgtggagctgcccgggtcctttcacgggcccagacccatgactggacgtctgagaatgccgcccattatccaactcacagagcacaaaggggccatgcgggggctcggcaggccaggcgcccccagtgagcacacggggctccgggtccccaccccggcccatgagtcccctgagcacagagggcaaggacctgcccagagtcgggagagggcgtcgttcacatgcaggaatgagaaccatttcctccagccccacggggacacagagatgagaggaaccaccctgggggctgggcttgagggccagggcaggccatcgctcctgggcccggaaaccagacctggaaggtcgcctcctcctccagaagaggcagagagggaacacttcaggggccaggaggggcccctagaatgtgaagggtggcaaagcctcgaggtttccccagtggcatccacagtggagaagccacagcactgctgtctggaaacacggtcaagaggggtactgtctcctgtcggtgccaccactggagggtcagcccgcccctcccgagccacactagtggggcacgatggcaaagacaggagatgcagcgtggaggggcagcggggcagggctcactttgccacctgtttgctgtgtgacctcgggtgggcctctaggcctctctgagccttaagtgtctgtgctcaggaggagaggggaaggaatgatcacgcaggccctcgagacccttgggtgggtgattaaaggaggtgatctccctgataatcatcatctgggtggagggagccctcctgaggggttcagaggataggctggagaagcccacatgggagctgaggctctagggcaggaagtcagcagacttcacacttcatgatgacacacacatgccccatcctcacagcggcccacggaggcagatcatgctcctctttccagatacggaaactgaggaccaagaagcagtggcgccgccgtggtcatgcagatggttagggtcaggcctctcagccccaagcaaggggcgcagggatgcagcggctgagagcagggcctggacgcctggaggctgtgcagctgcaggccagtggcacaccactctgaccttaagtgtccccatctgcaaaagtgggttgatcaaaggtccatcaatgatagactggattaagaaaatgtggcacatatacaccatggaatactatgcagccataaaaaaggatgagttcatgtcctttgtagggacatggatgaagctggaaaccatcattctgagcaaactatcgcaaggacagaaaaccaacactgcatgttctcactcataggtgggaactgaacaatgagaacacttggacacaggatggggaatatcacacactggggcctgtcgtggggtggggggagggggagggatagcattaggagatatacctaatgtaaatgacgagttaataggtgcggcacaccaacatggcacctgtatacaaacgtaacaaacctgcacgttgtgcacatgtaccctagaacttaaagtataatttaaaaaaaaggggggttgctaagaccccccccgcagggttgctcccacggggaaatgagacgggtccagcccccgagaagcagcagtgatggctcccggcaccacctaggcccatggctggattgccaagccgtccctaggactcttgtttccagcaccttcctgtggctgaggcggtgctctaaagcattaaccttgcaggggcatttcctgcaaggaaacgttctcagaggccaggcccaagggacaggagggcaggagccccctcctcccagcgcaaccctggccccactgttattttttccaattgaagaagaaaaacatttcctctgtctcctcacagctctgccctgggcagtcagaggtgagaatggacaggacagggtgggaagcccacccagtggggtggaaggcccaggcccgccttctccgagccagcatagccgttgaccaccgtgccccaagcaagactgccctgactcggccaccaggtcctcgtcttcaaaggcactgctggacatttcccaaatttcaggcattttggtggcatctggattatcacctatttcacatttgtctttaactcacttttaaaggacttcaatcaatgcatttatcaaggaagctttacatcattactgtacatggaaaaccagtagcacttgccaaaaccagaaagtaacggcaagtacaaagaaaacaaagcgctatcagtacattctagcacgctgatgtcaacagccctgagtttgagaccttctctctattaaaaagagacagtgacaaatgttacagtcattaaagacatgttagcctcaaaccaagaccttttccttgatataatcagacttgaacaaaaactgaaaaaggcccaaattgcagtgtgaataaccaactaggtctggctattctgggttagttcattccaagttagttattgctgggtcccacctaatccccactcctgagtacctttcatctccccttggttccctccaaaattccctctggaagaacacctcattgcatcttagtaaggccagggaaggtgtggtttgttccttcctttattcattcattcagccagtaattgtcagcacctcctctgcccagccaggggtataggggctgccaccatgagccatcctggcctgatggtgctcccagctaatgggtagaagggagaaatcataagatgtggagccagatctgggtttcaatccttaccttgctaatgcccctcagtttccccatctgtgaaatgggtttgctgaccacagcctagtcagctggctgcaaggatggtgtaagatctggtagggcagtgctgggcacaggattcactctcaccgtctggtggctctgctagccacattggggctcaggacaggaggtggagccctggtctttagttgcaatgccccccaccccaactcctggctctaacatgggcttcaggggtcatggttcactgccacaaggcggggagaaactggtgtttgctaagagccttgttgtgcttgacacctgttatgttatattctccatctcacaccctcccaggggcaggtgttctgctacgattgtcctcattttacagttgaggaaactgaggctcagagagggtgagtgccttgcacaagaccacacagcacttctcacctccagttgatgtgaggatactcagacccgaatacccttcacctagagagctcctaaaccccactgctcagcttggcagggagcttgtgtcccaagtgcccaggatcatcaccacaggctggtctaagacaacactgagcattatcctcacggctcagtggggggagctgcaggatgcagcaagatgaaccagatgagcgggagacaggaaggaagagaggaggggctggagagggagtgggggtgagggatagggagggagacagagagagagacagagatagagacacagagagacagatgaagagtggaaagggaagggggcaagacactgagagaaggagagacaaagagagtgaacgggaggagcaagacagataggaacagagatgggtgggggcaggagagagagagataagacagagagaccagcggatggactggggtgggggcactgaggatgtgagtgaggaggaggggcatggaggcaggccccatgcacccctgctgggctctgcagttggcccccacgggtggcacgatgtgcgccttctccatccagagaggaagacagggacacagtcccacgggcagtcccctgagtggctcttggtgggtggatgggcctgggagggggcctccaatttcctgcagctcaacactcccggccatcaaagcagtggccagaccagggctgaggggtctggaacaaggcgggcaggatggcaggaaggcgagggtgttgagggaagtggggggcggctgcaggcccagcctttcctgccggccccatggtgcacagacacccctgcccttccttcctggttgggtgggaaagaggaaaatgaggtcccgctactctcagagtgaggcccaccgggcaccctgtggaagctgggggtctgatgggaggccccgttctgagaggtcggagctgaagggcttttgctttcaaacactgtagctctgctcctcatgagctgtgcatcttgggccagtcccttcccctcagccttggtttccatatctggaagatgggttaccaatagcgctcgcctcgggggaatctgtgaggaaaaagagagcccgtacatggcaagtgcttggcacagtgtctggcacgggctagccctgtgtgagcacccccgtaaaacagccacggcgcatggtcctcacagggctgtgaccttggaaccaggctgcctgcccctaacgctgcttttgagatcaagaaccctgcccagtgccggcttttgtgggactaatcttccactaagcctgggaggatgtcagggaaagtgcctggcgggggtgccaggggtgggggtgcggctgggtctccacaggaggcaactgtgggctccaggaccaaggccttgctctggctatcggttgtgggccactggctggaactatttcctctctccatgttttcctcatttatatatctgaccctgagcactggtccctctggccctgccacttgtaaatcccttttatgggtctggggtttgggggacagattatggggtctggggggcccgactggccggcaccgggggagcgaaggcctggacagtgcctgagaaaggtggtggagggaggctgagtgtggaggggagacacagggttcgggaaggcagagggagaaggaaaggggagctcagagggaccgagagagggacggagggtccgagggggaggcagagggagccacggagagagggagcgagcgtcagggacggaaaaacggagcaggagagagaaggagactagaaagggccgggggcggggctgccagggactggagagcgaagcggagtcggagggagaaggagaagcagaggcagaacccggagaagcgccacacgcgcggagtttggggtggggacagagacggagagacgcagagaccgagagacgcagagagagggagagacggggtgggggagagggcggaaaagagaaaacaggcgcgagcgaggcaggccaagcggccaagtgggaggaaagagcgaggagagcgagcgacggcggcggcggctacggggagggaccctggggccgcgggcgggtcctggagggcgcgggcggcgggacccgcggacggcggggcgtggcccagggcggccaggggcaggcgggggtcccgggggcgggcggggccggggcggggagtgagggcgtgtccgcagcggagccgcccccgccccgcccccgccccgcccccgggctgcgcggcgaggctgagccgggcccgggcgccggggccgggggcggctggcgcgggcaggaagcgcctcgcggcccgggcccgccccccgcctctcgcccgctccgggctcccggctcccggccggcgctcgtcccatgcaatagccgcgccgcgcagcccgcgcacgcccggatggctcttcgcgccgcgggcggcgcaccctttagcggcccggcgccgctgccagccccccgccgttccagacgccgccgcggtgcccggtgccgctgctgttgctgctgctcctgggggcggcgcgggccggcgccctggagatccagcgtcggttcccctcgcccacgcccaccaacaacttcgccctggacggcgcggcggggaccgtgtacctggcggccgtcaaccgcctctatcagctgtcgggcgccaacctgagcctggaggccgaggcggccgtgggcccggtgcccgacagcccgctgtgtcacgctccgcagctgccgcaggcctcgtgcgagcacccgcggcgcctcacggacaactacaacaagatcctgcagctggaccccggccagggcctggtagtcgtgtgcgggtccatctaccagggcttctgccagctgcggcgccggggcaacatctcggccgtggccgtgcgcttcccgcccgccgcgccgcccgccgagcccgtcacggtgttccccagcatgctgaacgtggcggccaaccacccgaacgcgtccaccgtggggctagttctgcctcccgccgcgggcgcggggggcagccgcctgctcgtgggcgccacgtacaccggttacggcagctccttcttcccgcgcaaccgcagcctggaggaccaccgcttcgagaacacgcccgagatcgccatccgctccctggacacgcgcggcgacctggccaagctcttcaccttcgacctcaacccctccgacgacaacatcctcaagatcaagcagggcgccaaggagcagcacaagctgggcttcgtgagcgccttcctgcacccgtccgacccgccgccgggtgcacagtcctacgcgtacctggcgctcaacagcgaggcgcgcgcgggcgacaaggagagccaggcgcggagcctgctggcgcgcatctgcctgccccacggcgccggcggcgacgccaagaagctcaccgagtcctacatccagttgggcttgcagtgcgcgggcggcgcgggccgcggcgacctctacagccgcctggtgtcggtcttcccagcccgggagcggctctttgctgtcttcgagcggccccaggggtcccccgcggcccgcgctgctccggccgcactctgcgccttccgcttcgccgacgtgcgagccgccatccgagctgcgcgcaccgcctgcttcgtggaaccggcgcccgacgtggtggcggtgctcgacagcgtggtgcagggcacgggaccggcctgcgagcgcaagctcaacatccaggtacacccgggcggtggcggcggcggcggcggcggcggcggcgggggcgggggcgggggcgggcgggaaccgagcgggtcgtgagctgagtgggtcacaggtgggagcgcgcagagatccagatgtacgtggaacccaggtgtgcacgcgagaatacaggtgtcccccgaggggtactactggcgcctgtatggcccaggtgggcatgtgcagggactcaagtgagtgccggctcatgggcgcgcatacctaggcgtactgggaggggtccaagttgccacaggtacccaggtgcgcataaagcccaggtatgcacgtgagggtcacaggtgcatgctgagggcgcagtaagtgactgcatgcctgaccaaagttgtgttctggggccactgcgtgagcctgtcagagttaccattgcacgttggtgatgggtgcatgggtgtggcaggtgtgcaaggaggcacacaggtgtgcaccagggccctgcagatgtctgcatggacttgtgtgccagcaagctggggcctgaagacgcacagggcagacaggtgtactgcacagacactggtacaacgggacagggctaggtgtgcagtgggatgtgcgtggcaggggacgcaggtatttgggcatgagtcggtactctgaggaggctgcatggttggcaaacaggtgtgtgcctgaggccaacttttattcacctattctgcaaatatttcctgagcacctagtatgtaccaggtgtgggagtctggggtaaacaatagcacttgtggagtgccagctaggggcatcacatgtcacaattcccagttctcagaacaaccctctcaggtagcctctattctcatcacattttacagatgaagaaacaggcacagagaggttaagcaacttgctgaggatcacacagttgggcactagcagaggtggatttgaatccagcctgtctggcctcagcatctgtgtttttaatgcccagcctttgctgccttctggacttggatctcagagtgcgtgtgttttgggggcgtcccaggcagctggggtgggcagatgccagggccaggagaatggagggatgtgaacaggggtgttttgggggcaggagagggccgtggggctcagtggggaatgaggaggagtacaggcgggcatggggcccaggtgtctgaggctgggttgggcagtagcaaggggggccaggttgacggaatcagcatgtgtgttgacatgacaagggtgcgggaggggacttggtgtggttccctgaaaggaagttcatggcaagggattgctcctcacactggctttgggagctgggtctgttgatccccatagttcaccctgaggaatgaggccccagaatgacactggggcctttcccacaccctccacccatctgagtctggcgagcccacttcagctccactgcctgccattcccttaggaagctgcatctccatcagcaaaatgcagaactcagccttcttgtggtgacccaagccttccttggggccccaccctgtcccttctccatggctgtgacaagaatttcatgagattaaccattcctctgtgggcgggcccaacactggggctttgagaaaatgcagattccttctcccaaggtcgaggtcggtctcccacgactgcccaccatctggccggccaccctgaaagtaaaggtcacggtgggtgagcagggcagacagtccaaagggtggtggggctgcttgccctgtgccatggttggttcatccaccatctccaccccagagcttcatctcgcaggcaactgtgtttggcactgggggtctcagtggggagtcgctgaatggagagaagtgtcctgtggactgagggccttcctccagtagtttcaggccctgtgtctcggccctttggtgtaagctgatctgtgggattccttaggccagcccagggttccctccccctctggcaagaaccattctggttcccacggtccgctccctcggtgcagtgactcacccagctgaggggggctggagcttctctacctaaggggacagggcctctccagggacacagccccaggacagagtggcgaagggcctcttccccaccccaaggccacagattccggctgcggccttccttggtcaccctccctgtgttttccacacccttctcctcttcgccgtgcccgctgtgggcacaggccagtgccacttggcagtatctcccagaggtgctcaaggtccccggtctgggcctctagcatgggcaggggtgggggagggatcattattcttgctccaggctgttgccagctacgcagcgacagattcagaacctagactttgcatcaggctgcttgggttcaagtcccactttgtcacttcccagctgtgtgaccttggccaaggaacttaacctctctgggcctcagtttcttcatctgtgaagtggggacagtaaaagcaatccttatcccaaagcattgttttaaggactagatgaatcgataaatgcagctcagtgtacccagtacacagtaagcaccaagcagatggcagctcttcttgttattactctaagggacattattagcacaggtctctgcttggtcctggagagcagttgcctaatctggcttgttctgcagctgtaaacaccccaccatctcctacttctagccccagatgacacctccatagacatttactaagtccctattgtgagcccagtcccatgctgtgccctggggagccaatggcaactcactttgtttctactcttgtgggctgggcaggtgagccgaggacggatgtgtgaccaggcccttatacacagggcaatgcgtgccgcaaagggagaatgagggtggagggagcccagcggagggggcggaggagcaggaggaagccaggtgaggccggagaagaggaaaggcatccaggcaaagggagcagcctgtgcgaaggctgtgagcaggctcgagggggtctgcgtggccaggcgagtagagtgggaagcacatgacacaagggccagggaggcctggggagaccgtccttgggagtctggactttatcctggggtcctgggagccatgaagggttttagccagagaagtggagtggtctcagcaggcacctgagtctccccgctgcagaaggggaatgctcgtgaatacctgcctcttagggctgttgggggtattaaatgagatcatttatgtacctggcgcctgtttgcaatgactacaattcttctacctattattttagaaagcccctaggtagctggtgagaaggagcaatggaggagggagagtggctgagaggctgaggccgcctcccgggaatagattccttcactcagtcgcaaatatatcttgagcacttactgtgtgccaggctctgtggtaggtgccagatggcagtggggagatggggccggccttgttctctggagacatggctggcctggtctgcagcagtgctgagggcttggagggtggcaggtgggctctggacagatttgggggctgggatgcagccccagtggtggggagtgatgggatggaggagcagaaagctgcccagagtcaggctcagcaacaggatagatgttggtacccatggggtggggcatgcgatggggtacctctggggaagaggatgagtttggtctggggagaaccaggagcctagaatccttttttctcctggtcccatctggctggatttctctgtcactggcactgggtggcctgggtggggctgcacatggggcaggaccccagggccgaatgacctgcaagtggggcagctcagccaggcctttggaaacccagcctctcgctcctgcttgagggtctcatgaagaaccctgggccctggcaggaatcccttgagccgcccacaactccagagcctgggtcaggatggcctcccgacattccgggttcccagctgacaggacttgccctctgccctccaccttcttcccgagaacccaaagggagaagctgctgaagtgtgaggcgagaggcagagaacctcggtccccgcagccctcagaagtccccaaatttgtccctgattgttttcaacgtatttggggcagttaagatattttgagagaaactgagtgaagaaattagcctccattgcatgtagcttggatccctttcctcaaatcacaacctgtttggagtgcaagccagttgggaagttgttgagtgccactgatgggggaaactgaggcacagcatcacccaacaaggtggggcagactgagtctaccttccttccccaagtctttctccccaacctatgaatgaccataatatttgtatttttaaaacaaaaggaataccgacaggccaatgtcagtgcagcattttcaaggtgtctttttatagtaaaggtggaaaaaaaaccatcaggcagttttaaactggcatgcagtgggtgggtgcacgtcgtcaagaagacatttttttgcaccaatttaggggctgagatgccaggtgggggcggagggagagagagcttccaagatgggctttacatttgggtttgggctgggggctgggagtgatctcccagtgacgaagcgtgcaagcagagacacttggcaggatttaggagagggggttctaggaggattggctgagatgaccctctggcctggagaaacagatagggcttggaccaggagacatccctcccagccctgagaatgtctcgacccccaggtacatgggcatacagtccataagctgtgtgtcccagggccagtcatttaccctctctgggcctcattctttctcattataaaacaggtcttatgcctccctcctaggatgtgggtagattaaaatctcaggggtgtctctctcagcctactctggcttagggggctgcccataataaaaaataaatacataaaataaaacctcacatgcagtgcccaggaaatggcaggcacaggtattagtatcaagagggagaaaagacaccagaaaaaactggcctcagtggacaggggatgctcagaggagggagggtcagggccttggaggagatgagatcaaatagggcctgaaggcaggcaggggtgggtgagacgcctgggtgcagcaagggtgtgttgggtgctgtcccagccccagcacagagactgagatggagagaatggtctctagtgcccgggctgaggagtccagggcagcactgtcttgaaggcaagaggcctgtgggctccttggagtgaataaaaaccgtcgccgagctcgcgctctgcaggccttttataagcacctacatggttgacctcatggctgcccctcccctggtcaggcagacagtgcgtcatcatcatccccagcttacagaaggggaaactgaggccaagagaggggaagtgacttgccctggctcacacagctggggagtgagggtctggatccgcagatagaagcaggagtcctcttcctggtggctggtgagctgtgagctctccgtggtggggaattctgcagttccccctctggctgggccatagagattcaggcagggcccattgtgatagcagtgactcaggcgggctggggcatctgcagaggccaggccacatgctgggggatgggggctgacccagcttcctgaggaagtcaggggaggcaaggaacttctagttgcatttgtctgaaaatgcgatcatcagcctctggaaggagtgagcccatggccctttgggtgtgcaaatgagagatgtgggttcaatggtcagtgtgaatgatggtccacccaggagggtgagtgggggatctgtcagcgccctggatacgcccacagtgaggccttccacagccaggcaggcgcacatcgctaggtgattgcaggaccctggggccaacttcccagattcaaatcctgcctctgccccttcctagctgtggaaagtcccatccgttcttggagcctccattttcccatctataaagtgggctgagcgcagggaagactggagtggcctggcggcattcagcaagggccacgcgcatcgggcccggcagaaacgccctctgcaaagtccgattcacccgcctgtgactcccggtctccatggagattaaggaaaccagctgggttccatgtcctggttgctgccgtgaacaaagacgcgtggcgtgtactgggacaggagcgggagggcaggagccccgggagagagtggtgccttcccctacctgggcctccgttctccgaccctggagttggcccatggagtggcaaggaagccttccctctgacaccagaactgccccatcatgtcataattactgtggttgttgcttgagaactttctctgtgttagccctttgcagagcactttacatatcttttaatctccccagaacctgaatgaaatgactgttatccccagtctatggaaggggaaacagaggtccagaagggttaagcatcttgcctgaggtcacaccgtggtgtgtgactgtggtgctccaggtggagcaggcttctggctgtagcgcctgtgacccctcattcctccaaaatctttgaccgaaggggtgtgagccagagggtgtcggaaggggtgaatgggcccattttaaaggtgaggaaactgagacccagggaacttctgcgtccgccgaggcccctgtgagaagcagtgagggcctttcagggtggcctgcagagctgcccagccccagcgcccatcatggtcgcgggctggggttaggatgaccccctggtgtggactcctgctaccgggcctgtagctgtctccacccacacataccagaggccagcacctccttggtaacatcgcatgcccgtccaagctctgggtggggagctctctagagtatgtgagtatgggaggaggctcagcttgctacaggacagcccccaagagagacaaattggaccctctccaggagcccccagaatggtgagggaggaggtcatgacatcagacagatgccacacactaaccagctcatcagaggagtgcgggagggcttcctggaggaggggaggttggagcagcacttgacagatggggctggggaaggcattccaggcagagcacacgataggggcaaaggctcagagatgttggaatgtggcttgggtagcaggccgaggggaagctgagagtgtgctgggccttgcctgcaggctaaagacttggatgctgtcatgtgggctgcggggagccagcagggctttggggaaaggagagacatggctgatctggttccggaagggaccctgtggctgctggtctgtattggccctgccaggtgctggcaggatccaggggcggaggcgctcacccggagcccccactgtggctggaccaggtaactcccgagggcctctccagctctgacagccatgtggggattgccatggaaaccagccggttcccgagtggggacaagcccagaaagtctctgagtgccagccacgtggacttggatcctcactgccccccaagtacagccgttttcttctttccaaaggccatgtctgagccagggctgaaccaaacagaccgcccagacaggcatccagtggcaggggccctgctccaccctgctcggctgatactcgatgcagtcaagatctgggggccagcgccagcgggggccctccccgcctagtccaccgtcctttaccctgaaacttgataaatcatgcgctggagggggagggaagctcgcagctccattacgagtcccggcaaggccccagtggggcgttaatcatgtagcactttatgctctgatcggtaaataatgggggggggcccgcaggcagaggccttggagtggaggccaggcccaggaaagtggccaaacccccttgcctgtgcccttctccagcctctgcccgctatctttgtttgaggtgactgagctctctagaagcagccatcaccttgatgggcctcagtttccccagctcaaaacccagggtttttccagctccaagcggctgatttcctggcaaccattggtggctcccagcagagcggcgggtggggaggctgtggttaagggcggggatctggagcccgcaggcctgcgctggaggcttggatctagccattccggctgtgtgcccctgggcaaatcacttcaactctctgtgcctcagtttcctttactgtaaagcagcatcaactctttcagggtgtggtgagggttgaatgagataatacagaaagaggtctcagcacaaagcagactgcacacagctgcttgctactgtcactctaccgaactgttactatgagaaagctgcccctccccatcctggggctgggcctctgagctcggatgtgggcagctggagagagggccctgttgtcacctctgtgtccccagctcatggaatccagcccggagatgtttgcgcaaggctccaagcagccctgtcttcttggctgtgtccacagcggtcgtgcgatgactctgggaccagcggtagagtcctgctgcagagcacagcctgcggccaggcatatgggctggaccccgaggagaccaggggccggggaggagggtgtgagatcgaacctccaagtccccccagccccaggagggaactgccagtgttccctggagaggcaactatttctcggctcctggcctggagtcccttcaggggaggaagctgggagggaaactgttccagggcttggaaagactggcttcgtgctctgcccctcctgctggggggagggaagccttttccctgggccagggaagagccgctggctgcccatcccacactgtgctcctctgggacccagggggaggggagctggaaatggggccaggccgggccggaatgagaaacagcttcatgaagggggagctgggtgtctaggggctgcgtccagctaactaaacaatggctgcttgagtcagcgactgtggcggtggttcccaggcgccagggcagagcaggccgaggccagagctcccactactgtgtccttggtgagggcggtgtagcccatccagcctcggatgctttgacttcaggaagcggtggagtggcttgtccctgtcctcgggagctcccgagcctctgctccgtggtctgcatagctaattgggaacatttattgagcacctacagtgcttagcactgaaggctcctatgagctcagtccttccataagccctaggtggtgggtgctattgctgtcttattttacagatgtggagtccgaggttcagaggggatggtgcctcccacagtgaggtaagagctgtgagacttaggagtcaggagcctcagctttctcatctgtaaaatgggtacgcagcaagagtgtgtgtgtgtgtgtgtgtgtgtgtgtgtgtgcgtgcgtgcacccccagggctgtaaggtgcccccagtagctgtagtgtcacacagtaggtccttaatccagccaggcttgtgacctaagcctggggcttgtccttccaggccatgcctgtttggggtgggtgggcagatcatgcccagtctgtgtgttggccctcagggcggcctggctggctggcttcagcccttccagatggtgtccagctggtctggataacctcaaagccctggagctgggtgacccgcctcttccagaggggtcagggaaaccaaggcaggcctccccgaagggtctgccagagctgctgtgtcctttgccgtttgtctgaagcctctgctcttctctgtgccttggtttctccaacgtgctcctccaggctgcttttcctctgtggctaaggccaggcttcctgaccatggtgctaggcctggttggccatcttctccctacagcccctccaggaagcctcttggtcacccctgaaggcgctggtatttactttctcagcagcaggtggtctcctccctggcatgggggctgctgccagaggccacccaggaccgagtccgtcctgccccctcccagggctggcacacagtgtgcccatggctcattccttgcctcagtttactctcagcagaggtgtcagcttgcacagtgttctgagaggcggtgcatgctgaagtggaaggagctggggtctgggagtcacaggtgtggcttcataccctggcctggctgtgtgcggctgggctgctggactgagactggacacagtccacaggccaccactgagcccgtgccacatgggctccactcaggggagcccaggaggactggccctacctacctgggctgtccaagctgagggaggagttggcggggacgggggctgagagaggccacagaggtcagggccagattgagtggggcttcaagggcccaggagcaaagtttgggtttgtgttgacagcactagggaaccatgggaagctgttgagctgcacaggagatgtgacctgctttgcggggttttttttttttacaaaataaactttttactttggaataattttagattttcaggaaagttacaaagatagtacagacagttcctgtatacccgtcccctagtttctcccattgctaacatcttaccgttaccgtggtacatttgtcaaaactaagaagccaacatttgttctttactcccaactaaactccagactgcactccacaaacgtctgctttcttttccaggagcccacgttgcattaagcgctttgcagttttaaaagctctctttggctcccgtgaaggatgaatgggaaggagcccagctttgggaggagctggggggtccagacagcccagtccccggccaggatgtagtgagctgcggtcaccttgcagtttttttatttttattttttcgagacagggtctctgtcacccagactggagtgcggtggtgaaattatagctcactgcagccttgacctccaggcttcaggcgatccttccacgtccacctcccaaagcgctgggattacaggcgtgagccatggtgcgaacggcccaccctgcagtcttaataccccaaagtgatcatgtgctttcagctctgtggcaaatttcagctctgtggcaaggaaacctgactttcccaggatcataaacaatcaaacacttcaggcaggaaggtgccctcacttctcaagtgcaaagcctccgcagccggtgtggtagccatgcagtctgtacctgtgacggaaccgctggattttgcaacctgccgcagcgcccactgttaatgccgcatccttttcatagtgccacctgcggtgggtctgcggcaggatgtgaggcctgagaagccgggctcttgaagcgctccttccaactggcttcctggggagagaaagtcaacacaattacagctggtagtaaaatcaatatgtcagagttttaatgggagagtgggcagagctgagctttggccccaggagggagccagctggagggggagggggcatcctgctctcaaaacggggccgaaaccagcggcggttgctcatcccatgtgagagagggataaagtgaggtttttacaggaactgaagctagcagccagtgttgcctgggcctgaatacccgcctccctttgttgccacacgcagagtaggcatacgtttccctcagttctccagcacccagcatggccgtgttgctctcagtcactcgacttagagagaaagcagctgaccacagtcgttcacactttagtcaaaattaggttcctttcttttgtaaacattccctccagagcacaggctccatgctggagaacgtcatgcatgtgctgccatgggaaatgtgtgaccagcacagtgccatcacaggagttggggggctgagccacatcttgaaaacttgccgtctgggcatgcctggagagggaacagcatgggtccagacaccgggggcgctgaagtgccaaggggagtacgaatgcctcagaggcatgggatgggcattggctgctgaagggacatttacaatggtacaagagccccgggtatgaggtgtgggcacattccaggacctgtggagactgatgtggtgggcgcagcgggtggggcagagggaggagggagactggaggcctgggagctggcaggagctggggcacgaaggccttgaatgcgaggctggactgctggggcttgatcccgaggacagccgggagctgggttgtaggtagggagggtctgaccagctttgtgtgagagaaagatggccctgtgacttggagggcgctgcggggatagccgagccttccctgctctcaggagaacttgagttttgaaagactcatgctcattagcctttaaggaggacggtgctggggtcagggggtattttgggcctgtgaggctaactgtccctggagaccaagttcagccgaggccagcatgctcaggacgtctagtccccgagtcccgtgtccccctcccccagcctgcatccccctcccccagcaggggcggcacttcccgccacgctgggcttccgtgtttgagccggtttgccttgtgatttcccctggcagctggggaatcagcttccccctcggaacacagatcattcggagcagccgacggcttacttctttaaaaaaattttttaaaattttattttaggataaggggaaaaaacgctgggggaaaggccttttagaaaattccttcggtgcagaattaatggcttgtgaaagtcagcgcggggtgggggaggggggagcgggctcccagcgagctcccctccctcctgctcccctcctccctgctgccctagcccacagatcaccccgagctgggcgcctggtccgccttttcccaggaccccaccctggctggatgtcagggtatgcccaaaggtgtcatctggggcctcccaggtgtccccttccagaacttatgttcccttggtgggagggattcacaattttaattttaaacaacttatttttaaatgatgcaagtaattcatattcagtgaaaaaagttacttagttacctagcccctaggaaaatcatccctcgcagtggtgaggatcccacctcacctcttccctgcagctgcaggattgctgaggggtgggaccccgcctggttggggcagctggggagaccgctcagcacccaccttccagggctgtccccaactgtaacacacacaggatggagtcgggtaggtcagggctggcactgagaggaggtgccaatgatgcagctctcgggtgggggggaatggcttcctgggcagagggagcggccaggccagaggtcctgaggcaggaacgagcttgtgatatttgaggcacagaaatgaggccagtgtggctggggtgaaggagcaagggcaagggaggtgtgaaatggagttagaagatgaggggacccacgggaggatttaggattcaggatttattctgagtgtcctggaaaccatgggagggcttgaatcgggggagacctgctttacatttttaaagggctcatttggcagctgtgttagcagataggaaatgtcagtgtagggggcaagagtggtcttggaaaatgaagagggctgggagggctgtccaggtgagaggatggctgctcaaaagctttaaggtaggcatgatttgccctgaattttctttctttcttttttgatcagcagttgaacatgggtaacttttacttcataataataacataagcagcagtcatgtctgaaacacaatagtatcggctaacacttcctggacacttactgtgggccaggtactgtatgaacactttaacctgctccgtttccgacctgggccagttcacccctccttaggcaacctggtggtcccccgctcccgggaggtcaccatattgatgctgaacttagtgtggacacccgatcagcatagcacactacagcctagaactcctggactcaagtgatcctccagcctcagcctcccaagtagctgggaactacaggcacgtgccaccacgcccggcgtttgggaacactttaaaacaaatgattcatcccagcctctatgcggaaaacactatggatatacccattttatagttgagtaaaatgaggctcagaggcgaagtgccttgcctgggtcacccgccgtcatcctccggaagaccattccctcctgtatgttggtccagggcatccccagcccatcacacctctgggctcagggcttggcccccagggacatgctggaaacagccccagcctagaagcccatccggccgtaactgtgtttatttgcccaagcacagaaggacccactatttattgctttcttttgaaaactagctgagcctttgtgcaaaaaccaggcaggcacatcatcagtggcttaagcttgcaaaaagcacagacaagaaatttaaaaagaaaaatctttaaagctttgccctaaagatggttccaatgctgccttccggtgacctccctgagtcctgctctgagcctctgatgtccaaatgcagctgaggcatgggctcaagtctgctacctgggtcagccctgggggcgtgacattgtagttagccattttcccctctgagcctcagtttccccatctgtgagataggacccctagggctgccaggattctgggagtcagtgcactggcctggtacagtgtcagttcccagtaaatgtggcctgttattatgtttactgttgtgactatttattgtttatgcaccagttttaccaaaatgggcccatgacatcctgtgacttttcttgtaatcagtgtgggcttatggcgtcactgcgggatgggggctgctctcctggatgataagccatgatggacgcactcagtcccatccgacacatgtgtgtgtccccttttcactcctctgcaccacccttgtgcctgcgtctttgcggagttgcacagttattgtctcagggtcacttcctggaggcctgttttctatttttgtgcaaattgcaccaggaacctttgaacataccaagacccaggagaagggagggaaggtaggagcaagttcagggaacagcccggacatgggatcacctctcacagctgccctgtgagccgcagctgatttgctgctggagggcatgggtgatgctgggctgttgtggacatgggactgtgcattcagacacacccagcctgtttgtccccctgtaatgtgggcagatgaggggataggtgcttggggagggaaagaaaggctgcggtttagggaggcctccacctggagtcttgcaagctgctggggctttggggtggtggtcctagggtcagagcagacacccggcaggaggaaagcccatggttgctgtggagacgcagagccagccggggctgtaggaaaacagccgaggcaagagggacacctcttgggtgccagcgggttaagctgaggctgacggtggcctccggtcatctggtgtggactcctctgctcttcccagctgtgcccggccaggaggggcagccccaagggggtgcgggtgtagctctcaccctggccggcctccctggactctttaaaatcaaacctgaccttgttccctcgcctgctggttcccgtgtaccttgaacatcatctccttggaacagctctgtaaccaacactgaggtcagggcaggcctgggcttggggatggggtcccgtttgtgtttgggcctcagctgagcactgaggatataaagtaggaacaagacttgaaagctctgatgccagggcctgagatcccagccagctgtgcgggcggggagccggagaaggttctggagctgggatctgacgtgccgttcctcttccagctccagccagagcagctggactgtggagctgctcacctgcagcacccgctgtccatcctgcagcccctgaaggccacgcccgtgttccgcgccccgggcctcacctccgtggccgtggccagcgtcaacaactacacagcggtcttcctgggcacggtcaacgggaggcttctcaaggtaggtatggttggggatgtggggagggggtgggggtgggaggctcccctgggagttggctgagggggtcagtctgtacacagggctgctacaggtccagcctgaccctttgttttctcccattcgcctagcactttacagtttacaaagtattttgcaagtctgtttttgccactattgctcataatataggtggcgtccgtacagaggagggaaaccagggctcagagagggtgattctctcagaggctctaggactggggctttgaaactgtatggctctgagttcaaatgtctgggctctgccatttgctggccctttgaccttgggcaacacatattctctctccaggcctcagtttccctgtcaagggctgtaagctgttgtggggctttggcagggtaaggccatggcctggtgagcaggaatgctcattcatttctcctccccagccctgccagccaccccgtcccagggtgactggtgtctagagttaactgtaccccagcccgtggccccgagattcctggagctgggaggagatgcgcagaatccagtttccctgctctggggcaggacagacatggcggagcctgggccagacccccaggtgcagccctggacctgcccccaacccagccatctctcctgctccctcttgggagactaagctaagcgccaccactctattcatgcaccaggcccggcctaactgctcagatctgatcacccaagtcccccccaacccactgcctgggcagacgctgtgggctgggtgggcgtggggagtggagtcccaggaccccaccgctgtggctggggagaggaaaaatgtggggctcgtcaatggggctcgtggtttggggtcagatactcacttcggagtctggctctgctgcttccagcttggtgacttggggccagtttcttctcccctgcgagcctcagtgtcctggcttgggaacatgagccaggcccctcccccacccccgacacccatgaggctgcagttgttaggcgcctactgtctacccagagcctaaagggcatcctctcacttaattctcacacccctgcaagggaggcagaggcacgattctcatgccacagatgagaacgttgaggctctgagaggggaaatgattgccccagagtcgcacagcaggagctggcccacagcccacaccccgccacagcctggagcccctcacctaccaccctgcacagtgtggcctctgtctccagccaaccctgccctgctcgggccttaaatcgccacacccagcacaggccctggggcacagtagttgctcaataaatgattgaaggagtggaaatgacttgagtgtccactggacgcctggacataggggtgggtgcgggcagtggcctgagcccctgcaaggctccgccaagaggccacgtgggacaggagtgtctcaggctgggacaaagcccatggaagcctggggagaaggtaattttgagttggtgtgtagaggcttctgggcctcatgtgtgcattggtagaaggggaacaggaaggaatattccagaggagagcacagcataggcaaatgcctggaggctggaatgtgtgagcagggttgagggggtggagataaagctggggttgtccgggttagatcaccaggaccttgagtgccagaacaggttcattccataagcagaagggagccatgaagggtttgggagccccaggaggaaggctggggcagaaactggcctgggaggtgtccggaccactggccccatctcaaaatgcccagcctggggcctggcagggcccagacaagacaacacactgggaacaggcagggccaggcaaaaaagagcagagtttggtggggctctgaccggtattgtcatcctcaggaggacacgcagagggtccctcagagccagagaagcttccaggccccagataatcctggtcttcctcctccctgcaccttggttccacacccctagccttaagccttggactgtggggtcaggcaggcctggtattgcattgtagccttgtgatctcttcactttgtgcctcttgccaactccctcggccgctcccagcctcagattcctcttcggtgaaatgggcgtcggggggaggaatgagacgtgcagcctagcagcttccccgggcctgaccccatcagcctggcctgtgtcttatttaatgctcatggcccgcctgccccattagctcaggaaacaggctcagagaggggaggcagcttgtacaacttacacattgtagagctcctcagtgtcaaagccagaatccaaacccaagcccctgcccttagccatggtgcctaacagcctcccagagcacgtttcgtaaactacaaagcctgcacacgttcacagggcgggatgccttggagacgagcccagaaggagctcctggtgggggcacagcagaggcagaagcatcaaggcccggccctgtgccctcccctgcacgcccgtgacttcccacccctcctgaagggtccaagacaggatggggaggcagagcccccagacccgggctcaggttgtcccctgggtttggcctcccctgctatgggctccagcaccctgatgcccactacccccacagatcaacctgaacgagagcatgcaggtggtgagcaggcgggtggtgactgtggcctatggggagcccgtgcaccatgtcatgcagtttgacccagcagactccggttacctttacctgatgacgtcccaccaggtgaggccagagccccagcccaacgccatcccagcaccagccgagccctcttgcttgcctggcctttacacacgctgttcctctgctgggagcaccctcctcctccatctcccttatctgctaactccaccttgtcctgcgcctcccaacaccgaccttgcctctgcagggaagccttgtctcccatgttcccccattagagtgttgaccctcagtttccccagcctctcatggcccgcaccatgctgaccgtaccacctaccccaagggagaggctggcagtcccattgagctgggcccccacctctgcccccagatggccagggtgaaggtcgccgcctgcaacgtgcactccacctgtggggactgcgtgggtgcggcggacgcctactgcggctggtgtgccctggagacgcggtgaggctggacaccagcaacagctggaccaggagggctgtgggggtgggaggagctgacctgggtcctgaccctgcggtgccaccccaggtgcaccttgcagcaggactgcaccaattccagccagcagcatttctggaccagtgccagcgagggccccagccgctgtcctgccatgaccgtcctgccttccgagatcgatgtgcgccaggagtacccagtgagtcctgggggaggcaagacccagctcgggacacaggggagcctcccttcacccagcacccaggccccgagaggtggagactcccacccatggtgccccaaggacctgaagacaaataatgagaacagtgacaatgactgggctttcctgaccaactagtaagtgccaggcacgtgctctgtgcttgacgtccacctccgttaggccttacacaccctatgaagcagatgcttttgacatcctcattttacagatggggaaactgaggcaccaagtggtgaaacgacttgctgcaggtcgcacagctagggagtggtagagctggaatctaaactcaagaggcgggttctagagacccaggagggagggtacaagttggaggcttggaggacagtgagttccacccaccttttcccagaacaggggatggagggagggaccaccaggtgccagactgaaatttctccttctcagaaacagataaacctgcaatgcagggggctgggtctcccccggcttgtgccaggagggctctggcaggcagccttggcggtgggggattctgggccccggcaaggggtgggagccgagggtcagacaggcctggggttcatgcatctggctctcagtgacttctctgaggatgagggtcctcttctctcaccctggggggctctgacagcccggctctggcctgtagctgctcagcatctggggctcctctgccctgccctgccgttatcacacatcacagagtccttccctcattcattcagtcatttcatttattggacaaatattatggaacacgtactatgtgccaagcacagttctggactctggggacacatcagtaatcaagacagacccctggccccaggctcatgggggaggagaataggcaagataaaacctgaaggtgatgctaagtactgtggagaaaatgaaagcagaacaggggtggggagcgggttgtgggtgcagacatctcaggccaggtcaggtaagatatgcaggaggggagccagggtgagcatctggaaagagcgtctgggtggagggaactgccagtgcaaaggccctgaggtagaaacaagatcagctgtttcggagagtattaggggatggggtcagaggtcacaggggccagatcatgcagagccttcttgaccactgtaagatgatgtttcattttgcagctggggaaactgaggctcagagggtcacatgtagggcatagccctctggccctgagtcctggccaccactaccccttcccccaggggacattcaggcagtgccagaccttgggttggtgcacagccctggggcaggctgtgaggagcatagcctggacccccagagctgagggctccttgcccccagggcatgatcctgcagatctcgggcagcctgcccagcctcagtggcatggagatggcctgtgactatgggaacaacatccgcactgtggctcgggtcccaggccctgcctttggtcaccagattgcctactgcaacctcctgccgagggaccagtttccgcccttcccccccaaccagggtaagcacgctgtgctgttggcacagccccggaggggcagaacggtggactgtcaggcatggggatggcagggggccagaggtcacagcttctgatgttggtggcaatcccctgcccccatgtcctcccctggctcccccatccattccagaccacgtgactgttgagatgtctgtgagggtcaatgggcggaacatcgtcaaggccaatttcaccatctacgactgcagccgcactgcacaagtgtacccccacacagcgtgagtggcttgggtggcttgcctccagttggtggagggaggaacgcatccccgggaagggtctttgctttcagggggccctgagaagaaaaatcatagcatcgtagaggtagacaggcccttcagttgttcattcaccagcacatttattcattctacaataaatgcatactgcctgatgcctggcctctgtggacagccaggtgggacggggcaaagtgctttgattatactcagtttagtcttctaaaggccctgtctcttttaactcctatttgtatacctcttgttagcaggcagctcactaccttaaagacccaatctttcccaggcagccccgatgatgagaaagacctttccctgtgctgggatctgccttttgggttctagttcctgggacagggatgagttgaggggtggggaaccaggagttgaggggcctccttgtcttccagctgtaccagctgcctgtcggcacagtggccctgtttctggtgcagccagcagcactcctgtgtttccaaccagtctcggtgcgaggcctcaccaaaccccacggtaagccaggctagggggcccctccgcctctgctgtttcattaccttttttaaaaaattcacatgttgagaatgtttcaatgcctttgcatattccgccttagctttggctttgacagctatatggggctcatcacataccacggtgcgtttaacccatgccctatagttggacatactaattatttcctcttttttgcattttgatatagccagggcactatgcatatccttgatgattccctgaagaccgcttcttagaaatgacctgttgggctggtagtgtggccatagttctacaccttgagctcagctgccttccagaaagcctgagccagtttatacccccactgcagtaggaagaccatttcaacaaccctaggtgttcagggcatttgtcctcaaggcctgtggaggtgattcgcttaaggtcatcgactcaggcagtaccagacttgggccttaacccaagtccctctgcccctggagcccatattctcccctcctgtgaaaatcaggaactgggtggaaagggccctgcctgggtttctgcacgagcagtggcgtcccaagggtgggtggtgctgcagctgtccctggacagggaggatgggctggcctcagaaaccacacgctcccaggtcctcatgtcagtccctaggaccctgcagtctgactccatgcttgtcaggggccaggcctgccccagcactgcatggtggttgggtttaatcaactaaatggggtgggagcaagaggaggaaatgtaaaaatggatcaatctaggctttttagtgtaaagataaagtaaaaatggacatgccacatacctcgcccctggttggtttctgagacttgttcactttccaggtggcctctcacctttgcccaggaagcctctaaggccaccgcagcccgtgccaggatggccaaatgggatgcctgggaccttggctggggtgataaggcctagccaggtgggatgtgccagggtcctgagatcacagctcgtcccctctcagacctggcgcgtatcagggctgtgggtggctggggtagggcaccagccttcctgcagctcatctctccaggcaaaggctggtcctgcccatattccagatggcacaactgagataaccagcatggcacctggtgccctggctccctgcagaaggtcactggggcccctttctgggcacacatcccggggaagcagccccagcgcccagagcctctgcagccccagcctttttgcactgagctcagagaatcttctcaggaatccctgaagccctgtctaccccggcagttgctaaggagggggccccatggcctcagcctggaatcccctgctcgctcgcagtgcgcagcacctcccacctgagccccataactgctttgaagaagagcctggcaggggccatgcttaattctattcgaagaggggcttggcagcagggggcttccagcactggaggagagcccagtggagtcggtgcagtgaaaccatacgggagccctgagctgctcctggacccccagattccacagttgggaccccactaggactcctgctcctgtctggggaccccatctcaatcacgtctcttccttccagctcccagcccagggttgtgtacacagcaggggctcggttatggtggtgggaagcatcacactgggcagcagcctgcttcttgtgcgctaacctaggggatgcgaggaggacccagcctcgtcacagtccgttcagcatttattgagtgcctgctgtatgccttagtcagtactgggccctgggaaagaaccgagttggactagtcctgccatcacgagccaagagcctcaggtgtgagctgtggctgtatgatcttagggaagctactgaatctctctgtgcctctgtttccccatctataaaatgggacctgcctgaagggtttggtggggatctggaattatgcccgtaagataccaactctatacttggcacatagtagatgctcactacaaagccaccatgcaccttgggaactgatggccactctctgtgggtgggccagagtgaggatttcagagagaggatttcagagagaggatttctcttgagaggggaccttcgtgctgggtcttgagagatgcataggagctcaccagctgggagggagttccatggcagcgtcctgtcagatggctgtcccccaggtctgcagttcttcaggccaggagctggggtggaggcacagaggaagcctgtctgagaattacagtaactagccgaagaggcagctctgccccgggcgtgcaggaggctctgaactgatgtttaatttggcatttaatgaagtgccagttagtcgtagtggtgccgtggtctctgtgtgaacagcaggcagcaggcagcgggatctgcacaccacgtggcccctcgggagccgggagaagtgtccctgggaagggaggtgctagggcctgagtctcctgtcacgttcccattgtccctcatggtccccgcgtgaaagatgtgcgaagtggaggatgctggaaggagggcttcagctttaggggaggctgggaggaaggtggatgtgtgccccgtttgcaggtgcctgagggatgaggtagcttccctgggggtggcttcccaaggaccactcataggtgtaggtggtcactacgggccagtggagagagtggggtggtaggaacatgggggcaattgtgggggtccctgggggtacagagacgtagggagggaccaggtggattcagggtccctgggttgttgagtgccttgatggtttgggacaccagttcttcccctggagtttaggagaggccctgtgagagccgcgaggactcctccagcctcggttctctagaatgggggtgagcatccacctggccacaggttacaagtggctaaggggagtggggtggccctcggggatggtcacacatcattcactgtgggggccctcttgtgagagcgcctcctgccctgactctcacacctcagccccacatcaacacctacccaccgggtgggctggggccaggaggacagaggctgggccccagccagccgcaaagcagacctggcagtggcttcgaggcctgagtggaaacatggattccatgccctcggattccgtggggtttacacacagcacaggatggcagcctgcggtctgcagggggcccgccgctgactccgtctgggcccctccttggtaggaacacggaggcccggagagggtcagtggctcgtgtattctggcacagggagccagcagcacccgggcctggctatgctgcttctcttgccaagcccctgaggtctgcaccagaccctgtccctaggggaactcaccactctggtctcgtggtcagcaaatggtctggacaactggagcattcctgtgttgctcattccactgtaggcaaactgctttgcttctgtgtgcctcagtttcctattctgtaaagtgggtgtaatgatagtatctacctcctagggttgttgggagtagaatttggtaaattaaaagagtgcaaagtgctcagaacggtcccagcagagggagggctagatgagctggtgactgccactgttattagcattatcgtcatcagttcttgttgttggcattggcatcccctcgaggtccggttttgggctggggtccctgaggggaatcagtccctgtcctgctctcatctggtgtagaataaagaagcgtctcatattttgtcccaaggcctttggcctggctgggtgacctcacgtggacacacgtggcccatggacgcttttgctttctggcctgattctaacccagatccttctgcaaccagccttgggaaggagggcagagtaggaagtccctgagctgaagggtggttgtagtccccttggcatgggtgtggctgctccaaggtccccagtcctgccctgctcatggtcccagcaggtcagattcgggagcaggaggaggcaggaatggctcactggggccaccaaagctggagaacacagggcaggttggggggtccatacctcccagctcagagcgatcactaaggtggacatggcgggaacagccctgcctctggtctctgcccctcccccaggcctcagtttcttattctgtacagtggagcatggatcccaggagcctggagacagcagttcccaaccaggccttgaatccctgcagcggggctagacctctgcatcttaacacgcgccccagctcggaggaccccagagtcaagacacctggggcttcaggggccagccctgtcctccgccctcaggcagctcactgctcttggaggctcaatctcccctccctcccttccatccttcatccctccttccttctttccttccctccctcctccctccttctttcgttccatgaagcagctgctctgccaggcctcagtgactccaccaccaaacaagagccaaccatgtgctgtccccccatgagcccggggcccttcctgggagtatctggggctggcaccttcacctagaggctgtgacttatacccgggctgtggggaggggtgtcccctggagaccggtggtatctggccctctgaaatgtcctcctggtattcagagccctccctgtgcctttcctatgggctgtttggaagcccaaggtttctcttttctgaatcgcttaacacgggtcagtcaggaagctggagtttcagccctgggggcatctcagggagtgggtgcagcccccctgttctactattgggaaaggtgaggcccagagacagggaggagctgggcctggagttcagcctcccagcctcgtctgaggccagggagcactcatggaggaaattggccccaccactgggcgggttatgccatctgcctgtgcccaccttcctcatctttaaacagggccaatgcgacctgcccataggatggagggtggtggcgagtgggaggcacggggtggggctggtggccgttaggactgaatgactagtgttttctcctcaggaaggcaggactgaaccaggcaggctggggtgcagtgagtcctcctgcctcttctctgaaatgcccctgtgtcaccctctccttctgtttcctctgcagagccctcaggactgcccccggaccctgctctcacccctggcacccgtgcctacgggtggctcccagaacatcctggtgcctctggccaacactgcctttttccaggtaagtagaagccaggccagcgccgggtggggccaggaggaggccggggagcacgcaggccactaactgcccccatgtcctggtgtgacccctgctctgggcccactgcagtgctttcgcacctgtgtgggctttgcttttctttctctgagtttccacgttctgcatgaggaagccccactctgactgcacggggctgcaagaagaggaagtggtgagggccaggccaagggggacagctgggggccaacagctgccaagggaaagccagtgcccccaggctctcctgccccgtgccacagccggagggtggacgctgccctatcctgtcctcccttagcctgagctgtgaccctggacacacccacccaccgccgagcccactgccccgtgggtggcttccatgtcttccctgcagaatgaccagagaaccccttggccaccccattccccattgtccagatggggaagatgaggcccaggaaggaaaagtagatgacgccagatcacacaacacagggctggacttgtgcttagctctggactccccaaccagtgctcgtctttgcaactagccccgcccccaccatctgggctgggggttggggacgcagctcctttctggacccctcctggaggcgcgtcctgggtgggaagcgttgacgagtcctggaggcgtgccagccacccccctccccacctccctggaactcgccatctgttacttccatggaggagctgaggcccgtgagagctgtcacacgtggtggccacgtgccgggcatctgggatgtgtcgggaagcctcgtggcaggggctggagctctgggagggctagggtggggcctgccctcagccctcaagccccaccctgcaggagttggggcaagcgcctccaggatcagccagggggctgggtgggtgggcaggatggctctgcccctgggccgtgggcgcctgggatggggaggtgtgagcctgacttgagtcctgccgattcttcccagctgtgtggtggggcagcctccactctgaccgagctgcaggggcgcctgccctcctgctccccagggcctgctcctagaacactgaagtcaggcccagcggtgggggcctgtttgctgagcctacaccctggggagctctgggacgggccgggtgtgctgttctgaggtggctgaggactaagaggagggacccatctccagctcagcatggcaggggacaaaacgggcttttggccccgtcagcagccactttcctgtgttagcttccgggctgggaccccagaagcagggaggttgacctgcattctcctcagggtgtcacatctgccagccacagggacataaacaggaagctctgccacgcagctggctgggtgcttggcgtaatacacaaaacctgagtctgtttactcagcaaatatgtattggtgctgctcctgagaaggccagatgagcctggggaactgagcctcatgacacaaacattattggatacctcctgcatactaatgatagcaagcacatattaggcccctaccgtgtgcggccccttgaggtacacaatctccagttttcccagcaaccctattcccattgtccaggtaggaaaaccaagcctcagagaaggggtcaacttgcatgaggtcacatagctgggacatgcagaggtggggtttgaacccaggccagggctcttccagctgctttctgctgcccttgggggtggtgtcagagcggccgagccctgaccgtccccggttggcgaggggacaggtaagcagccaggcaagaggctaagggtgatgcctggcacacagggatgggggcagctctaggagcttcgtagtgccccagcagacacctgaatagttgctgctgagggaatgaatgaggatcaagtgaggcacacccctttgatttgagggcagcatctgggaaggcttcagaacagggggcttttaagctggatcctgaaggctgtgttgagctttgctgggtggtagaaaggaagacaggtgttcaggcgaggggagggctcaggcaaaggccggggcaggagagtctggccgtgttgggcgttggggcacgtctgagcagggcctggtagggcaggatgggaggtgggaaggctcgaagagcaggggaaccccgctgggagtggagccttaggagctgaatacaaggcccctgggttagatcactggggatgctggagaggcttttagtggtgctgagcgcatgaggccaaagttcttggcattcctgcactgcttgcctccctcaaacattggacgtgatggccaggaaggggattttgggggacgggacagcccatgcaaaggcctgacagttcgaccaagcccacctttcccagcaggagcccgtggtgtcctgctggagttagagggcaatgcatgctggcttggttctcctcaaacccgcctcccactccctgtttcccacagggtgcagccctggagtgtagttttgggctggaggagatcttcgaggctgtgtgggtgaatgagtctgttgtacgctgtgaccaggtggtggtgagtggggtgactccagcatgggcggagggcgggcctgcgttaagtccagatgctgtacccctcaccccaccctgcctctctctaccttctggttcccccatccccagcagccccaacttcatctgcctccatgacacccatccccagcagagccccaggcattgcccatgccccctatgctcttttctgcccttttgcagctgcacacgacccggaagagccaggtgttcccgctcagcctccaactaaaggggcggccagcccgattcctggacagccctgagcccatgacaggtgggcacccccacccgccccacatggcctcggggcctcagtgcagtgggtggggctcagccttgtgcgactcattccagtggttgccccaaagccgcagatgtcccaccccattgttctccagcacacacacagcctcatatcccagccctgccatgccatgccaggctccaggccttggggtctccgtgcatagtttcccctgccttcctgggcctgatcgtccccataggaaacaggacacagtccctctgcagagcttgtaaggacctgatgagccagggctcgcccaaccttgagcgtggcatctggggtgtggtcagctcccctcgcgtggcagctgtgcagttgctgtgactgtctgtgttgggtccactctccaggggctcctctgttcatggggagtctcaggcatccctggtggacgtggtgccctccagattcccaccatgaaggtcccagaacggccctgcatacccaaggtcctggagaaccctccctgccctcctctttgggctacttggagggtttgaagccccaaagtactcatagtccacattactcagggatccccagcatcctagggccccgccggggttgatcagacccactgaggtctgggtgggatctggctttaccacccacaggcctcgtgagctcaggcgagtccctcctgtctgagcgtcagcctcttctctgtaaagtgaggctgacctgaggctcccagctggagtctctgtgaggggaaggaaatcaatgaagcaggggctgcactgtgctcagcacaggccccaggggtttggggaaggggctaagaacctcaggggatcctgacccccagaatcaggacttcctctgggtggggcaccacaatgatggggcgcagacctcttgacagttgttgtgtgtggagggcacagcggtgttggggcatgcaccgcagagcggggctgaccgagctgccccgtgtctccccagtcatggtctataactgtgccatgggcagccccgactgttcccagtgcctgggccgcgaagacctgggtcacctgtgcatgtggagtgatggctgccgcctgcgggggcctctgcagcccatggctggcacctgccccgcccccgagatccgcgcggtaagcatgcccagtggaggcacgtggcacccgcactccggcacggcgcatgcgcagtgccctcgagggtccgacttcttggggacccaaacggcacatacaccgacacatgggtgcagtatcacctgtgaacaaaaggaagtgctctgcctcacagagctgatgtttcagtgggggaggtggacagtaataaataaggaaatgaataaattatagaaggcattggaagtgtggcgtggaggagacaccgagggctgaatgttgttagtttcaggggataccatgatcactaaagccaccaatgacatggccaaacattgctcctggaagctgacctcagcatcctccaggagaccccctaagtagcgtccccaggcccacgtgggctcagtaatgcacacccacatcctccttgccagcacagtgacctgccaagtggccacagtcccagccccacctgagcctccagaccttcctctaagcagtgggtctgcacggctgtgccctgctgggtgcctgtgactgtgggcagaagcctgctggcctgcagcctcagatcccattcgcccctctctcgggtcacctggcagattgagcccctgagtggcccgttggacggtgggaccctgctgaccatccgaggaaggaacctgggccggcggctcagtgacgtggcccacggcgtgtggattggtggtgtggcctgtgagccactgcctgacagatacacggtgtcggaggagtgagtagccacggtgcccccacctaccttctccagcagtgccagcctctgctctgtcctcctcactcctccctccccatcctctgtcctcactctgctgctttctggaagactgttgcttcgtggcctccaggcctgtgccgaagccattcccaccacacatcctgccgtttctgcttggggcatctgctttatccctccagctctggctctgatgcccactcctctgggaagccctcacaggctgccctagcacagcccttcttccacctaagccttgctctgaggaaaatcatttgcaattaaaaaggctggggctactggcatggtttagagatctgtgactggcccagaggggccgtaggaaatacgcgtgagcagagactgaactggctttccttttgggaggccgtgcatcaggcgtgtggaagagccgtcatctaccagcccagcagacgttctcatgatcagagacccttttgtcccacccccgtgtcttatagttgcagaactgtgggaaactgatggggtaaattatacatagaaggcattggaagtgtggcatggcgtggaatggggcgatccctgagcctggctctagggtggccgtgggggccaaggaccgctggctgaccacagcacctcccctcaggatcgtgtgtgtcacagggccagccccaggaccactctcaggtgtggtgaccgtgaacgcctctaaggagggcaagtcccgggaccgcttctcctacgtggtaagggggggctgcagcccactgtccggcccgcccagcacgcacactcccgggggctggcccgaggcccaaacgcctgccttcctcccacagctgcccctggtccactccctggagcctaccatgggccccaaggccgggggcaccaggatcaccatccatgggaatgacctccatgtaggctccgagctccaggtcctggtgaacgacacagacccctgcacggagctgatgtaagcctctgggcctggcccatcccttccagcccagagaaatcaatgggcttgggggctggcgggctggaggtgacatccttgagccaagcctctcttgggtcttcattggctgtgtcccctaagccaagccccttctcctctctgagcctcagtttcctcagctggtaagaatagtaccagtaattggaagaagggctttgtgccaggtatacagtagttgctccataagtgatagctgtaatgagaatggtgttgattgcacacacacagatcttctggctggcccaggggtgtggtgagtggcaggggtgtggttggagtctgttggcgaaacacctttgtctttattatgcacttattgtgtaccagaccccactaatgggcattgctgggacaccaagaggagcacaacatagacctcaagggaagggcagacatacccacgggaagtaggaacatccagtggggctaggattgggagaaaagtcagtgccttcagggatctggggagagagacttcaccagggttggaggcgggagagaagacctgggaaggcttcctggaggaggtgggatggggcggaatttggaagtgtaaggaaacagctgggcactaactgggcagaagatgagttgggaccagtcaaggaggccttgaaccccaggccaagtgcgtggacttgtgccccaggtctcaggggcattggcggtgggtgagcagcagaaggcaggccctgctgataacctgctgctccccccaggcgcacagataccagcatcgcctgcaccatgcctgagggggccctgccggctccggtgcctgtgtgtgtgcgcttcgagcgtcggggctgcgtgcacggcaacctcaccttctggtacatgcagaacccggtcatcacggccatcagtccccgccgcagccctgtcaggtgagactggcaccccgcccttcccccaggctctctggggctgcaggtgcactgataggttttgctgtcccccgcagtggcggcaggaccatcacagtggctggtgagcgtttccacatggtgcagaatgtgtccatggccgtccaccacattggccgggagcccacggtgaggcattcgggggcctgatgggtgggagggggtggcccaggcacagccagggccctaactgaccaggcctcctcccactgcatctctgtcccctcttcctccctctgcctctgtgtctcctcaaaccccactccccaccgtttctccatgcccatctgtccatcctgcatcccggcctgggcccctggctctcctgcaccagctctgcaaggttctcaactccaccctcatcacctgcccgtcccccggggccctgagcaacgcatcagcgccagtggacttcttcatcaatgggcgggcctacgcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacgtgagcaccaaaggggccggggtaggcgggggcaagcgagccagcctcagctgtgggcctcgggagcacttccccatgagcatcctccccctttgcacccacagaaggagcaggacagcctggggctccagagtcacgagtaccgggtcaagataggccaagtaagctgcgacatccagattgtctctgacagaatcatccactgctcggtcaacgagtccctgggcgcggccgtggggcagctgcccatcacagtgagtggatggggcgccggagcagggcagacctggccccacccctggcccatctgccaagcatctgcccctcacccagcacctgaattcactgagcgttttcacgctcaacagctcagtccagcaaagcagagctttacatccccacttgacatatgaggaaactgaggcccaagaacttagtgacttgcttgaggtcagtgatgggccccatctggacctggaccatcagaaaccataagaaattgtccctgtcccccttggcgtctatcctagagcctgggctgccaggcaccatgtagaggcaggggagcaggaggagcagagaggggccagaacactatctccttgcatgtctcctgggatggggagctcactctctcccaagcagcgtgtgccaccccaggatggctctgactgggaaagctttctttcacctgcacctcagtcccagtcctgcactctgagtcctcatacctcacctaccccctggtcccagggcagccttgcagatacttggggacagcagccaggccccgtgaactgcttcctcttgctcactcactactcctcccaggctgtaatgataatcacagccccctgcattgagccacctctgtgccaggcccaggaccaagggcttgacaagccctcatttagccttcccagtgtccccaggaggtggacattgttatctctatgttatcagtgtggcacctgaggctcagagaggttaggtaatttacccagggccacacagcaagtgaggagcagaactagagtataagtccaggaaagctacaacccccttccccaacctctgcacagatccaggtagggaacttcaaccagaccatcgccacactgcagctggggggcagcgagacggccatcatcgtgtccatcgtcatctgcagcgtcctgctgctgctctccgtggtgggtaaggagccccaccctcaggacaccttggagggcaggcttgccaccttgccccagcccctctgaagattggcagatgggagaaggcaggatgggatggggcacagcttgaacaaaggcttggccatgggaacaggttaggcacccagaggttgggggaggtgtgccctggctccagcaccaatgggtagaagatgttaggtggccaggggatatgctaggcccacgcccaggtccctgaatctcaagcagagaaatttggaaccatgttctccagtcaatagagagctactgaaggtacttaagagaggattactcaggaaaaattaacctacatgtctggtgggctataccactgttaaaataatggtcaataaagtaatagactcgatgtagcagagaaactggagccatcatacgctactagagggaatacaaaaaagcgcagctgctttggaaaacattttggaagtttcttaggatgtgaaacatagaattaccctatgacctatgacccagcaattccacccctagctatctgctcaagagaaatgaaaacgtagccacacaaaaacttgtacacacatgtttatagcaacattatttataataaccaggaagtcaaaacaacccaaatgtccatcaaccaataaatgaataaatgaaatatgatctattcatacaatggaaaattatttatccgtaagaaggagtggagtactgatccatgccaccatgggcaggcaccttgacaatattacactaaccaaaagaagactcaccaaaggcatattgtatgatgccatttatatgaaatgtttagaatagggaaattcatagagacagaaagctgaatggtgattgccagggactagggagaacacgaatggggagtgactgctgcatgggtatgggtcttcttggggcagcaaaaatgctctaaaattagtggtgatggttgcacaactctgtgaatatactagaaaccattgaattaggccaggctcagtggcttatgcctgtagtcccagcactttgggaggccaaggtgggtggctcacttgagcccaggagttcaagaccagcttgggcaacatggcaaaactttatctctacaaaaaatacaaaaattacctgggcatggtggcatgagtctgtagtcccagctactcaggaggctgaggtgggaggatcacctgagcctgggaggtggaggctgcagtgagatgtgatcgcgccactgtacttcagcctgggtgccagagtaagactgtctcaaaagaaaaaaagaaagaaaagaaaccattgaagtatacactttaaatcactggattatatggtatgtacgttatttcacaataaagctgttttatttttaaagtgagtatattcaatgcagaaaatttttggaaaaactgaaagatgataaaaggaaaaaatacccatcattaataccctgtgtatttttgtatcttccctcccagtctcttttctgaaaatactatatattaatagatattttaatacattatgtatatattcctccccaccccaggaaaggttataatgtaatattgctttgtaatctgcttttaaaagtttcttaatttacaagtaacacctggtcattgtagaaggaatagaaaatgctcaaaagcagaaagtaaaccgaagtcacccagaatcctcccacccaggaaagccactgttaaccactatttcacacacacgtattcctgtttctttttttttttaacggggctagacaaattctaacagagctgtaacactacacacttctttttctaaggacgggtcatcaggcattgctttgctggccattccccaagccctctgtccacgggagagctccccgcaactccccaccccccaccccaaccctgcccaggagggaggactgcagggcctcctcccacaccctgcccagaggagctggagcggaggccagaatacagcaggcgccaataaaggctttccaaagggcaccagaggcctgacctgcctctccactgcccgcagccctgttcgtcttctgtaccaagagccgacgtgctgagcgttactggcagaagacgctgctgcagatggaggagatggaatctcagatccgagaggaaatccgcaaaggtagtgggcggggaccctgcagggctgggcctcaactttccctcctaggggatgggttctcgggccgctcacggctgtccgtgtgtccgccaggcttcgctgagctgcagacagacatgacagatctcaccaaggagctgaaccgcagccagggcatccccttcctggagtataagcacttcgtgacccgcaccttcttccccaaggtcagcccgagcctgagcctgccctgaacctgtgccagccacctcaaggcaactcgacctctctgagccctgccagcctatagggtcccttgagcagtgccaaacctgcacagctgtccgcagccgtcctggccacttgccctggcctgccacggggagaagggttggaggcagattctccactgtcattctctgctcacttgatgtttaacagtccatatggaagccagctgcagccccgctgtcctggccagctgggcctgcctctccccttttcaaggtggggcagaagcggccagggctgtcccaggccagcctctctccttcctgtgcctcttcccagccaggcttcccttggtctctacactccctcctcctgtccactggactcctgccccatcccttccatgcctctcatgcctccccttgcccttccagggtccactaccctcactctacctcctagtggtaccaccctctctcccctgtccacaccattccccacacagtggccaaagcaagcccatgtttgactacatcatttttcacgaaaccctccagtagcttttcccagcctcaggctaaagctcagactcccagcctttctgcctcagtttcccccattgcacatggagctgcttttgcttccccttaagtcttgtgctgtcttgtgtggccacacccctggaattccacagcccccaggcttggcccactgcctcttagtcctttatggggagctaattccgtgccagtttcccccagcagcccaagccagtgcccctttctgtgtgagtgacctttccatgccagcagggggtgtccagccccgctgagatgctgggggtctgcctctgcagtgttcctccctttatgaagagcgttacgtgctgccctcccagaccctcaactcccagggcagctcccaggcacaggaaacccacccactgctgggagagtggaaggtgagtaccccacgacccacacacagtgggctgcttcagggcaaccctgctcccccctgggtcccctttccagttcatctaatgcattgatccctgtcatgcggagttgggaggcatctgccattgtaaggtactgagccctccatcccaggaggcattcaggcagccattcagggtattataagtgctgcccccgcaggccaggtagagcagacagaggattgggcccccctgtacaccccactcaacctgcttagaaaatggaaggtgagagtcctccacactgggatgccaggttacctccaggcacccttacccttctctgagccccacttttcaattcaaccaagctattgttccctgtcacaaaggttaggaggcatccaccgtggaaggtaatgagctccccatcccaggaggcatacaagcagccgtcgtaagcactggctgttaggctaggcagggacactgggcccctctggacaccccatcaccagttgcttccacagattcctgagagctgccggcccaacatggaagagggaattagcttgttctcctcactactcaacaacaagcacttcctcatcgtctttgtccacgcgctggagcagcagaaggactttgcggtgcgcgacaggtcaggctgtgacagactggggtggggtagggaagaggagcctgtccaaggccacacagcatcaggtcctgggtcctggggctctggggctcttgacacccccatattccagcccttcctgggccgggatgcccaagaccttggctcacggggcacgatggttgctgtggacgtagaagaaggtggctgtttctccaggaggattctagccccactcacccctcgcaggacccacccacacaggcactcctgggatcgatgggcccggggatgaggcggcactgagaccctgggacccacagctcctagggcctcaaggtgcagttgacacctgcctcccgctcacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggtgaggctgcctggggacagacagagcccaggcgggggacgtggcagggactcagcggcagtgaccccacggcctcccaggccttccctggcaccctcaggccagctctgccaggagggagtgttgcatgagacaggccaggcccgtaggacctgttatgcagagaggggagccatggccccggggaagcctggctggcttgctgcaagggctcaacggatgcttggggcataacagaggttgtgtcaggggccttgtcccatctgtggttttctcagtcatccacccttccctgctctggattcaggagatgaaatcagcccctggctggcccttgaggctctcccagccctaggctaggcgagacgtggaaacaaaatacagggtggccagtgcctcgcagcagagctcagctcacgaggcctccctctgtctgaaggcttcaaggtggcttcctggagcaggcaaccctgtgctgagacctaagagagtgagccaggcgaggagtggtggggagggtgctccaggcatcgggtacagcacaagggcagaggccgggaggaggggatgttcgtggaaggaatagaaggaaggccaaagaatcttctggatgagagcggaggctgggaagagggtgggcccggtaaccagggcctcctgcactctgccagaaggacccccataagctctcttcgcagagcaagggttgcttagcctcttgtcctgtcccactgtccagctgccctatggtggcagaggctagagggctgcctggaggattgtgggagaaaggcaaaggcctgcctggagcccagaaccggggcctcggatgttctgttttttgttattaatttttgaagagatgggggtcttgctttgttgcacaggctggtcccaaactcctgagctcaagcaatcctcccgctttggcctcccaaagtgctgggattacaggggtgagccactgcacccagccaagatgtcctgggcttgagtccaatctttggcacagcccagctgtgtgactctgggctactcattgccctctgtgggccttggtttccttctgtcaaatggggcctctgcccctgagcctggggcttgagggccaagtagcctgggggagccccacggctcctcctgggggaagggggtagtggggtggagcagaggcagggcctgggaggggccattggggtgcctccgccttctgcgggctgcctcactgtgggccatcaggaaccacaagggccactgtggaccctggacctcactcccctggcttctttctgtggcctcagccaggccttcccctatgagcctgtttcctcctctaggaagcagggaatcagtgcctcccacgccccagacctggagaattggaccaggacttgggctggcaggctgccttcgtaatctttgccaaatctgcctaatactattatgtacttaatttttctttaaatcaatttttgtggatagttaagtaaaactatcccagtggaacacctgggtcccttgctgggcaatggccttgagaatcagctcatggctgtgggtccagcagagccactgcctggagggccacccttggagatgggcaagagcagggacattgagccccattcctcctgagactccatagtcatcagcctgcaagtggggtcgaggccacatcggtgtttcgggtccacctaaactcacacttgggggccccccacttagtagaaagtcacaggcttgggagtcagccgagccaggtccgattcctgccctgccgcttcccagctgggtgatcttgggcaggtcacttgccctctctgagcctcggcactgttggctgcacagtaagaatgatactccgtatccggaagggttgccgggatgatgcaatgaatgcacccacccacagctggtggtgtttaatgaacacgagcttagggtccgtggagacaccctggagaggagagtgttgacaccaggatccaaaaggagactgttggaggggttgggggacgggggcgtgaaggtgtttggcccaaagcgtgggggctggaatacagagggggccttggccctgatacccccgtgcccctcaggagacggtgggggagccattcttcctgctgctgtgtgccatcaagcagcaaatcaacaagggctccatcgacgccatcacaggcaaggcccgctacacactcaatgaggagtggctgctgcgggagaacatcgaggccaagccccgggtaagtcggcagggcggggagggtcccagggctgctgtgtcgccgccaacggcattgacccagccttcctctgcagggccttgctgcctgggcactgacatagtgatggcagcaactcactgacctttctctcccactctccccctgcagaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttggtgggtgggaatgggggcagagaccccgtgtcaggcgcttcagccggggctggcccctgccttgacgggaaacactcctttcacctggcatgggtgcatgaatgtggggacactgagaggatccaatgaggccccctcagcaagaagctcttactctgtaggagacaagtcctgcagtgtgagtgaactacggacaacagcaaaaagccttcaggaaaggcttcctaattcctaaaggagggatgctggagtagggttggtttgtttgtttgtttttgagacgggatctcattctgtcacccaggctggagtgcagtggcgcaatctcagctcactgcagcctcgacctcctgggctcaagtgatcccctcatttcagcctcctgagtagctgggactacaggagtgcaccaccacatccagctaattttactttttgtaaagatagtgtcatgctgtgctgcccaggctggtcttgaactcctgggctcaagcgatcctcctgcctcatcctcccaaagtgctgggattacaggtgtgagccaccgcgcggggcctggagtgggttttataggagtcttggttaggccaagggtttcatcagcaattgtaacatgaacagccttgcagacaaggccatttccagagctcctcctctgtgccctccaccctggcaccttctctttgtaccctcacactctcccccagctctttcctgccctccccattttacagatgggaaaatggaggctcagagagaggtatggcttgcctcagtttacatggagagagcgagaggcctctccctatgtggctgggccggtacctacccctcaggcccagctccctgcccggaccctgatggcctgtcccttgtcccccagagtggttcgcctccagcacacagagctacatccttcgggacctggacgacacctcagtggtggaagacggccgcaagaagcttaacacgctggcccattacaaggtgcagccctgccccccgcccccatttccccaccctcatgcccccaccccaacctccggcctctgacctcggcctctcccctcccatcagatccctgaaggtgcctccctggccatgagtctcatagacaagaaggacaacacactgggccgaggtagtgcgggtgcacgtgggaagggagcccaggctgcgtgtggacaggggcttccatcccatgccccagtggggaagctgaggctccgagaggcagggctggcctgggctgaggcctccttggtgggggctgggcggggccagcctcctctgacccagtactgctggggcagggcccacaccaggcctcctcaagctgatttcctgcggcagctggagagaggccccgggagggcgggatgcagttccaggaggtctgggcagcagccaggccagaaggggggccagcatgcccgtctcagccttgggccatgtccctgcctcaagtgccccctccacaccctcagacgccccaggcacagcctcctggctgccaggcctgcgagcccgggatcctctgggtctcggggtccccttctaaggttgagagcagagtctcagtctctcccagcagcctgggaatctgggctggcaggagctctgggctcaggggtggggtgggcaaaggcacccacccccgcctgcctggggcccctcctcccccgtggctgcatcttcctgtttctctccaccgctgtccctccttccaagtccctccatcccgggtcactgtgtgtgtgtctttctctctctgcctcactctgtctcgctcgctgtgtgtctctggatctcacttatctctctctccgtctctcccagactcagtctccccatgcgtctctgcatctctgtctcattctctctgactgtctctttggatctctgtctccgtttctgtttctctctccatctttctgtctctgcttctgtttctctccccatctttctgtcttgtttctgtttctcactccatctttctgtcttcatttctgtttctctcctctcctctcccatgtttatttattgtgtttttcctctcacagtgaaagacttggacacagagaagtatttccatttggtgagtgcccaacctcggccccgggggatccagcccctcagtgggtgtggccttggctttctgtggccctgggcctcttgggaaaagtgctcccagccctgcgaaaggctggggggtgggggagtagggatggggcccagaatcaggagggaaccacagcccttgtgtgctaagaagcatggcagagccagacctcccacaggcggccgaggatggggcctggtgcggacactgaccactgcccggcctcccaggtgctgcctacggacgagctggcggagcccaagaagtctcaccggcagagccatcgcaagaaggtgctcccggaaatctacctgacccgcctgctctccaccaaggtgagtccggcctcagtctcccctctgtgcagtgggtacaaggctccagccccagctccagagggtcattgctcagggccagctgtgcacccgcggctgggagaggggtgtgagttcttcctgtttcccctgtggggctggaggggcaagaggctgaaggcttagggtcccacttgaggaggcatttctcacagccaggaaaaatgcctgacagagacttctatgttagcccacgtaacagggtacagcagaggcccagagggatcagtgatgtccccaaggccacgtggctcagtggcagcgccggcaccccacagcccatactctggcacttccagttctcgactccatgtgccagtgcctcgattagtcctttcaacgcctctgggaggcaagtgagccagagaggctcggtgaccagcctgatgccatgtggcttcctcattcagcagcctggcatttcaagctccgcagagccaccaagggtgcccactagccctctgcacgtggcccggggctgacggcggccaccccactcccccgcagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacaggtggcgggtgggggggccgtgtggacttcactgtgccactggggcccctgtggcagggggttcagagtctagtcttctggcctcgcctgcttggggtcaagccctcctctgccatttcccagctgtgtgttctcggatgagtgacttagcctctctgtgcttcagtttcccctccactgtaaaatgcgacccatgttaatggtgggaattaactagaagagtgcccagaagcatggtctaggtgttgcccttactatcattctcccgcacccctctcaggtgggcaccatcagctccacttcacagataagcacactgaggctcggagaagcagcacctgctcaagaccacacagcctgggacagtagagccaggctcggccctacattatctgaatctcttacccagttggtagccctcctttgaggcacctcttagcttgtcggggtcatgcacccccacaagaagttgctggaaacccagcctgaccctcaggaagaataccaccagcccaggcgcctctgtgcagggcagcagcttcctagagctctgggggtacacatgcccaggctgctgagtcactgggtggcctgaggtgggggtgggggtgttgctcaccctctctggcctcttgaggacaaggccagagctccaggccctgccccccacagccctgccacagctgctctgctaatgtcggacttcctgctgcctgcaagggttcagggaggagccaggggtgcccgggggccggcacctggttctaatgagaaccaggacctgactggaggctcaggagggggttggggggtacagctaagccctgtagctcctgccttgctccagcaggaaaccgggctctcagccccactgcaccccagctggccagggataggcaaactaaggttcccaaaggtcacatcttgtgacaaggctccaacctcaggcccttgagggacaaagccagctctctcctccacaactgtccctcgactgcttcctaccccaccctaccctcactgtctttgtcaccctaccccacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggtcagctgttcccaggaccaggccaggcccatgcacagggccagagtggggtgccgaccatgggtagcctcctcgactctctgaggctgagctcagagatcttcctgggaggggaaccaaaagatctcaggtctaggggatgtgggatgagtgactcattcagacagggagacacctagaagccagtaccttccatcagaaactctgtatcgctgcagaccaactgcacatgctgcagctgtgcctggcactggctttgaacacaggcctgagaacccggtgtgggaaagccagtatgagcttggacaacctgcttggtcaggcacaacatcatctgaaaaccgggccaggctctgggcagtagcccctgaaagtcaaaagccattcaagcgagcattcagtgaaggggtgggcagaggggtgatgggtggctaggagctctgagattcatgcggtgtgttgggggcacacaaggctgtgtctggctttagaggttgaagatgaaagaggatggccttccaggcagagagaacggcgcaggcaaagacagggaggcaggaaagcagccggttgctgtgagcagggatgagattgtatcattaaagctggcactgcaggattggtccaggtcgtgtgtgaccctgcatttagcccacgcatttcagagacggaccacgggaaggagaaaatgccatcgctccactactactcacgtactgcctccgaaggcagggtgcccgtgactgacaaagaactgggagtgttcttggcacttctttcaggcgttaggagcatgtggtgggaaatattccactgagccagcactcaggcttccaggaatcctagccaccaagacctatcaccctgagaaggacacatccttgttacgtggaatgggctgcgtgcagtgaagagctggcatgcccgtgcacttttcccctgaaagaagtagggcccctccccacccacatcattgtcctaacagtcctggggaaagtaggcggggcagacagagcacagtgaggagcccctggtctggggccggctgagtgcggggacgttcagtgaccgggtgagactctttgggcctcgggggcctgctaaggtcacttatgtggcaggagggatgagggctcatccagaaaacgaccagatccgtcctttctccagcagccatctaacaccctcgctcttctctgcccaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgagggtgcggtggctcggcggcgggggatgggggcctgaagagctgagggatcgggggtcgggggctgggcctcaatgcctccactggagtaagggcagggagcgcagagggcatttcagaagtggctgtggcctcttgctggcctgcaaattcgtcatgcattttcccagagtttgaggagcgggggcaggagagcaccctctggatggagaggagattggacttcagggtccgggaagccgtcttcgtccatgggacttgaggggcctcatcgctgaactgttctgtgggggccgtggggagttggggattgtgtgcaagcagctggctttgctgggactaggctcagctttgaccgctgggctaacctcctccccatcctgcctccttatagaaataccagaatgagttcaacaccaatgtggccatggcagagatttataagtacgccaagaggtatcggccgcaggtgagtgccccagggtgaggcacctgccctcggggtaggtgagcttcctactcaaggacacacatctcagggtgcttgcccctaatggacggatgtcactcgtggtagacgttcaggggtgtgttctctcccacgaactgaggcagggctaccggccatggcccggctgactccgctgctcccctcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgctgctgggagaaatggacgcccactgggcctcaacttgatcttctaccccgtgcctgtgactcagactgggaaatactgagcagagacggctggggcgggggcaggaggaggggctgctctctgagacaggggcgcccccgccttgacccctgggcacctccatcccctcccacctgtccccagatcagtctctgggatggaggccagagagctggtcaggctcccccatctgcccagcacggcctgcactgtgcccacccacttgctccacaacgtccagttggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctactgtgggctccagcctttgtcctgagatagccaagcgggagaatgggcagtttctttaccagtttgtgagagagaggagggagggagcctgccgtccctcctgtctcagctgcactcttgaggtttgggcagacacctgactagcttctgagaaggcagtcagaggccaggagatgaaacgagacggtgcaggctgcatgcatgctgtgggcccggcccagagctgccattccttaagctctgaggacaccccgggacctccaggaagatttcacagctgctgtgtgctgcctgcaactgggtgggccctgctcctaacctcatctctaacaagcccgtcaggaatgtgctagcatccctgtatgacagacgcagcaacttgaggctcagcacagctgaagcaattctcaaggtcacacaaccaggaagggacagaataaggaccaggtcccatggtccttccgggccagagtctccacagtggtccccaaaatgggcggggaggccaaaggtgaccaccctggaaagggaactgacacttaacttaccccgaatttctcatcaagcttaaaaaatacgtagcattaagctcatttctcagacaaggaagcaggcagtttaacccccaagcccagtttaaccctaaacgctgttccccacaagtacaggctgttcctcacccctgcccacaagaacaatgaacctgatgcagacacccctttccagccctgctggctcctctccaaccccagggaaagatctcgagagccagctccaaaggtacagcaactccacttaatttcttgcttttttgaaggaaaaatagttacacatgtatttatcaagagtaagaactaggacaaaagattcataaaatttaaacaaaatcccacaaataccagttctaaaattaatgagaacagaaaagtgagaacagtaaacaaccttttgctttaaaaatagctttttcctacagtggcttctgtgtggagagatagtctttatctttcacattttctattctgagcattgattccttcttattaagcagcagattttctaatttaagttatcagcacatttgatagcattttgagggtgaggggggtgggtgtgattctggaatgaatacacggttcccagagaaatgtaggaagcacaaaaagcgtgaagaaaataaaagctgccctaaccgtttgtggcgagcgtctctgagaacgccagccgcacggggcgcttggatggggcggggccgaggagtgaactcaggatcagggtgtgcacaccattttgcaacctgattttcccccatgcgacaatatgtcagtaacatctttctatgtcattaaatattccacagcctgtcttaatgtctgattaacattcagttcctccttgacgtttagaaatgtatttgcaaatggaggaaatctctagtttccagagtcgtttctcagcgcagaaggtggccaccttccatgaaccaattataatccttatctggggctctgaggacctggcagctgtgggcaggagggaggttcctaccctttgagggtcataggaggctagggacccctgatgtagcatccttaaactaaactcctttgaaaaggaaagaaaccattgcagctaagggaggtaacttgcccaaggtttcatggatgctagacaccccccacccctgtccccagctcatggacgtgagatgcccactgatgccccccgcactgcaggctgcctgggggtgccacagcactgggccaagccgtgaatgagcagtggcaggagcagacccctcctcaggaagcaccagcccggccccatcccaccatctgctctgggtgcccttctgggtcctgctggcagccacattacagacaccccaggggggctgtcagcacatctaggcaaagccgggattccaggaggagagggtggggtggtggagcaggggcaggaagggagcagctgatgccccatgctgagcagcctgcttccctttgtgccccgtctgcccccttctcaagtcctgtgcagtttgcctctgactccctttagtccaccccttccttctctctgtcctccgtggctaggctgccacctctcatcaggaccatatctcggcagcctcctggcacgtgccaagtcctcacctcaggaaatggtcacccagcagtcacttagctatctagaccccaaattgtggactgactcatcagtgacccttcctacatccaatccatcagcagagcccgttcacaccatcttcaacagcgatccagaagctaccacttctaaccctccctctgtgagcatgtcctggctggtcaccacccccttcatctgggttgtggcaggagcctcctcacaggcctgtctgcccgcccacatccctgcagagactctgttgcttgccgtcctctaatggttccttatgacaaagcccaccgtgcttgcccttggcttacaaggccctgcgtgatccagccgccatctaccctgcagcccttgttccagtgaaaggaaggggatctgtttagaaagatatattgctatgggacacaccaccccagtacctagtggcttaaaataacagcagtcacttattttgcccacgaatctgcaatcagggcagggcttggcaggaaaggcttgtccctgttccaccaggtttctgctgggccagctcaattagggctggaagatgcagttccaacacgcattcagatggtggcacgtggtaccagctggtcagagagttcagcaggagctgaaaaatggagtcctcagttcctctccacaagctgcatgggctttcccatagagtggtggccaagtttgaagagtgagtatcacaaaacaaaaagtgtcctcaaacacaagaagtagaagctgccttaaggtggggcccagaaattatcacagcgtcattgtcaccaaattctactggtcaagtaatcatggagcccagagtcaagaggtagggacacagagcctgtctctccgtgtgaggagtgccgcagatgtttttaaagcaccttggacctcgtctcccatccctgtgctcctctttactgggctctagccacacagaccttcctgcagctcccagcgtgaggagcatgttcccaccccagggcctttgcattcactcttccttctgctgaaatggtaccccctccagacagagatccttgctcagacagcccgtccaaccctgtctaaactagcagccagccctacccaccccgctggaggcccagccccacctcttcttcagagcacaggcgctggctgcagagtaggacacctgtcagcctgtcgcagtgcctggcccaggagcactcgggaaccagtggctgaaaggtctccctgtcttctcagctactctaatccttcctttccactgccagagggttctttctaaacagatcccctcctttcatcccacccctcagatggcatcctctgcctcatctgcctgacaacagctacccatcctttaggatcaaaagccatctcatcctggaagcctgatcgcagggccaggttaatctccctccatcagcccctttgcatcccgatatctgtgctgcagccccatatagcacacagtctgtatccctgaggcaggacctcctatctgagccccagcattggccaggtaaacagcaggtgctcagcggatgttcatgaaggaccgaatggccaaatccttgaacctcagcctctacccacaccaattgtgaggaaaaagaaacaaaagtctttattgataaatagcttacaatgaaataaatagagcagtggttagttgaagaataaaaactagggcagaggctcggtctctctccgcccctgcctctggccctaagcttcagccctctggctggacactttggatgatgaggccttgatgggcagcccagcctttctagggcccttgggggcctctgtcttcctggacaaatgtgcaggtaccaccttggacccactgcccttagcaggagcagcagccttggtgtttggcccctgcccagctttaggggccttggccttggccaccaccttctttttggtcggggaagcagcaccattcttgacctatacgaaagcaaaccaggagcaaagagacagctgggaagggctgaaatcccagctctgggtggctctgggtacacaacatcgcccttctaagccttagtctcttatctgtaagatggggatggcaacacccccagggtgccaggggaccagagagaaggtggtggactgtgctttgtaggaaaagaaattgagccccatccctggatgacccttccgggggctgagtgtgggatgcccaagctctggcctgttcagggcaggcagccaggccaggaaattcatgcaggcacctaccttgctggccgtgggttttgaactcttactctcagctttggttttcctgtaggcctcagcatctcctggaatttgatggaggaggttttataggggaagaaggaggaactgctggtggggcaggaagtttcaggggctctagaacccccattcctcctgggtcctaggtcttcactcagttatgtgacatggggcaaatcatttagccactctgagcctcagtgacctagtttgaagactgggaataatagcatgcccctcacagagtggctggagggttaacggaagcacttgctctaggcaaagcactagtgctccaagcccaccaaagccaacgtctaacgggcctgtcagctcgagcctttagtttgtcttccacctggcagccaggatacttttttttacttttaagacagggtctcgctctgtcactgtgctggagtgtggtggggcgatctcagtttactgcagccttgacctcccaggctcaagcgatcctcctgcctcagcctcccaagtagctggggcaacaggtatgcaacaccatgccagctaatatttttattttttgcagagatgggatcctagtatcttgcccagattggtctctaattcctgggctcagcactcacctgtgtgacagagcaagagcctgtctctaaaagagagagaggaaaaaaaataataactctagccctagctgcttcctgtcagaatccttccacagctctgcattgtcctccagataaagccctgattccagctgcccttcacagcttctccttgccaaaactgtaggtagactgaattacatgcagttcctcaaatactccaccttctttttgtgttttgttttgagactgagtgtcactctgtcacccacgctggagtacagtggtgcgatctcggctcactgtaacatctgcctcctgggttcaagtgattttcctgcctcagccacccaagtacctgggattataggtgtacaccaccatgcccagctaatttttgtatttttagcagagacgggggttcaccatgttgaccaggttggtctcaaactcctgacctcaagggatccgcccgccttggcctcccaaagtgttaggcttacaggcatgagccaccatgcccggcctaaaaactccaccttctttatgcctccaggcctttacacaggcccttcccctgcttgagacaccttcctccactgcctcaagaatgagtcagtctcctggtctctgcttcccccttcataacccttgaaatgtctgcctccttcccccaaccagctaccatgagttctctctctccaggtcaagcccagcactcaggacacatgcactagataaggaaacccctctccagagctggctccccgcccccgctccagtggctgtcaagacccccatccccacaccaccccctacaagtcacacaactaccttggctgctcctgctgcctttggcctttgccttcctgctgagcccaccagcactggaaggtgcccgcatggccttgtctggcttggggggcaccttcctagcctctcccgactgtgccctggtgtccttggccgcgccgccttgcttgcgagccttctctgtggctgcgcctggcttgggaggaggcttctgcacctttgctggcctcttggctgcctttttcaccttgcccacgttgggagggtcctccttggcctcacttggtttcttggggcccttccccttggcctcacccgctctcctgggagccgtcgcgggggccatcttcctgggctggattttcttcttgtgcttgggaactaactggagaaggacacggggtggggctgaaagcagagcctcaggtgcctcacgccccccaccccccgtaagactccgaatgggaggcctcgttccaaacaggggggctccacaggcagtgagaggcagggagaaggcacgaagccactgtccttggaggcactgtctactatgattctaggatctcaggatctctcaaccacctgccctaggcctgccactttcccacagattgtgcctctggactcctcctcccccactaccctgaagcgctgccctgcctcatgccccatgcccccaccacctcgccccttgacgctcagcagaacatgggctgaggtcagatggctctgggctcacagcttcctccgccctcctccagccgtgtaccacagccacgtcttctcatctttacagcaggacaatcaccaaggctgtgagcggcagggaagggagggctcctggcaagctgtttctttcctgtcccccaaccctcagggctccccatcaccaagactagaaactaccttcacccctcaactgccagcacaccgcatcagacacctgacgcccctctggctcttctccctgcttagccgcctggtcctgctgtgacgcaagtccaggctctgacccacgcccaggagttctaccagggtgggactttctgtgatctgtcaccaggtaaccacagggaccggcttggggtaggctgagaatgttccccagcattccatggcaactgtcatggcagctgctacatgcaggaagttaggcaagatgcaggggacccagcaatgacaagtcaggccgtgggtctggtccctgaggtattcctggtggctgatgacagtcctgatgttggggtgcagttttgtcccagacctgcctcagctctgagtgacctggcatgggtccccttttggagcctccttataaagatgaaactctcccctttgaaacggaggacatggctgctcagggaggtgccagcagagggaaaaccctttgctgtggtgaggaattccaggaaggggctacgtgcccaggacccagaagttagcacagctgacacaggccctgggatcccaaacatgcaacagttcacctgtcctggacaccaacagggtgactcttgcagtgggagctcagagagggcacactacctgccttcctagaggagagggcatctcggctgagaccacaggaggaacaaggacaggggaccggaggggaaaggccttccagtagaggccgcagcactcacagaggccaggaccattgctccaaccctgggctatgtcctccctcaggggcgcttactttgaagctgccagtggcccccctggctttggagttgaggggcctggcgaggaggccacggcgcatgccagtggccagcgcctgcttcagcaggtacttgaagcggaggacgtccactgttgggtacttgtgcaggatgtagagcttgatagctgccaccgacgtgccccggcgctgctccccagcctgcagcgcctccagcaccatgcgtagcaccggggggtggcggcgtcccaccgggaggctgctgtggctcgggcctcctggtgggacaccgccgtggctcgggcctgaggagagatggcaggccatcacccggggcccagtcacaactcagtggcaggcatcagctggcccgtggggggtgggtgagggtccagcaaggatcagatgcccccctctccccaagacactgaccgctggcatgggagctcccggatggtctcccctcaaggctcactgagtctctctctctttttttctttgagacactgtctctctatgtccccaggctggagtgcaatggcgtgatctcagctcactgcaacctccacctcctgggttcaagcagttctcctgcctcagcctcccaagtagctgggattacaggcgctgccaccatacctggctgatttttgtatttttagtagagacaaggtttcaccatgttggccaggctggtcttgaactcctgacctcatgacccacccgcctcggcctcccaaagtgctgggattacaggcttgagccaccgtgcccagccaaatctctctttttaaagaatggagtattcctttagaaaaacaatctaaattgggtgaatttcgtaactgtgggtttacaggacctccgggggctatgtgcacattctcagaggcacccagactgagagactctccagggcacacagccgggtttcttccacaaataaggggggaaagaaaaagtgggaggggcaccctatggactaaaggtccttaggaaacctctcaaccaaatgctcattcccagagcaggatttgaacaatccaactggaaaaagaaaggcaacagataaatgtgagcactggaaggaaatatcggatattagggataatattgtttcaagtgtgctaatggtattacaattgctttttaaaaggctcttatctgttaaaggtaaatattataaaagatatttacagatgaaatgatacataaatccagcatttgctttgaaataacccagcagatgaaacaagagtgtccacaagatggtgactgttggagctgggtgacgggtacagtggaagggagttacagaccatttggtagtctacttttgtatccatttgaaagttttttgttttgttttatggagacagggtctcaatctgtcacccaagctggagtgcagtgccacaatcatggctcactgcagccttgacctctccagctcaagtgatcctcttgcctcagtctccgaagtagctgggaccacaggcacacaccaccacgcctggctaatgtttgtattattatcattattattattattattattattattattattattgttattgttatttgacacaggtctcactacattgctcagtttagtctcaaactcctgagttcaagctatcttcccacctcagtctcccaaagtgctaggattacaagcatgagccaccatgctcggccctgaaagttttcataataaaaagttaccaaaaaattccactcttcggtatatacctgagggaaatgaaaacgcatgtccacacaaaaatgtacacatgaatgttcatagcagcactattcatgtcggcccaaagatggaaccagcccaaacatccatgatgaatgattgacagatggatgaacaaaatgtggtcgctacccatcccgtggaatattatccagccatacaaaggagtgaagccctggctacgacatggaggagccctgaaacatgcaaagtgaaaaaaggcagtcagaaaaagccacatactgtctgattccatttatatgaaatgtccagaataagaagtccatagatgcagaaagcagattggtggttgccagggctggggagtgggggtggagagtgactgctaatgggtactggttttcttgaagtgatgaaaatattctaaaattgattatagagatggatacacaactctgagtataccaaaagccattgtacactttaaagggtgaattgtattgtatgggaattatttctcaataaggtgttataaaatagttgcaaatgaagtgggatcaagggtgggggaagcatgagaagttgtcagtcaccatgaaatgcataaaagggatttaaatatgaaaccggatttaaatgtggtgaatggaaatgttgatttctgatcaatctgcagaatttaaagacttaaattctgggcaatatcgtgagacctcgactctacgaaaatctttaaaaatgagcagagtgtgg

SEQ ID NO: 1943 - DNA, 6340 bp, Homo sapiens
atccagcgtcggttcccctcgcccacgcccaccaacaacttcgccctggacggcgcggcggggaccgtgtacctggcggccgtcaaccgcctctatcagctgtcgggcgccaacctgagcctggaggccgaggcggccgtgggcccggtgcccgacagcccgctgtgtcacgctccgcagctgccgcaggcctcgtgcgagcacccgcggcgcctcacggacaactacaacaagatcctgcagctggaccccggccagggcctggtagtcgtgtgcggccgcctgctcgtgggcgccacgtacaccggttacggcagctccttcttcccgcgcaaccgcagcctggaggaccaccgcttcgagaacacgcccgagatcgccatccgctccctggacacgcgcggcgacctggccaagctcttcaccttcgacctcaacccctccgacgacaacatcctcaagatcaagcagggcgccaaggagcagcacaagctgggcttcgtgagcgccttcctgcacccgtccgacccgccgccgggtgcacagtcctacgcgtacctggcgctcaacagcgaggcgcgcgcgggcgacaaggagagccaggcgcggagcctgctggcgcgcatctgcctgccccacggcgccggcggcgacgccaagaagctcaccgagtcctacatccaccgcctggtgtcggtcttcccagcccgggagcggctctttgctgtcttcgagcggccccaggggtcccccgcggcccgcgctgctccggccgcactctgcgccttccgcttcgccgacgtgcgagccgccatccgagctgcgcgcaccgcctgcttcgtggaaccggcgcccgacgtggtggcggtgctcgacagcgtggtgcagggcacgggaccggcctgcgagcgcaagctcaacatccagctccagccagagcagctggactgtggagctgctcacctgcagcacccgctgtccatcctgcagcccctgaaggccacgcccgtgttccgcgccccgggcctcacctccgtggccgtggccagcgtcaacaactacacagcggtcttcctgggcacggtcaacgggaggcttctcaagatcaacctgaacgagagcatgcaggtggtgagcaggcgggtggtgactgtggcctatggggagcccgtgcaccatgtcatgcagtttgacccagcagactccggttacctttacctgatgacgtcccaccagatggccagggtgaaggtcgccgcctgcaacgtgcactccacctgtggggactgcgtgggtgcggcggacgcctactgcggctggtgtgccctggagacgcggtgcaccttgcagcaggactgcaccaattccagccagcagcatttctggaccagtgccagcgagggccccagccgctgtcctgccatgaccgtcctgccttccgagatcgatgtgcgccaggagtacccaggcatgatcctgcagatctcgggcagcctgcccagcctcagtggcatggagatggcctgtgactatgggaacaacatccgcactgtggctcgggtcccaggccctgcctttggtcaccagattgcctactgcaacctcctgccgagggaccagtttccgcccttcccccccaaccaggaccacgtgactgttgagatgtctgtgagggtcaatgggcggaacatcgtcaaggccaatttcaccatctacgactgcagccgcactgcacaagtgtacccccacacagcctgtaccagctgcctgtcggcacagtggccctgtttctggtgcagccagcagcactcctgtgtttccaaccagtctcggtgcgaggcctcaccaaaccccacgagccctcaggactgcccccggaccctgctctcacccctggcacccgtgcctacgggtggctcccagaacatcctggtgcctctggccaacactgcctttttccagggtgcagccctggagtgtagttttgggctggaggagatcttcgaggctgtgtgggtgaatgagtctgttgtacgctgtgaccaggtggtgctgcacacgacccggaagagccaggtgttcccgctcagcctccaactaaaggggcggccagcccgattcctggacagccctgagcccatgacagtcatggtctataactgtgccatgggcagccccgactgttcccagtgcctgggccgcgaagacctgggtcacctgtgcatgtggagtgatggctgccgcctgcgggggcctctgcagcccatggctggcacctgccccgcccccgagatccgcgcgattgagcccctgagtggcccgttggacggtgggaccctgctgaccatccgaggaaggaacctgggccggcggctcagtgacgtggcccacggcgtgtggattggtggtgtggcctgtgagccactgcctgacagatacacggtgtcggaggaggtggccgtgggggccaaggaccgctggctgaccacagcacctcccctcaggatcgtgtgtgtcacagggccagccccaggaccactctcaggtgtggtgaccgtgaacgcctctaaggagggcaagtcccgggaccgcttctcctacgtgctgcccctggtccactccctggagcctaccatgggccccaaggccgggggcaccaggatcaccatccatgggaatgacctccatgtaggctccgagctccaggtcctggtgaacgacacagacccctgcacggagctgatgcgcacagataccagcatcgcctgcaccatgcctgagggggccctgccggctccggtgcctgtgtgtgtgcgcttcgagcgtcggggctgcgtgcacggcaacctcaccttctggtacatgcagaacccggtcatcacggccatcagtccccgccgcagccctgtcaggctctctggggctgcaggtgcactgataggttttgctgtcccccgcagtggcggcaggaccatcacagtggctggtgagcgtttccacatggtgcagaatgtgtccatggccgtccaccacattggccgggagcccacgctctgcaaggttctcaactccaccctcatcacctgcccgtcccccggggccctgagcaacgcatcagcgccagtggacttcttcatcaatgggcgggcctacgcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacgtgagcaccaaaggggccgggaaggagcaggacagcctggggctccagagtcacgagtaccgggtcaagataggccaagtaagctgcgacatccagattgtctctgacagaatcatccactgctcggtcaacgagtccctgggcgcggccgtggggcagctgcccatcacaatccaggtagggaacttcaaccagaccatcgccacactgcagctggggggcagcgagacggccatcatcgtgtccatcgtcatctgcagcgtcctgctgctgctctccgtggtggccctgttcgtcttctgtaccaagagccgacgtgctgagcgttactggcagaagacgctgctgcagatggaggagatggaatctcagatccgagaggaaatccgcaaaggggatgggttctcgggccgctcacggctgtccgtgtgtccgccaggcttcgctgagctgcagacagacatgacagatctcaccaaggagctgaaccgcagccagggcatccccttcctggagtataagcacttcgtgacccgcaccttcttccccaagtgttcctccctttatgaagagcgttacgtgctgccctcccagaccctcaactcccagggcagctcccaggcacaggaaacccacccactgctgggagagtggaagattcctgagagctgccggcccaacatggaagagggaattagcttgttctcctcactactcaacaacaagcacttcctcatcgtctttgtccacgcgctggagcagcagaaggactttgcggtgcgcgacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggagacggtgggggagccattcttcctgctgctgtgtgccatcaagcagcaaatcaacaagggctccatcgacgccatcacaggcaaggcccgctacacactcaatgaggagtggctgctgcgggagaacatcgaggccaagccccggaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttgagtggttcgcctccagcacacagagctacatccttcgggacctggacgacacctcagtggtggaagacggccgcaagaagcttaacacgctggcccattacaagatccctgaaggtgcctccctggccatgagtctcatagacaagaaggacaacacactgggccgagtgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagatcatggccgcgctggaggccaaccccacggcccggaggacacaactgcagcacaagtttgagcaggtggtggctttgatggaggacaacatctacgagtgctacattggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaaccta

SEQ ID NO: 1944 - protein, 1892 aa, Homo sapiens [sequence omitted]

SEQ ID NO: 1945 - DNA, 178825 bp, Mus musculus
  misc_feature (1)...(178825): n = A,T,C or G
ctgcatcaacagatgatcactgcacaactcatttttgtagggattaaagaaatttaacatctgcttaccaaggagctgtgacaaattagtctctggttggaaatttcatttgaaaagagataagacaggtcattcttaaactatattctgcatctgctgcttcttaaccattgttagctctgtgtgcagaagaggtatattttgtagtggaaaattctgatatcccccacaggatatcaaaatgtagaaaaataatagtaaatagtaagaaaacttttctatggtggcacattcttaattcatcttgactcacctttaaatgctattttaattcatcaaattaaactatgcaggatgagaaggccatccttagataagtttggagaaacactaatttaccttgctgacctgccatgagcactgctagcagggaactgagctcactttatgatttttctatcacatactgtttgaaatgtatcagattagatataataccttaatggtgaactgttctaacctttaagattcttttctcaatttgctggattagtaacctaagattttcaaaaagagtaagattttttttaacccacctgtaataaataccctttcccatttcaaagctcaagtgtttgtctctgtttgtgtttgatatcataccatagagcctacaaagcacactgtgagaggaactgtagcaataatgggttgctaagcaagtctctcagctaattaaacaatgtggcttgaattattctaaccgtctgtgcagctcacccatgatggagcaggtgagaatgatgctcatttttagtttttgtcagaacttacacgagaaataagtgaaagaatatcctacttgtaataattaaaaagaaaaggactactaggtgaagttgtatgggctgaatgtttgaaacaacccaatatgcagtaataattgaatacctaaccagatggtaatttcattaagtatttcaaaatcataccaattgcaggtttctttataatataataaatgctacattttatcagattacagatattttattatgcaaaccagaagcacagtgtaatatatctcttttgtaaatcagcatttttaccctattattgctccctttcaaaataaaattgagacagaaggaagcctactcagcttatccaaattataattaattttggcaattgggtgtattacaaaatgtgagctagactctctaaggagagttgtaaatgcagtcatggaccaggtcccagattgttcaaataatttatttttctgtttagagttgcttcactcattaaaagccaaggcaaagggtgggtagcagggacggatgggaagtgcacacaggccaggaacttcaattctgccgagcacacctgctctcttatgctaaccctggagctgctgtgaggatccagttgtcatttcctccccattttcctcctctctgtgtgtggcttcgtcaatgagtgcttgattagagaagcatcatccttctgtgtgtacatacccagtaggtacttggtttaaactgattccactaatcacacttggaaggaaacggaaatttccatggatagtgtctgtggttccgatcactgcaggtgtagttcgtaagatcttaattgttccccgtgactattggatgttttttctttctatctttagtcagctattatcaaatctcaaatactttctatactcaactctctaaaaaggtcaaaaatctgaaagtttaaaaacatcaagtgcatgtctcggaaagtgggaaggggctgttaaatgtcagtgttcaattcctacaggcccctccatggtgttctgtggtgctggtgtcatgagcttctagaatgctctttgcatttttctcacttttccttcctttcttatactctttaatacagctggaatgcttgcggattcttctgaaaccttctaagcctgactctgaggacccagcttgaggatgccgtctgaacactgcctcaggtactgaatgagaagcccttttcagtatggcgagctgaacccgggaacaacgcagtactgagcacagagcagtgagcagtgagcactgagcagtgagcactgagcccagcatagagcactgagcactgagaactgagcacagagactgagcatagagactgagcatagagcactgagcacaaggcactgagcacagagcatagagcactgaccacagagcacagaacactaaatacagagcactgagcatagagaactgagcacagagcactgagcacagagcacagcatagagcattgagcacagagcactgaacactgagcacagagcacaaggctcgaactgagcatgatttgactgaataaacaaaactgtcataatttttgtgattttggtatttggaaaaaggatgaaccactaagacctcttgatcaaacttagaaaagcctcatgagtctttggctgatactgctttttgtttttgttttttggtttttgttttttttctttcttattttggatggtaaccctttgagaaaaaggcaaatcactataaaggtacatgataaaaatttgtagaaaactatgctgcctctgaatattgacccctttaatgcaatccctttggggaggattcagaagttcctgctaccttttttgaatatatatttatttgataagtatttgctgaggcaaacattcaacttgatgtaaagtaccagctatgactgatacaaaatttgatttattccttcataaactgggtattctatcatagaaacagctacaccaccagcaatgcaaatgccgtgatgaaaaccgttctgatggtaaagtgcagtgcaaacccaggaaagaagcaggcctgaggtcccaaggatgagctgagctgggcggtggggcggtgcaccgaggcgggagggagctccacagtctaaagtctgagaggcagccagagggaaagtaagtggcggccattctgcctggaggccggtccccatcagtttctgaggaagcagtccaaaggtctctagaagaaataagaagagaggtaatagaactgaggaatagctgtagagtgtgaggaattagatatttctattaaatagagctgtctgcagctattagagatggctagttccaaaatcagttcagagtcggtggcattgccagagcaggtctagcactgctttatgcctcttatgagtttgttgcagtcagcaattctcagtggagaattagggaatggtgttcaagggccagcagtatttcttatcatcagggatcggttgattttagctacatattgtgctaaacatcttacagtgtttaagactggtcctcagagcaaggtttcttaaggtggtttaacctgtctcagaatgcagttaattccaaggccgagaagccctatgctagatctggtaccctgccaaaatgatacacgtggactatggtatttatatggtacgacgtcagacagtttgttccttggtaccagaatctgtgtgttctccaagtgatttcttaccctaagcctgcaatttatggtaatcagctcccatccttctgccctgtcttccactgtggagtcatctccttccctgctcccgcccacagccctggcccccctcctctcgggcttccattatgccttttggaactgttgcaacaagaccatgaatgctgttgtgtcttcctcctcagcacagaccttttatggaagagctgcccagattccaggccctgggatcctcagcctgcttttctccagagaacgttttcttccagccagccacattagaccgcagccatagcatggatcttgttatccccactagtcacttcatgtctgagattcctcctgctgtggattcatttcccagcttgcaggtttacctttttcactagggctgttatttgccttcgtgactgtatctccatagatgctattgagttctttttatgttgaccagctattgctgctagccatgggacctggccttaggagtggtttgtatccccagtgacattctgttggggaaaactaagttgtcattaatggcaattatcaacttgaggtagtttctggatcaggggtgagcacttttgtccacttctcgtcttaccactgggccctcacctagcacagataagtgcagactctatgcatgctgccgtgatctctgtgagttcagatgttccttggttctgctggattgggtgtctagaaagccttacttccttgatatccctgcatgctctctggctcttacaatctttccatctcctcttcggtgggctttcctgagatctgagaggaggggtttgatggaggcaaatcatttaggaccaagtggtgcctggctttacgcacattgtctggctgtgaatctctgtattagtttgcgtctgctgcagcaggaggaggctcctttgatgatagctggctggtctgtgagttagcagaatggttgttaggagtcattttattgctgtgttcccttcttaacaggtttaaattctgaaacttttgcccaacctttaattttttccatttcagttgtttttgtggcatttgcctgtgagaattttcattcagatgaactgaataatctatgctgtccagtgcagatcagttcataaaagtctttacatcaaacaagcccccagatgcccagagtcttacagctgtttctggggttcctatttcctgccccttaagaagcaaaccaagccatgacttgcttctgtgctttcggggccttttccatgcaagcagcttttactgtgctcttgggacagctgggctctgtcggtttctctctgagaaacctgagttctgtttctctccttagccgaggctgagttttgagcttcagacccatgaatcaagctgtgcttttgacatctgctcctagaaagaaaagtctttaagacaactcaaatttaacatatcccaaaatgagtttattattttcttcttttccagttgccctactattgggacatcaagttttataaacctgaaactccccccttctcatccatatctatatctaacctgtcaccgagactcctaacttttccccatgagtagctttcaaatctgttcacctctctgaagcattgtcctgatgtttcagggcagggctcagagaggcctcagctactgccgtggtcccaagctgccccagtctggcccagtctccctaagtgctcttgggactgcaatccagttgagcttttctgagacttgccatggctcttggatgccctggcccacacatcctacgtgagtcatcacctcatctgcagttactcagttccttcgtaccctcagtttcagccactgatttctgtagaagagcgtgccagtctgtctgtgctccttgctgacacaggccaaagcttgccgtcctcttttcctgcgtacatcttcttttctttgtctcagggtggtaactcatccatctgcaccttagctagttctcctttgggaagctgagagtacttacttagtgtgccactgtcctgatacactgaatatgctgtgatggccgttaccacactttatttattcagtattttatttccagcatctagaatatcaaggcagaataaatgtttcttatatgtaggaattagggaagggatataaaaagctgttggtgtataagtaaacttctttctccgtagtcttaatatttcttacttgtgcaaaatgtcttaatctaagcttgttattatagctatgtttatttttagcatccactttatagagtttataaagtattatataaaaataaaattaatcccattaccaaatctgttaaaagcctgcccacataaataagtagcattcttttactattaatgtataaaaatatctttaccctgttgagtggtaggtaaacattaaaagagaaatctacagaacttttacatttgaaatgtaaagtagaaaagtatagagttgtattagaatttacatcttaagaactttctgacttcagttaagtgaataaatgaaaataagagctgttgggatttctgggattgaagagttaactctatgcactcaaagtagccatttgtgctaaagcagacattcaggatgagcaggaggccactgtcagaagcgtgctctgcatttgatttactcgtttttcatgattggttccagaatgaaagttactggctcaaagtcatgattagtcctattccctgggacctcatgaatgaatctccccattattggatgctggtatgtgaccagtctggggctaactccctggcattactaatgtccatcagctgctgagggaatctgggattcctactgtgatccagagtcctgggtaggccagtcctgtgagatgcagaaatggtgctctcggacagtggcagcttgcctggagtaacctggcagggtgcctgtgagctggtggacttggaaatggagtcatgacaggaagcatgtctagtttaaagtagatacatttaaaataaggactgaagagacagctctgattaatctctgtgatgtatttcatataaatcagtgtgtcccaagtcacagcctaagctttatgtcttaagtataagagtattaatgagatatattgagtccttttttcatatcatttttgacagcacaccttaacttgcactagcctactgagagagttcagcagccccaggttgctagtgacacctgttttagtaatgcagatcttgggctcccacagaagacagtactaactgtggattttgagccataccattttttcatggaagaattttcccagttttaagcatcttctcaaatctgaatttcccctgaaaaatgtggagccattctcaggtctttccccagctatggggaaagtttttgatgcagtttttcctttgtttgtttgattcccagtagtgaaaagacattgctctgacctaggaggtgaatatgctggtttgccatttcttctcagggcagagggagctagtgacaagtgtccgtctgctcccaccttaatgtctgcttgatacactgtagtcttcggtttctgttctcagtctgcgatcattagccaggtgaagtgagcctcacctcttcgcgctgtcctgtgcacaggtgtgctgtcaggtttgcagaggtgagggcttttgcagctttgtagctgagaggtaagtgggagactgctttgcgaatacaaggatgatgtgttgagacttgttgattactgggcctttgaattcttgccaaatgccagagtatttatttttgctttttaagaactcataacatattggttctaaaatatttaggctcttctgccaagtgttgtcttaaataccagcttatggtgttctttaagggtgactcttccaagctgagctcttaagtctgggaaggcagggagcatcactattgttccagagcgcagcccttcagtctttgccaagctgcagttcacagttgctcttttcccgccaggagttactcacttccaacagatatctcagtgcaaacactggctcaggcttaatagtgatgtggattatgcactagatttggaaataggaaaagaatttaaagcaagtgtttttttaatttttaaattttttaaaaagatttatttattatgtataaaatgttctgcctgcatgtatgcctacacaccagaagagggcatcagacctcattatggacggttgtgagccaccatgtggttgctgggaattgaactcaggacctttggaaacgcaacctgtgctcttaaaccctgagccatctctccagctaaagcaagtattttaatgttctcttagtctactacaaatgaaatttcaaaattcatttacggtgacataaaagaggagaaaagatagtttctaaagttataatactaaaactcattttctgtttcaaaatgttagtcctagtacataagaaaacagctttgaagcatgattgcataattttgtgattattgcatgcaaaatgtgctttcatatattactcaaaagggttgatttcaagtctacttatgtatgatataaatataaactcaacaggagcttttgaaccttttgtcaccttgggcataagttttgcagacctttcttacagataacttttctattaaagcaggaaaaaagagttataccattttgttcttaacattgttttttttttcttttttttaattcatgatcaagaattttggtaatcttatctgtaaaacataggtgccagtggtaccttcttttagggttactaggaagactaaattgttaattaataattatatatcatgtaggataattggctaaaaactgtaagcaatgtaattgctaactatgaaaatgtcatcactttagaaaagctttttcaggctatcctagcgttctcccttgctgataaggaattcttgtgtcttttccttaatgatactaattaatctgcattctaggtgttacatagaaaattgtataaagaactatttatgcttccgaaagtgactttcagttactggttttgaaagcctgcctaccacgggagccacagatgaatattcaatggctgtgagcctttcagactctgctgaaaataatccttccaccttcccacaagaacttcctgtagcctcactttctctggagttattttctttccatagtttggtctttggtgcttcccagcatgaaatgtttgataaagcctgctgagtgcaccggcttttcccaggaagaattaggctaattgtaaggtagagatttgtatttaactctaattcaccagccagttggcagaagtaaggcagagccctgtcaaataaagcaacagtgtggctaagactttgtctcctctgaatagcactttttcacactggcactgagcagagcacagaaatgtcaggtagggagcgggcatgctcaggcatccttagatattcttactcagatttcaaaggagttcactgttcggacacagggcgagacacccttgtcatcctctggttgcaatttagtaatgacgtagctcactagtcagagcccaggacttgtaaggttttggagtaatgtagagagatttttgatgatctaagctagaattgtccatagacatgtataaattcagtttgtgttgtgagttcatggcatcatttctgtctcattttagaaaatctttgaaggtcaggtaggacttttgaaaggacacaggataaataggttcggatgggggaagaaaatgaagtggtaaagcttcatcataggagtttagcaatctcacaaagcaaaaagaaaaatagtctattcatatatccagtacagtggttacttagacattggaaatggatatttgacttttaacttttaatagtctttttcatttacaaggacaccttgcccaccacagagataggtctcgtgtagctcaggttgacctctactatgtagccaagtttggtgttgaaattttctgcttcccaactacttgaatgctgagattgcagctctatgccactgtgccccatttattccaaatgaatgtcttctgacatttgttgtgaagtgggtggtttcccaagttctgactgatgctgtgtttgatgccacacgtgggaatgtatgctcacctaaacacataaagcaaggtttgcacacacacactgaagaaataggaactcagaaacaggctcataggttcacagacacatgtagactttcacaaagttaaaccttagcaaaatcaaaaccaaaataaaaaaccccagggagctaccaagagaaaaagtcccaggatagggcagaggaacaaattagagtaaaggaaaacaaagaaacaaaaaacagagagggcaaaattgagaacaggaaggtcagactcacagggcactagaagtagcctccccaaagcccaacgggtgagagagccccaggaagctgagccggtgaaaggcataaacagggcttcattactctcctttgtagtattcaagaaatgctgacgggccagaggctgtgccactcggaaactcacaatgacacggtcctggcggcgctgaatcagcaaagaagtgatggcattctctgcgacgtgaccctgatcgccgaggaacagaaattccacgctcacaaggcggtcctagcagcctgcagtgactacttccgggtaagtgaaggtggatgtgtttgtcttaggatgtcagtgcacagaggacagcctgatctttcctaggccgtgagccaactacatggcggaaggcagatttgtaagtgttgagaacctgtgtaccttcctggacagaactgagtccaggaccctggtgggacattcactggactgggctgggtggctgcaatgagaagcagaccgttgcatctgactaatacatttaacaagcactgaatggtgtggcagtgacatgcatggcatatgaagatatggttcttttttcctagaacttgaaatttgatttccagctgtgagtgatgtgtgctgatataaccagggtggatgaggtcttttatatttatatttcatttaattatcatgcaaacaccttgtacaaatgaatgcatgtgctattaaaggctgccattttttacatataaggaaacaaaatcttagagagtaaatacttaggattcagaaagtaactaaataataaacacagttcttaacttgcatatctggcatttgacatttgtttgttaattttagaaacttattatttgggggctgaggagatgtccaagtggttaaagtgcagccatacaagtgtgggtgggtactgggtggagctcagatggagtaaagggaaagtaaagtggaagagaaattgaagaagattcctggcctcaacttcagatccccatattatgtgcccatattcatgcagacatagaaacatacagcccacacagaggtggaataagaacattattattgtatgtgtgcatgtgtgcatgtgcgtatatatgatgcaggcatgatgtgtgtgggtgcacataccaaggtattcatgtgaaagccagaagacaactttgttgattctttccttccatctacctttacatggggtctggagatcaaatccggctgccaaacttgtacagcaaggtcctttacctgttgagccattttgttgtctcctctgcccccgtcctcctccctctcctcgtcctcttcctcccttgttgtccatgtattctaaagcaagttcttttaaatgtatcatctattttcaccatctgtctctccctcctgttatttcccctcaattctcatttactcctcctaatcgctcccttctccccaacccccatctcttactgtgttgtcaactgggcagactctggaatctcctgggagataggtctttggatatgctggtgggggaaaaaaaaacctaccttaattggggcaagggctgcttcctaggtggggaccctgtattagatggagacagcaaaccgagccctagagtggaattcacacctctctccttcggacagtggccagctgcctccagttcctgctgccttgaccatgggtaccttgaactgtgagctaaaataaacctctttcccttcagtttctctccttagagtattttatcagaacaataggaaaaaagctgactcctctgttctcgtccaccgatttgcaggtttgtttttgtagtagtgccatagtattttggcactggtttttcagtataacaatagtttttcagtataactttaaatcaggtgttctaagaccttgctacttctagtttctttctttctttgtaatctgtttctgtgaaaaaatcattggcattttaatggaaactgttgaacctgtagatgccttttgataatattgtgatatcaagtctactaacccactagcattgccatctttccatctttggtttctttcttaagtgctcacatttttaacattgtagtttctcggttaggattagtccttggttatttatttatttatttatttatttatttatttatttatttataaagcagcgtgagtggggttgctttcctgatttctcagcagtatgttggttgctggcatatatattaataatgtaagtagatctgtaatgaacaccaagatttccctagttagagttctattgctctgattaaaccacttaccaaaactaatttgggggataaaagaaattaattacaagatatagactatcactgagggatgttgtagtggtttgaaagaaaatggcccccataggctcatagggaaaggcactaggagtggccttaatggaggaagtatgtcactgtgggggttaggtcttacatgcttaagctacatctagtgtggcattcacatgtgctgtcttcagatcaagatgtagaactctcatcttggcttaaatttggtaggccatatgtgtctagaaattttctcatttctacaattttttagaatttacaatttattagattataattttattctatattttattaaattataactttatttctgcaattttagatttttgtaatttattagaatataactttcaaagtatgccttaataatcttttgaattttactaataccaggtatgccttcttagttgtctctaattttattaatttggatcttttaattgtgttagtttggctaaggatttttcaattttttgtcttttcaaagaatcagctgtttgttttgttgatattttaaagtaagatttatttttgttaatgtgtgtgtgtatgtatgtatgtatgtatgtgcctctgtgtggcatgcttatgtatctatggttactgacagagataagaagcctgagttgcaggtggctgtgagctgcctgatagcagtgttgaagtcagagttctctgcaagcagaatacatgctcctaaccaatggcccagctcttcagtcctagtgttggttttttgcatagttttttatgtcattaatttctgtgtttatctttaatattttgtttgcttactgatttgggctttggcttattcttacatccttatggtaggtatatcactaagaaatttactgatatttccctgctcttttgatgaacccacttatagatatagacatccttcccctttagaactgcttaaattgtgccccacaggttctggtgtgttgtatttttgctttcactttattcttctagaatggactctggactctcttctgctctgcagacttttctcttttgcttagctgctgtaactagtgcttcccacactctccaccctcttagtatggctgcattcttcctgtgcctagtttagccccagagattataacaccctgtgcatgggtgtcattccatcttctgatatcttctaattctatccatgtttgactcttgcccagtattctctatgcctttttatatggatacagaaacaaaacctggataattgttaactggaaatgagattaacttctgactatacatttttcaagtctactttttaaggaggtttatttttaaatatttattagtattgcctgcaaagtttgcactgcatgtgtgcctggtacctatgaaggccagaagaggggccaggatcccccagtcctggagttaagctgccatgtagctgctgggacccaaacttggttcttctgcaagagcagtgggaccacttctctataccttttatttcagcttttcttaaatttttttaagtgttgcttcagttgattgatggctgtcttagtcatggttctattgctgtgaagagacaacatgagcaaagtaactcttagaaaagaaaccatttaaatggggatttgcttacaggtttggaagattagtctgttatcatcttgtcagaaagcatggcagcaggcatggtaggcacattgtgctgaagcagtagctgagagctgcatcctagtgcacaagcagagagagagggaaagggagggggagggggaggaagaaaaatatctgagcaaggctgagggcaaacaggtaagctacactgtatcatggcttctgcttcagttcctgccttgacttcttgccctgaccttctcaatgatggactgcaaagaataagatgaaacaaactcttttctcccctggttggtttctgcaacaaaaaccaaaggagaacacggtgctaatataacataagctatacaatcagaacaactagagggagcataattcctgctttgtccatcagagtgcttctgggtaagactaatattggaattgtcaagctgagcgcagcaaatcatcctctgtgattggtgagacttgcacagtgagttgaagatatgggttaaataaaagggcgaaagcctgacactgaggctatggaatactcacaaaaagacctagcatgactgtcctccgaaacacccaacaagcagttgaaagagtcaggtgcagatactacacctaannnnnnnnnnnnnnnnnnnnctccagtgacacacttcttccacaaggccacacctaatcttgtcaaattgtgccactccctgttgactgtgcattcaaatatatgggcctatgggggccattcttattcacaccaccacaatgactaagtaatatttttgaaacatagcattagtgaatattgatctctcattggccaaggtaacccaatagccactcccacaattagtgtaagagagcagttttgactaatagcagtctaaatcttaataagtaggagtatacatttcagtatgatgtaaaaataaatccttttctagaaatactcttctctaaggatgatcatgtcaattgttatctgataccaaactgtcaactctgaaaatatatgtacaagtcacagtctatagattcagcaggctttattatatgcacacacacatatgcatataacagcaattaatataaaagaccccatgacttttcgggagggtttgaagctaagaaaaggaagagagatgttgtatttataatagcagaacataaatgaagtaatataaaaagttcctttacaaaatctttaaataatacagaaattagcagaggtgtttaggccagctaatgattggtttagatatttcaaataataatcctgtttttgtttttgtttttgtttttttttcatttaagagatagtatcgataacattctgttgccaactaaaagtgatatggagcttttgaaagcaggctggggagatggctcaatggctgaagtgcttatcatacaagcagaaagacatgagaacacagatctccaatatcgtaaaaaccaggtgggcaataggcccctgttagcctagtataggagaggctgagacaaggaatccctgcccaactctcattccccagtaagagaaatcctttcttctaagtctgttggtaaacctgccttttgctccagactgtgatgtctgcttcacttccaaagctgtttgttacagaagcaaacctggaaggaaaacttagataaagaaatggtcattgtttgtcctggtcaatttttgtcaacttgacaaaagctagactcatctgggaagataaacttcaactgaaggtttatctgatgaaatgccttcatcagattgactgatgaaagtctatggaacatttttcttgattgacagttgatatgggaggactcagcctactggttgttgtccccccccacccgactcacctcacctaggcagatgaccctgggtggaatatgaaagcaagctgagcaagccatggagttaaaccagtaagcagtgttccttcatgctctgcttcagttcctgcgttgagttcctgccctggcttctctcaaggatggactataaactaaactctctaccttcaagttgaatttggtcatgggttttttggttttcttttgtttgttttatttattttttttcttcacagcaataaaaggcaaactagaacatcgtttcattctgagtgtgtgcagaagtttaagagactagtaaagaacagcctctcccaaccacctaccctaatttagaattatgtgtttactcttgtatcttatgttccatattgaaatgcctagatacagtgtcttgaagtccttggtaacttctgtttctcttgcaacaatgtaatgttgtctcattctttgtaagtgctcagcaaataacttattaaagtagtgaaatgtctcctaattttcatagtaattcatgtataattcagttcttaagatcttagatactaaatgtatatatacaaaatatgtgtagattatgtgcacattttcccttgttaggattctatggagttaagtaaatactggggtataaactagacttttatgctttaaagtgtggtatttgacacatgattctgaagctaacacgcttcttgtttgtttcaagaaacataagacttcaggagtcaacaggctcatgctttggtgtaaactgttccatgatattgccccgagacttaacagattttcttgcttacaacaggaatagtgaaagaacagttgagcacaaagcactttgacttcctgtgatcatgaacattctaagaggaggtataaaaaacattattgagtcaagaaataatggcttagaaaaaagaaatctaaatattaggtttaattccagtagcgtatgcacagtgtggcatttgtcaaacatataactaaattagagccacaattcttaggagggtaatgcagcaatagggagatgagatgggtgaggtaaggagcctgtctgagttctgccacctgcagttgttttccatagtgcttagcaaatggaaggctctacttcaattaataattgctgggttcctcctcctctccaccagctgtgctgtgtaaacatgggcaggttatctctctcctgtggacctgtgctttttcatcagtcagctgattgcttcaagcacgggcctcaggatggggtgctgcagattcagtgatgtcagctgttccctcttcttggattgattagaggtgcctggccatgctccacctgggtgctagtggaaagaagagctcagctctttttatgggttgagctgcttacagggacactcaccttttgatagttcagaatagcgtggttttattcttttctacttttgcattttctgaatctgaaatccccttccgtcttagaaaccttcaataaccatttgactttttctccttctctggctcttctctcctgaacctctgtgcagtactaggcaatgctcaggtgctaggctcagccttcacacactcttagcaccacccacagccccacccacagcccctcccttctctcgcctgttccttcagtgctgccttagcacacgttcactaagcaccatctctttcatctcatgggtttgcacttctcaatggtggaccctttgcctctcagtttgctgttctaccaaggttcatatcgaccaacatggctcatgcctctcatgagcctctatgctgattctcctctgccatgttcctatgttcataaagtcttctgtttttcaataattaaaatttagcttgtctcctccaaagaatcgaagattatgtaccttgatcggcagtagcaccttagagaggtactatgaatagccaaggtaggaaggtccatagcagtattgttgagtaaaactgaattggaaaatattgacttagaggtaaaaagagaagtcaagcagaagctttgtgattgtgtgtgtgtgtgtgtgtgtgtgtgtgtgtgtgtgtgtaatgggtgagtgtgagtcaactgttggtcccctccttttggaagtcccgctgacccagggagctcataagtaaggtcacaggatcctgtcgttgcccattctgagttatgggccactctgtaggtcatttatggttgtagaggctgtttcaaacttgctatctgatgtcttgacttcctaacatatgttcatgtatgtattggtaaaatgtgatgttttaaaaagttaaatatttgagcatcttttttcccttagagcctgcatagtgctgtgtaattttcaggtttgagggaaggacagaagcccatgatattgaaaatatggtctttgttccaagcattttcgtaatcctattcttcagtcattactggagtaaattccacaaatgattactaaatgagaatataatgtgtaattagaaattttcaattcaataaacatttgttgtaagcctgttattttctagacattgagtgaatttatagtcttgtagaagacacaggcaggtggacagattaccacagtataatgtaatcaacaccagggtttggggggttagacttgtatttgtttttatcccatgtttatttggatatttctagtcagtttcagcaatgataaatgtgactgctgtgggtatgcaattcctgtgctccacacatatattctaaatgccttatgtagatcaatgtatttcactctacaaaagagtttgtaaaatggatattagtgttattatgttcatccagaaataaagaaaaggcatcaatactgcctactgggattctaaaaagtggcttacagcctggactaagggaagagcagatgtctagaaagataaaaatctttccaaagcatggttaggatgtgcagttgatagatgtatggataggaaaagaatggtaaaacttcagagtaagacttaaggcctgatacttgagtatctggatagtaggaataagggatgttcttgctgttcatatacctaaggtatggaggaaatgggaaaaagaatggccacaagaattttaaaggaggctgttccattgaagaaacaatggagaaaggcttttgtataaagatgtttctttcagttttctacaagggggagagtcaaggttatattctttactgtgctgtttggtccccagagcctactgcagtgccaaggacatcataggccctccatcttcatttcccctattgtaatccaactgaacccgtttcttgctgtgttgaatcacactaataccctcctaagaacttccttctgcctatatatatatatatatacatatatgcctatatatatatatatatgtatatatatatacatacatatatgatatatatgtatatatgtatcatgagttcatatatgcacacatatatcattacatatgtatatatgcatatagacatagatctctctcttttttattagttatttatttcaattacatttccaatgctatcccaaaagttccccacgatctcccacacccactcccccacccacccactcccacctcttgtccctggtgttcccctgtactgaggcatataaagtctgcacgaacattgggcctctctttccactgatggctgaccaggctatcttctgatacatatgcagctagagaccccagctctgggggaatactggttagttcatattgttgttccacctataggtttgcagatctccccagctccctgggtacttcttccagcttctccattgggggcactgtgatccatccaatagctggctatgagcatccacttggtgtttgctaggcccgagcatagtctcacaagagagagctatatcagggtcctttcagcaaaacttgctagtgtatgcaatggtatcagcgtttggaggctgattatgggatggatccccgggtatgacagtctttagatggtccatccttttgtctcagctccaaactctgtctatgtagctccttccatgggtgccttgctcccaattccaagaaggggcaaagtatccacaccttggtctttattcttcccaagcttcatgtgtttctcaaattgtatcttatatcttgggtattctaagtttctgggctaatatccacttatcagtgagtacatatcatttgagttcttttgtgattgggttacctcactcaggatgatgccctccaggtccatctatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctatctttgttggatcctttttgtggtttagttaacagagtaattatggcttcatagaatgagttgggtagagtacattctgcttctattttgtggaatagtttgtgaagaactggaattacatcttttttgaaggactgctagaactctgcactaaacccatctggtcctgggcattttttggttgggagactattaatgagtgcttctatttctttaggggacataggactgtttagatcattaacctgatcctgatttaactttggtacctggtatctgtctagaaatttgtccatttcatccaggttctccagttttgttgagtatagccttttgtagaaggatctgatggtgttttggatttcttcaggatctgttgttatatatcccttttcatttctgattttgttaattaggatgctgtccctgtgccctttagtgagtctggctaaggatttatctatattgttgattttctcaaagaaccagctccttgtttggttgattctttgaatagttcttcttgtttccacttggttgatttcgctcctgagttcgattatttcctgatgtctactcctctttggtgaatttccttccttttgttcatagatctctttaatatattcatttgtcttatttcctaatacagtgtcctttaaagacttgaggctaatagtactgctcacaaaggggggcaggtctttgcagcatttatactgcctgctgctcagtcaccacagataatgtgcagacagataagcttattatactaaggataagaaacatatagcattgacagttgtgttgctttcagctcccaagctgggtgccttctgtctttatttcttccctgctcctcaaatacaaatcaattctgtgaatatcagtgtgcttttagtaaattatcttttagtttaaagataaaattaataagaacaaatgaacttataaacttacaggtggtacattaatattaaaggtcagatagtcacccacccccgtgtttatctgtcattcagtcaccatgctaaagcttatgtccatgttccaagcagtcactgaagtcagtcgcataattgagagctgctcatttatgctatagaggaatctcacattctgattagaacaggtttttaaagttatgttttaacttagtggaacttatttcttagatcttcatttcataaaaaaaagaaagacaataggaaacaaacccaaagccccattttgtttactttgtatctcctggtgtcttagatagcaaaaattactctgtagctattaaatttatacatagttgtcactgaaatgcagtcagaaatgttcaatgttttcagtagtcagctctgcagcagcctgctccatgactcattgctttactggaggtcagacaagctctcctgaatcacatggttatgaaacacatgtgccaccacagccacagcctattgttttcgtgcttattctttcctttctctgacaattgacatcacatgtcgttcacaaaggcacctacattgcattcttacaacataacctctcattgttcggtaaactggtcattattttccatcaaatggtcttagaacacagaggaagccctgggtaaagtcctgggtgaatgtatattttgacatgggcattccattttaagaaacacgttataagttcatggttagataacatatgttgtgacagaagtttctattgaaaataattttgctgttttgtagacatcaagtgagaatgtcaagagctttacccttgcaataattcctgccagctttatccctgggcacctgcagcattgcttttctttacactctcttcatgggaagatcttctctaccattgtacataattactctaacacagagctaccatggtatccttcactagacaaacagggaagctgtggtctacccacaccatggaataatagtcagtgaatggggaagaatgatttataaggctgtggaaagtcatagatgacactgtgaaagtgaaaggagctaggctgaagacaatattccgggaaaaactgttggagagggaaaaaaggagtagttcttaggagcttgaacatgataggagtaaacagataacaaagggtaaatggagactaccataaactttgggccttagtaatagcttcctaataattggtttgttgtatttagggaaagtgaatttctagtgaaggctctagttttgtaaacatcaagggaatagcttgttacaaatgaatacttttatatttataatatatatttatgaaaatatttataaaaaattaatatcctcttgaagaactgacagctttaataaacttaggtctttgtttcacgtcaaaggaattctaagaaaatcgagagaggatattttcaaatcaagagaagtgtaccagagctggctggctctttagtgccccaaatagtaatgatgatgctccaggataataaatagtattagaagatccagagaaacaaaaccaatatgtaggtaggtcaaaagagagatgcatagatttacggatttatatcactatagaggctagggcattgcccaatctgtaggggcaagctggatatctaggggaattaatggatggtacagttgtccaaatgagaagcatggagaaataagaggaagtcgttaatggtccagtacaagtccgagttctaaaggaaaagaacaatgcccaagcttaacacagagaattccttcttattcaccctttttttttccttcttttttaaaattttatttaatctttttttacattccagattttatcccccaccgggtccaccctctgactgttttacatcccatacctccccctccactcccatctccacaaagtccccaccccatcccaccagaccttcccactccctggggcctccagtctcttgagggttaggttcatctcctctgactgaacccagactcggcagtcctctgctttatatgtgttgggggcctcatatcagctggtgtatgctgcctggttggtggtccagtgtctgagagatctcagaggtccaggttaatggagactgctggtcttctacagggtcaccctcctcctcagcttctttcagcttttccctatacaaccacgggggccaccagcttctgtccattggttaggtgtagtatctgcacctgactctttcaactgcttgttgggtgtttcggaggacagtcatgctaggtctttttgtgagtattccatagcctcagtgtcaggctttcgcccttttatttaacccatatcttcaactcactgtgcaagtctcaccaatcacagaggatgatttgctgcgctcagcttgacaattccaatattagtcttacccagaagcactctgatggacaaagcaggaattatgctccctctagttgttctgattgtatagcttatgttatattagcaccgtgttctcctttggtttttgttgcagaaaccaaccaggggagaaaagagtttgtttcatcttattctttgcagtccatcattgagaaggtcagggcaagaagtcaaggcaggaactgaagcagaagccatgatacagtgtagcttacctgtttgccctcagccttgctcagctatttttctcatatagcaaaagaccacagttaaccattaatcacccaaaatcccacagacatgcctacaggccagactgacagaggcaattccttaatagaggttttctcttcctcggtgacaggaatttgtatcaagttgattaaagttaaccaacacaccatagataacatatcccttatctttcctcatgttgtgtatacgaagaaagaaacaaatgcaaaagtggtttcctagggaaagcatgtcctttaatgtgtgtttggatattgtcttttggttcaaatgttagtaagaaatatccaaatgccttcaaacctttctacccggggaagaaatatcagtggttgtttagagttgattaaagtatgcaaaatgatgaaaggccaggcccttccttatgtatctatagcctttaacatttttgtttttatttgtgagtgtgatgcatgtgtttgtgtgcctgttatgccagaagaggtcatcggatcccctgaggcttgagttgctggcagtcgtaagctgcccacatacagttgtgaccttctttgataaatcatctagaacaaaacagtgaaatgtgtcctaatggttggaacataggggatttctaacagtgttggaaattattagttacatactgcaaaacttatttgtgaaggaaataaatctcaaaagtataagtgtgcctttttacatatggagtaaaaaagttgctttaaaagggctagtgaaaaatttaaactatcaaaatgttttatttcctttgtaccattgttaaaagagtctatatattcacttataactccaacttgctgaagtatactaaatcaatatgatttaaaagtttttttttatcttgaattaaaattaaataccagagttggtacaaacaaatcccctggctatataaatgctagaataaaattatttgaattttttcaataaaaggatattgatagtgaaacaatactccatgcaataggtagggtttctacttctgtggcaaaacacaatgaccaagtcaacttacaagagaaagcatttaattggccttatgttttcagcatattagaggccatgatggttgagaaaaggcatggtggtgggattagctggagccatgggtccctggagttttgagtgacatgcttgctatatttagaaaaagagagcttgaagcaggtgacctctagaagctggaaagatagagaacagaccttccctacaagccctaagagtaccacatccctgttgcaacttgatcttagtgcagtgaaacccatcttaagccttactctacatcctcaccagcatgagcaacttgtgttgttgggcttagctattctgccagcaataacatgaaatctcaaagtaggtttgatttgcattttcctgataactaaggatgttgaacatttatttctttaagtttttctcagtcatttgcatttcctctattgaaaattttctttttagatttgctccccatttttaaatcgtgttgttttctaaatatctagtttttactttatgtatcttagacattaatcctctaatgaatgtgtagttggtaaaataatcttttcctattctttaggttgccactttgtccaaatgatgttgtgttcctttgccatgcagaagctttttcaatttcacgagatccctgtttagttattgttgatccttaagtgcctgcacaggggtttttgagcaggtgttctgctcaaaacatccttttcttgtgctaatgagttcagggaattcttcactttctcttctatcaggttcagtgagtgtatctggtggtatgttgaagtgttggatctacttgaagttgagttttgtgcacggtagtaagtatggatctgtttggattcttctacatgtaaccgtccagttcagccagcaccatttgttgaggataatgtcttcttttcaattcatatttttgatttctttataaaagatcaggtgtccatgggtgtgtggatttatgtttgatgtttactactctagaggcagtggggtcagggcgattggaaccagtgcataagaatgactaaagtctgatgcaataaccagctttgttcagagcatcagacaatttatactctgagggttaagaaggaccttccgagtaaagttatcatgagttcaagctgtattcaatcacaaggataagctgcacatgtgaaattttttttcatagcggcatataaacgtttaattgaataacatcagaagccatagtgagtagtctgaagtaacctctacacctgggagtatcatgaaaacacattccaagaacaattctgcatcttgaagaaattgagagcgcaagactcttctaatgtttacttggatctttcttacaagcacttaaaattctctttccatgagtccaatttttattggatatttggtttatttacatttcaaatattatcccctttcccagtgtcccctctggaaacctcctatcccaacacccctccccttgcttctatgagggtgctcccccacctacccacccattcctgcctcccgccctggcattcccctttcataagggcattgagccttcccaggaccaagggcctctcctcccattgatgcccaacaaggcaatcctctgctatatatgcagctggagccatgggttgctccatgtatactctttggtgatttagtccctgggagctctggtctggttggttgatattgttgttcttccaatgggattgcaaaccccttcgggtcttttagtcctttctctaattcctccagtagagactctgatcagtccagtggttggctgtgagcatctacccttgtatttgtcagagcctctcaggagacagctatatcagtctctggtcagccacctcgtgacttcatgctaaggatagatcatggccctaaggacatgtagcttgatcatcttccaaagacaccttattcccatgagtccattcttgaaccatggtctgacagtttcagtcttcaattcaattctatttctggtttttttcccaataccataggtgtggggaattgcagtctggcctccagtcgagctgagaactgaacctctgtggtgataattcaccttcatgacatggtaggcgttccctcatgctcctggaactctggcccctgcttaagttaccgccccccacagcccccacaagaggagcatggtcggtagcaatgacccaagcttctgaccttcagactaaactcctccccagttacctagcaacagtgaagaccataaaaaggggtgttcagcccccatctcgctctcttactcttactctcactccttttgttctcctacctctcccttctctctcctctttcctttctcgttgtcttcttctctcctctccccctctcccctctccctttctctctctttctttctagctctctctctctctctctctctctctctctcttctctctttctccccgcacttctataataaagctcttaaaccatagagagtctctgctccatgtagatctgctgtgcaactctcaccagtgccaacacttcccctattccctctttcctataacttcagggctacaggatatcacctcagggtccctagttggtggctgccctttgtccaccccctgccaagtggggtcagatgcttagatgtccacctgggactaagtggaaagtgtctggcggctctgcctgtgtctgcctgcccaaagtccaggaactctggctggacgttggccccttttcctcccccacttctccccagggcctccctgggccccccatttttttgttcccaatacatagggtttttatatatagctctgcagtacaatttgactgtggggaatgattaacccaatacaggatacttaatacagtagaagcttcctaaaacacatatgtatatgaaggcgatctaaaggatatcaccaaataatggggtaggcagaacccacaagcacacatttcttatcattaatgaagtttccagtactaagatttcattgcacctcattgagttatttgccaaagggggtcccatttaaactgccaaacaaccccaggctgttgctattcacaaaatgatggcaaggccctattgttgaagacaacacctactcaacttattgaatatagagaagtaatgctggtgtctacatagagcctttgttaccatctttgatacaagaaggtttcaaaggataaatgtaaacaccaagccagtcacaaacccttttatctacagtagtagatctgactgcaagatatgctactgcaatggtggcacaaagcttctgggtgctaccaaccaatatctgagttgacttaaggcccattccatgagatccaacagggcatggataacaagaacctgatgctatatagtccagagatcgaaggtaaaactaaatactactgatctaaaacaaaactaaacaaaaaaacaaccaactctagcaataaaatgactcctaataacattctgctatactcagagattaataccttgcatcattagagaagcttcttcctgcaacagatgggaacgagtacagagactcacagctggccattacgcaaaaagtgagagacctgggaacactcagctctaaatgggatgtctccatcaaatctcttccttagggctcagggaaccccgaggagaggaggtggaaggatggaaggaatgtaagagccagaggggatggaggacaccaagaaaacaaatcatttcaaattaacagggacaacacacatatgatctcacagagactaaagcagcatgcataggcatgcacaaggtgattttatatatatatatatatatatatatatatatatatatatatatatgtatatatatacatatatatgtgtgtgtatgtatatatatatatacatacatacatacatatatgtgtgtgtgtgtgtgtgtgtgtgtgtgtgtgtatgttgtggtttccagcttaatgacttcatgggattcctgagtgtgaaaatgagtaggtctctttgtatatatttttttcttgtgcttcctcttaggctcttttccttctgtatgtttgttttgtcctattttaatgtgttagtttttgtggttttcttattatattatttattttattatattaattatcctttacaaaaaaagagagaatggcatgtttggtatatgaatgagaataagaaggaagaaaagaaaagaaaagaaaagaaaagaaaagaaaagaaaagggaaaagaaaatgactgctcctaggtatggtggaggagaaagtttattatagatatgtgggggagcaatagccagagaggcaggaacatctgtgagagcccagagtggacatgaccagaccgagcttagccatgctgggaaaacaagggagagcaggggaaccaggtgcagcaaccaggacatccaaaggtacaaaaagagcaggatatccaaagtgattggattatatagggactagcatctcagcttcctgggctggagagttcaggatggagagaggggtttgtcagctgggagggccctgtaacagataggtcctgaggaatgtagaagagcttgctggggactgatgtgttccctaaatgtgcttgtcagaatcttttgaagccataaatagcagcaatcccatagtgtgtcattttgtgagaaagggacacttgttttaaccttctgaaataagtttaacaactgtgttctcttagaatggacattaattttctagtattcccaaagctgaatatctgtcatctaagggaaaggaagaaaacagtgtaccatgagaaccaggccagctcatcagccgccatgttcagtcaaagtcaagtagaaaatgagagctctagcttagatgcaaaccctagtatattggactccaatatttcaaccccagtatatcttcttttgtcggacagttaattatcagagcaaacattgtgatgggtcttgttttgaaatgctgatatgaatggaagtctggcaacaaattagcagactatttttataacagtgactttcaaagagaagaacccaggaaatatcttcatagatagtctaggcagagtgcttgggactttgaagcctgactaatggagtcaacttggtgtgtctacaagattctactagattgtagaggcatagggtaaatcaaattccaatggtaggttctagaactctagagtttatatacaaagtttctggctaccccaagaacttttcatgaagggaccggctagtctgtgctctgtataaatttaggactgttagcagtattccatggtacagagaggccgatggtacaagtaatgctactatatgacaaggctaggacctatgcccacactctctacacagaaatatggagcaaggaaccgaggagatggatcagtagattatcacttcctaatcgttgaccaaaatattcaattgtttttttaaaaagggaatgcaatataataaataaaacggtgacatttaagatgaaaataagaaaaatgattattagaaatactataggaattataccaattaacttacaaccttgataaataagttctaggaaatataaattagcaaaactgtgggtagtagccagaatagccacatacttcctcaatggatccagactacctctgccttacttaaaggctgttcctcacactatataaatctgttctgacccataagaatatagaaaatcacacaactatgttattctgttaccaaagtacaccaagggcagtaaagggaaagctatagcttgtttactaatatatgtacacaaattataaataagacatagtcaaatccagtaatggacacccaggtctcctttactcagcatcttaatcttttaatattacctaattttttaattcctttgaccttggcaccccacattcttcaggttttctttctacatactggctgttagctttgtctaatttcaccaaacttctcaaaattgggtttagtctggctcagtccttgcccttctgtttacacatatactcttgcctccgtaggaatttcagtctcatgatttatccccccatagtctctcctccccttccctacatttctagtatgtacacatgcatagagttctacagaactagtaagatgcatttgtaatggaaaagatgtttattataaggaattggctccaaccatttttattgcatcccaagatcttattttttgacaaggtcttcctggcaacccaggacagccttggtgtatcccctggagagctccagcccttcagcataaaacggggctgctgagatgtctagcttgatgtactggataacagctctttcctaaaaccccaaacttgtacattgaacaggctgctcagtaactgtagtcaaatgttttggaagcaatataaagctaggttatctattattaaagtctcaattcagctcacaaagctagttattgtgcaggtttccccagtatatctttataatcaacacagggtccaaatgtctgtgttatccttgactgctaacaagtctcccaggtctgccttaaatatatatggacaagtctcaatcacttttgctactgtcaccctgatctaagctaccaccatcttttgcgtggagttgtaaagaactctgttagaccctcttttttatttcactcttcagtcccacagaggctgttgcagagttacagccccagtgatcctggttgaaaatgcacctcagactttcacaccttctcaacacactatgctgctgtctactctgctgcagaaggaaagctgttccctcctaccgtgcccaccaccctaggcctcattacctgccatccttgcctggcacaccccacctgggtcctgtgcacagtcatcctctcctggaattatctcctcctacaaagcttgttcttttgctgtttgttcaaatattgccttttcaggaagtaggattttaattttatttaaacctaattattatagaaaactatattcatatattatgtgtataagtggaaaaccagtcaaaagaaaaatccaacatttagctgtacaaaattgattgtctaataatttcatgcttgtatataatgccttctgatcacatttatctctacctcctttcttagtttctttccacgccagccaatcttcctacttatggccttgacattcagcaaagccaaatgaagcaatcatgtgacattatctagccagcctgttaccaagtctcacatttgatgggcatcagataagcactaattgtctggctagcaattagcagcttcacatctgctgctgtggatgcagcatacagtgggaatgtcgtgggaaggttaattttggatggaagcagctagaactcccaggggtgttatgagtttattttgaaagataatagcttcataatttccctagaccgtggacattcattaaaaataggattcttttggaattcaaggtgtagatagatatcagttagtagtgagattgaccaaacatcccatactttttacattaaaaaaaaaatctgagagacatcattgtattcctcttttgaattatttgaatcagtgatagagaaattgtttccagttgagcatgatgactgtgtttttatattgttattcttatggctccctgtattcattatcctgaatgcagaatggtgaactctggtttgtatgtattatttctttatttgaacggattcatttacactcaatgtaaatatgaagagagagaaaaatatttatgaagtgatcatactggctaacatttgatatcattcatactatgcctactattgtgtacagccctttatatgtattttattcgaatgtgtgtggaaaaatgatttcttttttgttttaatgtctttttaatgctttcaaaattataactttcatgggaatgtttagttgcaataacattttcactcatgcttgtttttttcatgtgtacacataatgtcatcttgatctgaatatgctcaaaggataatatatctgatgaaatttttaaaacttgaaaattgagtattgagttaacacagatgtcttatcaaagaagggaaagctggctgatcatgtcaatctgatgaatagttcctgggatctgtagaggcgctgcactcctgtttatcatcgttgtaagcactgactcagaaggagttgtccacactgtgggatgatccagctgcttgttgaatcaattgcatttaattagcccatctgatgttgattgaattctgggcttgcatgcctggattcctgaaaaattgaattatcagtattcttctcatttagaaatatttgaatctaaagtgatgaaagatttttacaccaaattattcttattatgttgtgttcataatccatctatggcatgttctcagatcctaccacagtctggggaattcagcctcctgtgaaattcaataatacgtggtaataatgcaatgaccaagcaggcagcaagtatttatcctttggtatcatctgcagatgggagaggcaaaagagagaacttccatacatctaaacagtcaagtgcctctgtttttttttttttttttttttgaatggaaaggcccactgctttctcagataatcagtttattcttgagagagagacaaaagtgaagaatatggtaaagtatgtgggctcaagtcctgactttacctaccacttaccagctttctcaccttgggctaaacactaaagttctagtgttttcagttccttcatgtttaaatgaggtaaaagagaaaccaggagaagttatttattcttagaaattactaaaattatatttacattaatgcattcactcactatgtaggtggagggtattcatggcgtagtacctgtgtaagtctagcgcaatatgtgaaacagttacctccttctgtcatgtacatcgtgggggttgaactcgtgttgtcatgcttggcagtgtaaggatctgcaattctttgaagaatgataccccaaactcaaatagtatgcaaaggcaaagagtgcttattctacaaaaattaccagcatgcagggatcttcatccacgaaaatggagacacccagtgtattcacagtctcagctttcattgtcagatatgggtatgccagggaggggcatgcacccttttaccttgattggttagctctttctctagtggtctgactgattctataattagttaggctctggggactttccagggtggtactccttgtagctacctatttttgctgtaggacagatggcaagatgtcctaggattggctgccttcagctgtggttggctgaccgcaggttcctggatccgggctttcatttctgaaaacagcaacttagggccactctcctgaacagtcaggagagtgtgcagcccgtgatggagtcagcctggttctggatagctcagtcctctcagcagcaggagcctttacctgctgagccatactgccgatccatcttcctaattatcgaaaaaagtttatttcactcaattaagaaagaaagaaatatggattatatgtatgcaaatacaaatatgtgtaacttttgagaagtcagttaattataaattattataaaatgtgatcaagatctcttctcattccgtaggttgccttttttgtcttttgcccagcagaagcttcctagtttcatgaggccccatttattaattatttatcagagtgcctgtgctaatggtgttctgttcagaaaatcttttcctgaggcaatgacttcaagactattctctacttaccctattatcagaaaactggctacctttttgtcaatttgacccaagctagaataaagaagggagcctcaattgaggaaaaacatctcaattgagaaaatacatccctacaagataaggctgtaggcaagcctgtagggcactttcttaattagtgatagatgggagaaagcccagcacattcggagagtgccgtgctgggagtagttgtcctggcttctgtaagaaagcagaggagccatgaggagcaatcagtaggcagcactcttccagggcttctgcatcagctcctatttccaggtccctcccctgcttgagttcccatccttactttccttgatgatgaattgtatgtggaagtgtgagccaagtcaagctgtcccctgcaagtgtctttggtcctggtgctttatcatagcaatagaaaccctgacgaagacaatcgtgttcagtatatctggctttatgctgaggtctttgatccatttcgaattgagtttgagcagaatgacaagtatgggtctctttgcattctttcacatccagccatccgtctgaactaacaccactcgctgaagatacaaaagaagctggaaattgtcctttaaagatctgtaaagaactgtgtgattgcattggatctgtagattgcttttggaaggatggccattttactatgttaatctttggaatccatgaccatggaaagtcattccctcatataatatctttttctattttttccaatgatttaacatttctatcatacaagtctttaacttgctggggcagaattaccctaagacattttacataatgtaatgctactggggaagattttgtttccctcatttccttatcagtccatttgtcatttgtatatagggggcagctactgatttctgtaagttagtttttgtgtccagctacttgcctaaaagtgtttctcagctgtaagagtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatttcagtggaattgctctgaatttctctccacttaggttgatgctggctatggggttttggtaaactgcctttattatgttaagatatattccttgtatccctaatctctccaggacttttatcatgaagggttgttgaatcatccaatagagggctaatatgcaaaatatatgatctcaaactagatgtcaaggaaacaacccaatttttaaaaaaagtatgtgtggttttttttttttttttggtggggggggtacagggtgaatacagatctaaacagaattctcaatagaggaaactcaagtagctgagaaacacttaaagaactgttcaacatccttagtcaccagggaaatgcagatcaaaactactttgagatcttatcttacacctgtcagaatggctcatatcagcaaaaccagtgacagcgcatgctggtgaggatatggaggaacactcatccgttgctggagggaatgcaaacttttgcagccacagtatacaatcacaatatacaacatacaatatacaatatagtatacatacataggcctactggctgtggtctagctagtccaacaatggttttctaataatgttcagtccatgagcctggatgtctctcatctggtacttagtatatgccagaattctgaagaggtaagttctaattccaaggaagaagtagacttgctagtctgatcaatagtaaacaggcaaaaagagcaagcttcctttttccatgtcctttatataggctgtcagcagaaggtaggtacaacccagattacaggtggatctttccacctcaaagggttcaggttaaaaattgatcactccacatttcaagtgatttaattaagaaaaaaatacctaatacatgtatccagacacttgggcttttgtaattccaaatatgtcaagttgacaactaagaatagccatcacaactccatcccttgtcaacctaatgcacaataatatctccttacatcatgcttaattttcaagtgaaaaatgaaggtcataattatacctatacaaaatgatataaatatctcacatataatcacaaacacattaaatatttaaccaggtcattattatgcttaacatgatataattatccctcatacaaccacaaacatattataaatttagaatgccccttgagggacattcttttactatcttaaacttagatgtcataacccctgatattctcataattgatgttatactacatgatatagaagtcaaggagagaaaacacaaatatctgtataagcacattcttaacaaaatatgacaaaaacagtcattatagttataatcctcatttctgcaattggccatgtggtgttagctactctcttcctctactactcattctgagtttcctccaccctcagcaagtacctcagtaggtcttggttctttttatggagaagtgacaccttcattcctaaaggatccgtgtcctttgtcatcctgtttggattaggctgttataatttcactctgactttaattacagaatgcggtagcagcaagagatttgctaaaggatctcttgcactccagacataatctttcttattcccattgtggagaagccaaccaatttccctttggtaatctggatcaagcatccctcctagcacttattcctttcttggcctgtaagcttaatggcatcagaagaccaacgtgattagaggggaggtggagtgtgagcttccagttcaataagagtgttgtgtctcctggaaaaagtgctcctctctctaggaccaaaatttttaggtcagcagacttaaggtaatgggaacagggaataaacatttttcttgtgagttggtagaggtgataatgagtgggactattcttgattccttggatcctaggtatgaggcaaactgtactgtgtattaaaacctgattcaaagcatattctgcctcccagagaaccctgccccagccctccaggctgccgctacctgattggcactgtaaatatgtcattaaaaggctattccatctttctatcaggccaactgcttcaaggtggttgagaacatggtgagactagtggatttgatgatcatgggcccttctctggctgtaaagtgagttccttggtcggaagcaaatagaataccatgattatggatagggcagtctataaaaccatgggtggtagttttggcagaaacattacatgcaggcaaggcaaatctataaccacaagaaatatctattcagtaaggacaaaatgtcttctccacagaggaagtggtccaatgtgccagaccactagctggtcatctcagagaatggtgtcatgtctggggttcagtgttggtctctaccaccatggccactttctttatgtgcacttttgcattgtaacgagagtagaaaccatatgtgtttgggcagcttctttaagtaatttgctttactgcctttggggcctgctcagacatgatgacatatataccactccacttctatttgataatgggttactgctgtgcacgtcctgctttatgacttggtgagtcagataacacacagctcatgatgaggcagctcagcttgaattgtaacttggtggcccatggtcaaaccttcagtttccactaagaatcagtaaatagcaggctgaaagctgtctcttaaagggaaaacagttgcttgcagattatggtagagccttgttcccaaataccaaaggtttctctatgattcacttgtaggaaccctatctgccactggtacttcaagttccatcaggtctgatggaccatatggtccaaatggtggagcagcttgcacaacaacctgtgcttgttgaagagccctttcctattccagcccccacataaagctagcagctttctgagtcacatcgtatatgagctggagtaacatacccaagtgaggaatgtgctgtctccagaatccatataggcttgctaaaggttgggtttctttctttctgggaggcaccaggttcaataatctagccttccatttaaaacagtggtcacaacaggaggaactgtattaaagggtcacagccctatatatgttgaggaccactgttttaacttaattctatccatttattctatcctttatggatggttacttatgctcaggtatcataatccatcacctcacatcttcctggtgcaatctctacaataatcaccttgtatttggcaattcagggctgctacgtggttcctgctacctcaggtcccaattaaacccaatgcatttaattcatccaactgagcatcaacatctccaaccctaatgtctgacaccaggcaaaggtgataccaaagctctttaaatgtgctggtgtccccacactgtcttgtgtcttatagaactagtaaagggcatgtcttttgggctttcccattgtgggcaatttggtttcatatagcataccctctctagtattgcaattttcctgagcctcaaatcctttcagcaacattaagctaaagatatccagcatttccaactccatttcagtaggcatcttttgacaaatgcttcatccaaccatttaaacaaacttttgacatttaaaaaaaaaaactgtacaaactttcgaattatacctacaatctccactcagaggactcagattaatacaatcaaccttatccagttttatgtttcatccatcattttccaacacccttaaaacccattcccacacaaatttcccagattttctcttgaatgcattagcagactcattaagctctttagtaatgtatcacacctcctcctggactacactttcaccctcccctctagaagcctgccttgccttaagtctggttatgggtctagaatcaactattgatgagcactgaaggacataagtgttgtcttacctgacatctccttcagagaaagttactgcaggtaacaaaccatgaaggattaatttccttactcaaagggggaaaagtcaatttctctggggttaggagttaatatgtcttctgctatgggtgtcgagactactttcttaggtgaaatagagccttgtcaatctgagggttcacaagatcccattcattaccagttaacaccgtttcttaactgacaacatccttggctgatggagataagattctcttttagacttaaacgtttagactgcttatgtgcagctggaaccagtcagctttatcactgagttcattactatccttaccgtattctgagatgatacaagttggttgattttaccgcagagctcattcttttcttttgtcagtttatccagagatgctaggagcaactagatagcatcctcatttttcttatctttccaccaactgtcaaaacatttatgtacagaatcatgagatctattgccactcagaaaccatgaatcaggaaaatcaaatacatttttcctctttaagtttgtaaaatacttcacaccatgggatttccatattttccaagtgttaggaatggcttcagtaactgttggtattagcaaattagcaagcccattttaatttttaaaaattctatatatttacaaattcatctttgtagttctgttactttagaacgacatttggtagcaatacctgtatcagtcagggttctctagaggaacagaactgattttgtgtgtgtgtgtgtgtgtgtgtgtgtgtgtgtgcgcgtgtgtgtgtgtgtgagagagagagagagagagagagagagagagagagagagagatgtgatgtgatgtgatgagatttattggaatggcttaacggctgtagtccaggtggttcaacaatggctgtctactaacaagagattcaagaatccagtcgctcagtccattaggttgtatgtcttcagtatatgccagaatcctaaagaagtgggctctaatgccagtcaaggaatggacttgccactgagtgcaagaactaaaaagcagagagagcaatattccatatctttcatataggctaccaggagaagatgggtatggcccagattgaagctgaatcttcctacctcaaaagatcccagattaggagtcttcccacttcaaatgttttatttagaaaagtactgtcacaaatgtacccagtgttttagttannnnnnnnnnnnnnnnnnnnattttagggtaaattcttgaataatcttttgtttcccatgggatgtatgtgtgtgtgtgtgtgtgtgtgtgtgtgtgtgtgtgtgtgtgtgtgtgtgttgatggagatgggacccaaagtcttactcaagttaggcaaatactatatgtaagacttagctagtctctcagcccagtctgtcctgtttcaccctctctagtgttgtgattacagtcgtcatgtgtcagtttgtattggactgtaagagagaataacaatgagttttaattgacctcaatccatactgttacctttcaaaattcttttaaaagttctgtataaaatgtgcaaagtggctttgtgggtggcattgtgatctgtagggaaaagctatgatttagtgtgtgttctcctggttcttagttatttgcattatagacctcatgactccatgctaaccacactctgatcctcgtgtgaaatgagtgtgacctcagtcttcatacaggctccaagaagtcattgctgatatcagaatggacaaacaagagtccccttgccattcttccaagcaagctgcaactattttaagattctgtgttttgtgtttcaaagttatatttaagtggtttgtatgaaagcaattctgaggcagttacttgaagttcctctccaggaaaatatgatagaaaatcaactcacaggagttggggaaaagtggtagggtgaagtgcttgcctaaaggctttaacttcttccccatacaagatcataggatgataactctttcaaaaaacagctgaaatgtgtgctcaaattttataaaagtaacatttattatctcagaaatatttttttctcagcccctcagactctagggataagttgaacttgctgaaatttggtcaacagggtttctaggaggactcagagttgagggttggttgttctttcttgggggggggctactattactagatatctgaaggtctagtgagtagaaatcactgagaaatttactggtagtataagagaggagaaagctatctagatagcaattatgatttggtacctttatataagagttttactaactgtcctccagcaaggtcgttgcgaagctcaaaacttcaaatattcagacatgcaagtagtgatgaaagtgtagggaattgatggtacctgcacgtctcaaacattcaatatgtctgaggtctgcctggagttgtcattaaaacataacttcccattcggtgagtgtggggaggtacccaagattctttacatttatcaggttcttaggtgaagtcaatgccaatagttcagaaaccacatctgaagtagtaacagctcagcaatctctgaagtatcaataatgtttgaaaaaaattaactttattacttatgtaaatgggtgttttacctacatatatgtctatgttccacttgggtgcagtgtccattgagaccagtctcagggtttggagtcacagatggtggtgagcctcactgcagatgctggaactgaacaggtctttgggaagagcaaccgatgcttttaactgctgagccatttctgcagttgctggttgttagatgctagttgtgcttggtggtacaattgaggctggagcaggaggatctggagttaaaatcaaatctagattccagagtgagagcttctcaatgagaaacaagcaaacacccaataggtaacacaccacagaatgtagaaacatacttgttggaaagaagttggtttagctatgattcttaaacacactcacatagctcaaagcctcttttctgttataggattcccctagattcctgttttacattcttgagtacagacttctccattgtgctctccaattttgcctaaggataactgtctatatgcaggaaattcaggtgcccacagaaaactttgaaaagcaggattggctgccatttggagacagactagaatgtctctgcacagggaagtgttcttaagatgaggtgacagaagcaagaaagtgacccagtgacatcatcctctagagggcataaccgctctcatggataaatactttccttcagaggtttaatccatctctgtagaaagcattacgttttggctttcacatttatgttaatgttagccaggagcaacttggtatgtatgatttttttttcatcttgttattgtctacttcagaagaactactttctagagggaaagaaccttacagaatacaggaaaagccacaatggtacttgtgttgcagggtcactctcagcactcattttaaaagcaccttccagaacaaagattcaaagcacagccagtcctttgaataagcaagcaatgtgtttgaaggtgtataagctgggcaatggtggtgcatgcctttaatcccagcactttggtgacagaagcaggcggatatctgtgagtttgagaccagcctgatcaatagagttccaggccaggcattcgagaggatgatgtgctgggtcacgttctctaatgccttggtctttcctgcctctgtcaccttccagtccccgatcagttgagaaggggagcccaatgctctcttgacatcatttaaagaagttcattttcagaaccgagcaggattagctgccatctgaagacaggctagaaggtctctgaaagcgctctgagacacagtctcacagcagactttctgtttctctggctctgcccctgagccttaggtgcaggagttgtgttaatggacagtgtgacagtcagggctggacaccgcaatggtcacttgttttctgcattttttgactgtgattttcataacgatctccatatgatttttctttattctgtgtagttgaggtaagaggaaattggtatttctaggacagcctacaaaggctatctatggccttataattttactgttttggtttccctgtggtaccctgttacctgagagcattactctactgtttggagaaaacttaaaaaggttataaatgtattgcagactaaaagatttcccactgaatccctctactctttcaggcagtgattcaccccaaatggtttgggttcctacatttgtgagataaaagaagtaaatgatgcagagcagctgtgtcaggaaccaccccttccctgtagaggacaaagacatggttgcagtgaagtgaatggtcttattaactaaagcttgctacatgttctgtacatgagctataatcaatatgcagtaaactatgactattaaactataaagccataaactactgtatcaatatctaattgagcaaaacatatataatctttgttgattcagaagttagttcagatctcggcaacatctcgtgactatggtaacaattgtggactaattatatacgacagggtgtatatataagatgtagaggcctagactagatctgctgtagttattatcaaaagtgactttttataagtggcttcctgaaacctactgtttactttaatttcactttctatcataaaaggtgagatataaatatctgttcttaacaatttaattattttgcccataagtatgtcttgcccacatacagtgctcacagcaaagctacagattacctgataaaaagccaccatatttcagcatctttgaatgtagtgtgtcagcacatctgtcacttgctgtcttactaatcagtgacggtgtcactttttgtcagtcttaagaccttatgtgctgactttggtgtggttgtagttcatcttgcgactgaatgacaacccgcatgatccaagccagcttaattcatggactgtgatttttagactcaatttgtgtcatttccctgtgaataaagagagaataatgcatcataaacccacagctcactctgtggtaggcactgcaagttgaccgccttcccacaaaatgagttttcaattagaaagatctgtggctgcagaagcacattaccagctaagagtaagctgtgaagactgtaaatatcagcctggccacggctctcccagacacaagacagtgtgaaccaaacaggagtcagagctgtgttttcatactccttgtaagaactggctcccgggcattggcagaatgttgtggccatatgttttgtgtgtgtgtgttttgtctctaaatgtctagctttgaacttgctcgaaatgtgtagcttatgttagatgttctttctaacaaatacaagttttatatgtccatatctaacacggaagatattttcttagaacaaattcttcttgcttttgccactgtaacagtagatcgttagtgtagtggttttgagaaacatcatggcttgaacattcatttacctgagtgtggtgccatccctggactggtggtcctggtttctgtaagatttcatgccgaccaagccaggaatgagcatcgcacccttactcttcatcagccactacctccaggttcctgcctgttccatgttcctgccctaacttcctttgatggaagtgtaagctgaataaagactttcctcccctatttgtttttggtcatgatgtttcatcactgcatggtaaccctaataatgtcaagatatcttctaaatccataaactctaaaggtagctctgttagttgtttttatctatagcaaccctggattttcagtattctcctgttgtattattttctgtaggaaaaatggaaaggaaacttaactttgtttctttattacaaaaatacaaattttgttaagaacttgtcatatttaaagctgtattctgagcactttatatgcattgctagcttgtagtcatcaaatccactaaattgaatactattatcattattattattattagtgtgtgtgtgtgtgtgtgtgtgtgtgtgtgtgtgtgtaggtgtgtgtgtgtaggtgtctgtgtgtaggtgtctgtggaggctacaagagggtgtctaatctgttgactgaagttacaaatggttgtggaccacccagttagggtgctgggtactgaattctctagtactctgcaagagcaatgtgatcatcttttcttttcttttcttttcttttcttttctttttctttttctttttctttttcttttcttcttttttcttttgcttttattaaaaaatagatttttctaacttaatatatcttgattacaggttctcttccctctacttctcttagttcctcctcacatccactctgatccagatcgactccctttctgtctctcattaggaaatgaacaagcttctaagggataataaaaaaaaataagatataataaagttagataaaataaaaccaacacatccaaattggacaaaacaaaccggaggagaagagcccaagagaaggctggagaaacagagacctactcattgctcactcaggaatcctatagaaacattgaactggaaacagcaagggacctggtgcaggcctgtgtaggccttctgtatgctgcattagtctctgtgagttcatctgagctttgatcatgttgctttagagggccttattttcttggtctcctctatcacttctggctcttccattctttctgtctcctcctcagtgggttgctgatccctgaggggagggatttgatagagacatcatgtgtaggtctgagtaatccaaggtctctaaactctctacatatcgtcggactgtggatcagcatatttgttcccgcctattgcaaggggaatcttctctgatgatggctgaacaaagcacttatctatgactttaacagaattaggagttattttattgccacattttttagaccagtattatttggttctacgttaggtactggggtatctagtctcaggttcttggtcacccaagcagtatctggtatgggttctatctcgtggaatgagctatacgtcagagcagatactggttgatttctttcataaactgtgctcctgtcgctctagcatatcttgcaggcaggacatcacagtgagtcaaagactttgcatctgggttgatgtttaccattccattggcagcatgaagaatactttcctatgctaaagacactagaacataggggtaaaggtacgatgtaggcaccaactcaacttctttgtgttctatgagctgtgtaggtattgtcttcagcaatcaggcctagctgtcattttgtggagaccaacctgtagtattggcaacaacctgggttgtttcggggttcccatgtgacccctttgaccaacaactcaattatatttaacccattcccagaagcttcatttggtgacaatagaagtgtacttggggctctctcttcccatcatttggtgatttcttttacgtcacctttatatatgcccatattttaggaagtgcctactggattctctataccttaaatggcacttgattttagttgattctccctgtatttccttgttgttccttcatccttcactccccatgtgattttccctgaaaaatttccccccagtaaataactgtatattctatttccttttcctgacacgatatatgtgtccccctagtcccttcctctatacccatctatacccatctatgtggttatattaactgtagcttggtcatccttgacttaatagttaatagctgcatataagtgaatatataccatatttgtcttgcaggtccttgatactttacttagaatagctttttctagttccacccatttacctgcaaatttcgtagtgtcgtttttaatactccactgtgtaaatgtgccatatttcctatatccatcattctgttgaggaacatctaggttgtttccagtttgggctgttatgaatggagcagcaataaagatggctgagcaaatgtctttgtagcaagataaagtgtcttggatatatacccgagtggtatagctggatcttggggtgtactgagtactctcttcccaagtaattgcaataccgatttacatcatggtgagaaagtttacactcccaccaccaataaatagtgcctccctttgcatcctcaccaccctgagctgtcactcgttttgttgatcttagccattatgacagacataagatgaaatctcacagtagcttttattatcatttccttggtggctaagagtgttgaacatttctttgtttctcagtcatttgagtttcctctgttgagagttctccagatctgtgccccatttttaaattgaactgtttcatgatgtctaacttcttcagtttatttatgtttttagtattggtcctttacaagctgtggtgttggtaaaactcctttcccattctgtacactgccactttgtttgaattatggtgtcctttcccttacagagcttttcggtttcatgaggtcccagctattaattgtcaatattagtgtctgtactaccagtattctattcataaagtcttatatcttacaaataatttgaaggctattctcaactttctcttctatcaggatcagtgtgtcttattttatgttaaggtcattgatccttgtggagttgagttttacgcagggtgataattatggatgtatttgaaattcttctacatgcagccatccattttgttcagcaccatttgttgaaactctggtgtccctgggtgtgtggatttatgtctggatcttcaatttgaatcccatgatcaacgtgtctggtttggagccaatatcatgctctttttattattttagtttggtagtgcctcttgaaaatagagatcatcatacctcccacaggttttttactactcaaggttgccttttagttaattgtgataatggcttgttaatctttctgtttttcacaaagaaccaattgtttgttttgttgattgttttgtttgtttgtctcaatttaatgaatttagccctgaatttgtttgcttcttgccatctactccttttgggtgtaatttcttcttttttgttctagagatttcaggcatgctattgttagtataaaatttctcctcctcctcttcctcctcctcttcctcctccgcctcctcctcctcctttcttcttcttttttaatataggcacttagtaatattaaccttccttttagaatcaccttcttgtaatttttggtacattgtgtattcattttttttcaagtctagaaagcctttaatttctttcttgacctatttgtgttgttcagtttccatgaatttgtaaactttctgttgattctgttattgttgatatccagctttagcccgtggtggtcagaaagaatgcatggtgttgtttcaattttcttgtatctgtagagacttgctttgtgtcccaatatgtggtcagttttgaagacagttccatgaagctctgaggagaagatatattctcttttgtttgaatgaaatgttctagaaatatctgttaggttcatttagcctgtaacaccagctacttgagcatttctctgttcagtttttgtctgatgactctctattgctaagactgggttattgaagactcccagaatcccagaatgtgggtcaatatgtgatttaagctgtgtcttttacaaaattgggtatgcttgtgcttggaatatagatattaagaattgaaatgtcttcttggtggatttttttcattgatgagtatgtaatttctttcttgtctcttctcgttagttttagcttgaagtctattttgtctgatattaatatgaatacaccatcttgcttcttaagtctattagcttggaatatttttccattgttttaccctgaggtgatatctatttttgaagtttaggtgtgtttcctggatgcagatgaaggatggatcctgttttcacatccattttgtttatgtctttttcttgggaacttgagattgctgatggtgaaagttatcaatgagcagtgtttgttgttgattcctgttttgtcgttgctaagtattggtgtgtgtgtctctgtgtgtgtgagagaggagggggaggggaagtggaagggaggggagggagagagagagagagagagagagagagagagagagagagagagagagagagagattttccttgtgctttgttgggtgtagtcaaactctttatgttggagttttccttctagtaccttctgtaggactgggtttataggtatgtttgcttaaatttagttttatcatagaatgtcttatttttttattcatggtgactgaatgttttggtaggtgtagcactctgtgtgagtatttgtaatctttaaagatggcagcacacttgtctatgccgttctggcttttatcttctcaattgagaagccaggtgttactctagtcagtctgcttctatacattacttggtctttttcccttgcagattttaataccatttcattgttttgtacatttagagttttatttattatatgccaaggggactttttttctggtacagtctatttggtgttttgtgtgcctcttgaatcttgattttgagctaggaatttaacattttcttttaatatttgagttaggatttaacattttccttgatagagatgtccatgtcttacatcatgtcttcaattccctgatattctctgttccagcttctgtgatctgctgatgaagcttgcctctgaggttcttgtttaagttgctaaatttttcacttccagatttctatcagtttggattttctttgattttatttctactttcattgatttatttctactgtcttgaatgattttattggtttcttccacagtttatagttttataggtttttgtaagacagttattaatcttctctttaatgagctctgttattttcatatttttctggtctttgtcttgtgcttcagctatgttacagtacacaaggcctgctgtggtgtacgttgctaggctctagcagaaatattttatcctgactgtcgtggatcatgcttttaagcttaactctaggcatctgggtgtgggaaaactgtaattctaggtgctgatatatggcctcatgttttgttggatgtttcattctttcatttatgttttctctctggttcttagagaaagggtggtggctatgtgttgcagggtaggaaaattcttctggagtcctgataggtatgtctaccaggggttctgggtgaaatgtgtttctaagtgttagaagctgacagtagaaatgggagtttgttaggttgcagggggatgagtgtgctcagggtagtgttccatcaggaactgcttagtctgctgggaatggagatagagagtgagcagaggcacagcaggttgcctgctatagggcttgaaatgagactcatggatttgacttgaaggaatgaaagatgatgtgaagttctgcagtcagctcacctgctttggtggctaaaatggcccatgtgctcccagaggaagcctgttggagttgggaggctgagagaaagcaatgactcaagggaaggaagtttgcaggggatgatctatgtgagccactcagaagtgggggtgagaagggacgctgccaccgatggtctgaaactgagctggggataagactgtaggattggttttggaaacagagaggtagagacctacctctacatctacatctagcctcctgtgtccctggacagagcagcctgaggcttcctagagttgggagctgggataatgcaataagttcagcgagggaagttaggatggaggatgtgtgtggtccacttagagatgggggagagaagaaggggaagcctcagcaggttgtctgctgtaagggtagggatgagactggagtgttgtatttggaggagctaagggagggggtgaagatcagaggcagtatgttctcttaaccagtaagctatccttccaccaccaccccacaaaacggattccgttttagtcccattcttcaatggagaaagctggctgagatgctaagtgtttgcccactcatgctgtcgtgtccatactcaggatgtgcatctgcccttgctcttccaccttgagagagatgtgatgtcacataattaggtcccgtttcaactttattgaaatggtatggaaatacacatatatttcaagggaacaagataaagtattcatatacttccatattttggagtagtcatagtcaagctaattggctgtttatcacttcctatagttattgctattctctatccatctctcttcttaccattctctctctatcccattcttttcttctctctccctcactgcccccttctctccccttggagtgactccatttaaaattctggtaaatcttagtgatagatcattgttagctgtagaaacattgctgtatatcagatatctctagaatgttgttatcttgggtaagtgaaactttttattctttgagtcctattttctccttatctgagcccttggcaacatctttccttttgttttgtttgtgttttgttttgttttgttttgtttttttcaagacagggtttctctgtgtagccctggctgtcctggaactcaatctgtagaccaggctggcctcaaactcagaaacccacctgcctctgcctcctgagtgctgcgattaaaggcatgcgccacctcgcccagccaacacctttccttttggttgtctttctttgttttatttgagatttcctcctatttaatggctgagtattttcccttagcatggatgcaggtacatatctattctctgtatccattttttaggttatttctataccttggcttttatgaataatcttgtggtgggcgtggtatgctgatttccctttggggtatagatcttatattatttatatgtaaattagtcctcctccattatctaaaagtattcaaagaactggagtcagatgcctgaaattgtatataatgctaaatcctacatattcttttatttctcttatataagcaagctgtgaaaagtttgatctataagttaggtataataagagctaaacaacagtacctcatgctaaaagtacaacaatataataaaaataatgtgccttggcccctctcaatgtattttattgtatagaagtcatctttctcatcatgtgtgagatgatatagctccttgaataatgtgatggagtgaagctattgatagagaggttacaacctgcattaggctggtctgtgattccatgccaattgatgtagtaactaaatggctcctcagtcactaaagggtagctttaccctttagtaaactttgcatggatgcagtggagaagggatgcacactggagatgtcatcactctatcgtgcatggtgtgtggttcatttttggtattttacatttaagttgtcaaactgtgtttagtcaaacacagttgtgtgtcgataactgaaacagtataaggcaaggattattcactgtgaaaagagaacaagattataaagacaaagacatcagaagagacttgactctccacatccattgggcagaatgttcagtatggctgcacctcatgtgattccagataaagaaatgagttcagtgagcctgagcattattggctggatgattgtgctgagagagtgtgtgtttgtttactataactgtctagctatcagatgggtgcagaggcttgtgaaaatgaaggtttttggaagtgtttcagaaaccaaaattacatttcaactgaaaagctctctttttttcctggttcctctaggacattgtctttctctcttgctttttagatcccataattcagtctttccttttttactttcctcatttcaggcaatgttcagtctttgtatggtggaaagtggagccgatgaagtaaatttacgtggtgtgaccagcctgggcttaaagcaggctctggagttcgcatatacaggacaggtacggtgccaaaggagatacaagcagctttgcttgttaactgtgctcaatcaatggtacttgtcttcagtggatatgatttagtttctgtaccctatgctcattttaatatttaaaaaaattcacatctgtttggttttataactgacataatggacaggtgagtaaagtcatttgatttctagtgttatctagaaacatagcattttaatccaaactctgtggttgtgaagattgttttttcatgattcaaagtactgccacaaggaaaagaggtgcagttagttgaattctagttatcacttaagctcagtgacccagttatggctttattgcctaaaaatcaagagtaaaacagggcaagagctatagcccagtgatagagtgaacaagacccacagccacaaagaacaaaatcaaaattcttagttagggttattattggtgtgatgaaacactgtgactaaaagcaggttagggaggaaaatgttgacaccatagttcttcataggaggcaatcagtccaggaactcaaatagggcaggaatcagaaggcaggagctgatgcaaaggccatggaagaatgctgcttactcgattattgtccatgacttactcagccaactttcttatagaactcagggccagctcagtagtggccctaaccacaataggctgaggccctcctccatcaattactaattaagaaaatatcctatatgctcacttgtctatagtctgatcttataaagccattttttttcttgttttgttttgtttttttgttttttgttttttttgtttttgcctgttttttatttttttttattatgtattttcttcaattacatttccaatgctatcccaaaagtccccccccccactcccctacccacccattcccaatttttggccctggcattcccctgtactggggcatataacgtttgcctgaccaatgggcctctctttccagtgatggctgactaggtcatcttttgatacatatgcaactagagtcaagagctctggggtactggttagttcatagtgttgttcctccgatagggttgcagatctctttagctccttggatactttctctagctcctccattgggggccctgtgatccatccaatagttgactgtgagcatctacttctgtgtttgctaggccccggcctagtctcacaagggacagctatatcaccgtccttgcaacaaaggcttgctagtgtatgcaatggtgtcatcgataaagccatttttaaaattatagttctctcctcttagatgatggtacttgcgttaagccaacattaaattagtgagcacaattggcctcttatccacgttacacacactatttagctataacctttcacttttcgtttatccccaagatcccatattgataaatatcacaaacaaaacattacaaatttaaaactcctacagtatttacaaagtcaaacattttaaaaattcactatctttaaaatatccagtctcttttaaagggcaaagtctctcaaaaatccagtttctaaatctccaaaatgtttttaatacttccaagtgtcattttgtaaaagcaataatatactttcttacttctagagggaaggaccagggcacagtcacagtctgaacaaagcacaacataagtccaacagtagaaatctcagtatcaaacttctgggttcctccaaagggattgccacagcgtgcatagcttctctagtcagcttaggccagctcggttccattggcagctgttgtccttggatgctcctccatggtactggtgtctcaaatattctgggatttcctgctgcaactgggctgtacttttgaccagtagcctctcctggactctttttttgagactccagccctgtcacatagtgacatgtctcaactgctctccatgattgccccatgccttaaaagccagtacacctgaatgactcttagaatagcaagttattcaacatgagatacagccttcgctgcctctagaattcagcttccatgtgttgactatgaggaaatatttcccaaaagactgcacatcaaagatgctggtctcttcttaatcacagtggactcttcagccccagcagaccagcatcctttgcaaagcaaaggttttactttactggttgtggtcttttgtcagttacaactgattcttcagctgcagctgactagatactacagactcttaacacagatggcccagtagaatctttgctttcctctgaaacttcacaagtcaggctttcaatgtctgcatttctttcagtactcttatcttccaatctcccacagtgtagcttatcaagctctcaatactcaatggcttttttcagcccaaagttccaaagtccctctatagtctacctaaaagtcacatgttcacggctgtcacagcagtatcccactcctggtaccagtttctgtattagttagattgctacgataaaacaccatgacccaaagtaaattggggaggaaatggtttatttttctcactcttccaaagaactgttcatgatagaaagcaaacaggccaggaattaaaatagggcagtaacttggaggcaggagctgatgtggaggactgctgcttactggattgctctccacacatttctcatcctactttcttatagaactcaggaccacaacccatggggtggaaccacttacaatgggctaggcccacttacatcaaacactaagtaataaaattccctacaggattgcccacagtctgatcttatatggacattttctcagttgaggttcctcctctcacatgactgtagcttgtgtcaggttgacctctacaactaggcaggacaacagtattaaagtctcaagatttgagggttatagtagaagcagaaaactcacacaaaagaatgggcatggtcaccagggaccaccagcacagcatttcatagagaagatgctattgagatattgaagaatctgaggtttacctttcctctgacttttctttagatgattattggaaggtatgatattcaggactagagagaggttcaaggttcagagnnnnnnnnnnnnnnnnnnnnnnnnnntctcgtttattaagcagaggtgctttctttttaaagcatacatcgcggaaaataggggaggggtcgagggagaattatacaaagaacaagggaaaggacaactgctgacatgggggctgaaatcaggcgccaagcaggtacttcgcatcttatctcctctggagccttgatcctcctcaacagccttgggagtcaagctgggctcaggcacagctcatgtccttggatgtcatgggaactcaggaagagatagggaagaggggactgttattcaaattttacagccttaggtgttaggaagggaataaggaggaaggggtgtgtgtgtgacaaccagctcttagcacaaggccctttgacttgtcaaggagattgtgaagggatcactttctcacgggatggtctctaacaagtcctagggaatacaataccttcttctgacctctgtgggcatcaggcatacaagaggtgcatagacaggcatgaaaacaaaactcttatacacatggaacagtttttaaattttactattgttcagtctttttcttgatccagtacagtttgagatgtataacttagaataattaggacaaatatggcatttagaactaaaatagaagaagcaaaaacacaatacatcaagtaaaacaaacaaaggcaaacgaggatggtggatgcagattcaagattagcctagtccaagtttatgccataggtaactaagataggcagctattatacaaagctatcagacatttttgtagtatagtttgtaaataatatattttatgctttttggttcacatatataaattaatacattaattctaaattatttcatgtgtatagttctctcttgatatctaaattgttgttatatctacattcgctctcttcatggaaggaaattgaagcttagggtcatgtgtcagggtcacagtccctgaagagagaccagaaggctattgatgagggtgcaacctcagttatagtgaatactccacttaagatgtcagtgttgtgagatgactaacaaggacaatggcaggtatgaagtggagcctacctcttgtgtgtggtatggatgcagagccagagtagagtccttggagctcagaagatagggagtgtgtttaagacttttcttggacactgagctacactactgctgtttggttttgctttcctctgactgttactgtgttctgctttttctcatttagatgtaagtatgtaagtaatttttttttagtttataggagcctatagccaagacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccttcaaattgttcttttgggacattttcttgattagtgtcggaaggcttagggcactagggtggtgccccctctgagcaggtggttcagggtggtgtagaacataggctgagcaaaccatggagagcaagaaaaccagtaagcatcatttcttcatagtttgtgcttctgttcctacctccagcttcctttcttgagttcctgccttgacttccctcaatgatggactgtaaactgtaagataaaataaatcctttccactgcaagttgcttttggtcatggtgtttgccaagtaatagaaagcatatttgtagcaaatatagtgacatttaaaaaaaaaaaaaaaaggaaaataacgcaaggcctcaagcctattatggtcttgtatttattctttttggagaccagaggccaactctggagagtagtcacaatgagatattgcagctagggcacacagcatcaacttggctgttcagactgtgtcctgatagcatctgtctctcagaacactgaaggagcaagggcatagtgctggctgggtactttatgcattctcttttacctaatttgtaaaacagccttgaggaatgtggtggcctctcttgaaaagaagcaagatctgctgggtaacagcttggatttcagttagagacaggagaatctctggagttctaagataacttggtctatacagtaaactccaggacagcaggagtagagagagcctgtctcagaaaaccaaaccaaaccaggccaaagaagtgcaatggactgactaaaatcattcccctgtgtattttgacttagttgttgatatttcctaattccaggtttattttccttttctgaatgccatcaagaaagagatatgccatgtttgttagcatcttgtctaaggaggcacagaagtacttagagaggctttaaaacaactccttttgggttacaatgggtgggggtgcctctcatgtcagtattgtttgagtttttattcttgttccctctgtgtcattgctctgctacaaactggtcgacgagccagcatttcttatagcatccaaggaactttgacttcttaaacgttacaatgactatgtagtcaggtttggtggcacatacctttaatcttagtaccccaaaggcagaggcaggtggatatctgtgaattcgaggttagcctggtctacattgcaagttccaggtcactcaaggttacatagtgaaactctgtgtcaaaaaaatgaccttgtaataaatttgccttgagactgggatacagatgatggcaaaccaatgtgttatagtatatctgagaaacgtccaaagatgacttcccatgccgtggagttgaaattagagtcgagcatagaagaatctggcatgtggtagtatcaatgaaagcatggcattttagtttcttcatcgggactgatcattatggactttcaagtgatggtttttaaccatatataaatatatatagtgtgtatcagacataaagtacatgcatatctatgtaggaacacacacttgcacgcacacacacacactgtgtgctgacagttgatcataaatttagccggttgtagtaagcatagtataaaatgaaggtattttaagtgtctgacaattgccgctgtcttggagtacagtgtgggcgtgatgaatgaatgctgctaagtgcaacagtgtgtgtgttcctcctacacaccgttctgagtactgccttctcaaaatcatcccacagatttcatccaggaagtgttgaaaagtcaaaattttcccccaatgctaatagttcttcagagcatgtatgcactcttcctatgccttcacaaacacatggttcacacgcatagacttgtcttggcactcattggcaagtgttcttcctctgtctacacactgctcagattgattgagcaaggctcaggatgcgctgcagtccttttggtgtccttgcacagtcacgaacagctgctgggagtgcagcagagaagagccacggggtagaagtaactggccctgctctggaaaccgatctgccttagaaggaggaagaatgaacctaagaaaacactggcctttacttctcctggggagcaagaagatggttcctggttgtttttttgtttgtttgtttgtttgtttgtttgtttgtttgtttttggcctccttcatcttactttctcatagtgcagaccagtccagaatagaagagacatgagaaagacaagatggactcaggggatatggtacctccttcccatatagaaaagtgctcactcacagaaacaggcagatattgttttcagacagacagacagacaaaatcatccatctagctagtgaagaacatgtaacaccaaagctagcttatgaaggaaagaattctgggaagtaagacagctaacccaatggctctagaataacctctaggaactgagtagcttagcggcagcaggtaagcaagtagaattcagggccataggtttccctgttgagcgctcaggctaacagggtgtagcaagtaatgtccatggatatgctgtgtgcagggtgacggactgttttctattttcatttccagagagctctgtttccggctgcatcacctgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttatgaaatttctaggcaaatggatggacttggagggtatcatccggagtgaggtaaccccaatcacaaaggaactcggcacaatatgtactcactgataagtggatattagcccagaaacttaggatacccaagatataagatacaacttgacaaacgcatgaaattcaagaagaacgaagaccaaagtgtggacactttaccctttcttagaaatgggaacaaaacacccatggaaggagttacagagacaaaatttggagctgtgacgaaaggatggaccatctagtgattgccatatgcagggatccatcccataatcagcttccaaacgctgacaccattgcatacactagcaagattttgctgaaaggacccagatatagctgtctcttgtgagactatgccggggcctagcaaacacagaagtggatgatcacagtcagctatcctaggttttttgttattccagatgaatttgcaaattgttccttctaattcgttgaagaattgagttggaattttgatggggattgcattgaatctgtagattgcttttggcaaggtagccatttttacaatgttgatcctgccaatccatgagcatgggagatctttccatcttctgagatcttctttaatttctttcttcagagacttgaagtttttatcatacagatctttcacttccttagttagagtcactccgagatattttatattatttgtgactattgagaagggtgggtcacacggcccccaatggaggagctagagaaaatacccaaggagctaatgggaattgcaaccctattggtggaacaacaatatgaactaaccagtaccccggagctcttgtctctagctgcataggtatcaaaagatggcctagtcggccatcactgcaaagagaggcccattggacttgcaaactttatatgccccaagtacagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaagggaaagggaaagggaaagggaaagggaaagggaaaggaaggaaacccacgaagtcccagtttgtgtggccaattactctggagcctgccctggcatgtaattggtacatctagtgtcacttcattgaagaatactgattctcctccctgcagctatcaattttgattatctttgttggcagtggtgggacttcatatcaacttccatactctttgatgggattttgtatagacactgcatatgatgtcacaacatttgttggtcaatgtgtgattttgtgcttctgccttattgtatctttaaatgccatttctcaaagtcttccattacccctggctcttacaatctttctgacacctcttctgcatcaattcctgagacttgactggaacgttgtggtatttagggctgaggattttagagtttcttattttctatgtgctatccatccgttagttacggttttctatgttcactctctgatgagggctgagcaattcattgatctatgagtatagaaatatgtcaccaggagtcattttattgttctgtttattttgcagaattatagtagtagattttccctaagcctatgacctgagtctcaggttcttggcctcattaatggtgtcaagtatgggttctatcatatagagcaggccttaaatccacttcaaaagctgtctggttgcttccataccatttgtggcactaattatacaagtgggcatatcttacagttgagtagtttttgtagttcaaagggtctttagcggggtgagactaataattacttttttttttgaagtagcatatatagcaccttccagcactatgaatgctagccagtaaagggtgaggtttactattgagtactatctccatatgtgtgtgtgtgtgtgtgtgtgtgtgtgtgtgtgtgtgtatgtgtgtgtgtatatgtttattgagtattaccttctacattatatggtaactcccttcaatgcatgcatacatgcatgtgtgtgtgtgtatgtgtgttttaggaagtttgatagtagtaggtagatagtagaaggtttccatatgcataaaacacacatgttaattaattgaataggactgaagacctggacaccagtccacacatctacgaacaccagatttttttttcacaaagaagcaaaaaccacatactgtagaaaagacagcagcttcaacaaatggttctgttcaaacttgatagctgcatattgacaatgaaaatacattagtatttttcacactgcataaaactcaacttcaaatgaatcagagaactaaaaataggaccttatgaccttaatcttgtaaaggagagaatagaaaatatcattgaattcattagcatgggaaaggaagttttgaacaggatcctgatagctcaagtggtaagacttacagttaattaataagtcaggcttatgaagctaaatgcttctatacagcaaaagacacaccatcatccaagcataatggtagcctacaggataagaaatatcttttgtaccaactattaatctgataaaggttagtacctaatgtacaaggacctttaaacacctgaaaatcaagggagctaaaaagttttcaaaagatgcctgagacacacttttaaaatgttcattatccttagcctttaggaagatgcaaattaaaatgatttttagacttcatcttactctactcagaatgaccaagatcaaatggcagcagatgctggtgatacaggaggatggtatacgcttactcattgttgttggtacaaattgctacttttgaaatcagtacagaggagcctccaaaaacttaaaatagatctaccatgataccctgctatatgtctcttgggcatgtacccaaattactctatatcttactacagagatagaaacttgtgcatgcatggtcattgcggttctgtctactatccgaagttggaaagagtctaaatgtccatcacctgatgaatagataatgaaaatgtgctacatccacatgtgggagtattattacactgttaaggaaaaacgaaatttgcaggaaatggacaaagctagaaaacattatcctgaatgaggtaactcagacccccaaagacaaattgcttgctctctattatatgtgtatgttagcttttatattttatatacgtgtgtgcttcatttagaatatccacaaggttaggtaactagttagtgactagaagaggagtaggggaatctcccaaggaagggacaacagaatgtagtgttataaagtgatgaagggaaactagaacaggagtattaagtggggtaagggagcagagggcatgggagattggaatgacatagggataggataatttaaatttaaacatcatcttagtacaaaaatattgaaattgtcccatgcatcctatcagatcaccatggactaaggctgatcttcaataacaaaataaataatagaaagccaacattcacgtggaaactgaacaacactcttctcaatgaccccttggtcaaggaaggaataaagaaagaaattaaggactttttagagtttaatgaaaatgaagccagaacatacccaaacttatgggacacaatgaaagcatttctaagaggaaaactcataatgcctgagtgcctccaaaatgaaactagaaagagcacacactagcagcttgacaacacacctaaaaactctagaacaaaaggaagcaaattcacccaagaggagtagacagcaggaaatattcaaactcaggggcgaaattaaccaagtagaaacaagaagaactattcaaagaattaatcaaatgaggagctggttctttgagaaaatcaacaagatagataaacccttagctagactcactaaagggcacagggacaaaatcctaattaacaaaatcagaaatgaaaaaggagacataacaacagatcctgaagaaatccaaaacaaaatcagatcattctacaaaagcctatactcaacaaaactggaaaacctggatgaaatgggacaagtttctagacagataccaggtaccaaagttaaatcaggatgaggttaatgatctaaacagtccctatatcccctaaaggaatagaagcagtcattaatagtctcccaaccaaaaaaagcacaggaccagatgggtttagtgcagagttctagcagaccttcaaagaagatctaattccagttcttcacaaactattccacaaaatagaagcagaaggtactctacccaattcattatatggagccataattacactgatacctaaaccacagaaagacccaacaaagatagagaacttcagaccaatttcccttatgaatatcgatgcaaaaatcctcaataaagttcttgctaaccgaatccaagaactcatcaaaacaatcatccatcctgaccaagcagggatgcagggatggtttaatatacggaaatccatcaacataatccatcatataaacaaactcaaagacaaaaaccacatgatcatctcgttagatgtggagaaagcatttgacaagatccaacacccattcatgataaaagtcttggaaagattaggaattcaatgcccatacctaaacataataaaagcaatctacagcaaaccagtagccaacatcaaagtaaatggtgagaagctggaatcaatcccactaaaatcagggactagacaaggatgcccactttctccctacctattcaacattgtacttgaagtcctagccagagcaattagacaacaaaaggagatcaaggggatacaaattggaaaggaagatgtcaaaatatcactttttgcagatgatatgatagtatatataagtgaccctaaaaattctaccagagaattcctacgcctgataaacaggttcaatgaagtatctggatataaaattaactcaaacaagtcaatggcctttctttacacaaaggataaacaggaaattagggaagaaattagggaaacaacacccttctcaatagtcacaaataatataaaatagcttggcatgactctaactaaggaagtgaaagatctgtatgataagaacttcaagtctgtgaagaaagaaattaaagaagatctcagaagatggattggcaggatcaatatagtaaaaatggctatcttgccaaaagcaatctacacattcaatgcaatccccatcaaaattccaactcaattcttcaacgaattagaaagggcaagctccaaattcatctggaataacaaaaaacctaggatagcaaaaactcttctcaaggataaagaaacctctggtggaatcaccatgcctgacctaaagctgtactacagagcaattgtgataaaaactgcatggtactggtataatgacagacaagtagaccaatggaatagaattgaagactcagaaatgaacccacacacctatggtcacttgatctttgacaagggagctaaaaccatccagtggaaaatagacagcattttcaacaaatggtgctggcacaactggtggttatcatgtagaagaatgcgaattgatccattcctatctccttgtactaaggtcaaatctaagtggattaaggaacacacataaaacagagacactgaaacctataggggagaaagtgggggaaagcctcgaagatatgggcacagggggaaaaattcctgaatagaacagcattggcttgtgctgtaagaaagagaattgacaaatgggacctcataaaattgcaaagcttctgtaaggcaaaagacactgtcaataacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactggaaatgagaggctcccagtaactgagaccatatttcatgaccagtatgggtgtggcccacagtgtttctaacccaccttcattacctggcctgggtttgttgcttttcttctcttcaccgtgtttggagctctctgtagctcctgtccccactgccattcagggaaccagaatgtaagtattcctcttgctcttcttgatggcttattgtcagtagtaggacaggaaacagcctttgtttttcttgctgacaccatcatgcatagaaatattttggcatccagcaactcataaaagtagataaacacgcctgcttacttggggtggggttgtagttgagaacgcttgttccccttgactgttttggcaggacattccactgtctggtgtgtccttaagtacacatcttcagaaggtagatagcacccctgttagaaatatttctaaacaatgatctttcttggtcattggaatttctgagtcatgactgtacccagggtctttgctgaaattacctgagtagcaagttagccatttctttcatggctcatcttggcgatgcctttgttttcattaagagatgttagcttattaaagtacctgaacttttctttgttcagacaaacaaaaaaagatgagtgccatctagcctgtatagttcttttgaaatgttcatgaggaggtaaatataagcatgaaggtttcctgagagataatgtggtctttttatccagatttttaattcccagcctcctctatcaggatttaatgtaaaagggtctttactatatcttgaaatgaaattctttcatgttttatccattaatttattcatattatatccctatggctaccttagcttcctcccagtcaccctcctcacacagtccctcactccattcctcctccccttctccacgcagaggatggagaccaacctgagtaaccccctaccctgctgcatcaagtctttgcagggctaagtgcattctcttcctgaggccagacaaggtatcctagttaagggaacagggtccacagacaggcaacagcttcagggacagctcctgctgcagttgttcgggacccgcatgaagaccaagctgcccatctgcaacatacatgtggggacctagatccagcctgtgtatgctctttggttggtgcttcagtctctgagagcccccaagggtacaggttagttgactctgttggtcttcctatggagttcctatcctgtttgggcccctcaattcttcccccactcttccctagaacttcctagctccatctaatgtttggctctctgcctctttatctgtcttagtcagctgctgagtggagcctctcagaagacagttattctgtgctcctgtatacaagcattatggagcatcgttaatagtatcaaggattggttcttgcccatgagttaggtctcaagttgggccagtcactggctggctattccctcaatctctgctccttttttgccattggatttcttgtagataggacacagtttggtcaatgtagccactttttaactgacctacataagttactctaagccccgacaaaattacatgaccacatatgaaaagggtgaatacaaggagataagtttatatttaaaatcatatcaatacatatatactgggagtaattattctcagagttggggaaacactcacttgcctgcatgtatagatggcttggccatgcctgtgccagttgacttaatcatgagtgtttcaccaacaacacacatacccagaagtatagtctttgcactgtactgtttataaagtagtaagtaattccaggaaaaatacattaaggggcttctgctcatcttttcccatcggagcactggaaaactgaatgtcttgccacacagaaaaacagtaaaaatgtggttacatgttagacagagttaagtttggaattttcatctttaaaaataaaaatcttacatgtgcattgctgcaggacattgaggcttacagctgtagggaactctttgatggctgctctttccattgcctgacagctggcctcctttctgaatgactggagatgtccacgtgagttttccacttgtcccctagagagggacactgacatctttaagaaacactggttatattttgaattttatactgaaatctgccgtaaaaatcagaaagcaatgcttgggttttaaacagtttttttcttttctttttgtgttttacttcttctaatcttatttaaagtattatcaagaaaaatattctacatcttaatatctgtaggaaaacttgctgtagatctctgggtctgtaggaattagaattatctttagtgttttcagcatctaagggtacatcattgtatttctgttttagtgtgtgtacatggatgtgtggtggatgtatgtgtgcctgaacatatggaggacagtatcttcccctataaaaaaaaattgtgtttttgaacagtcttccaatgaacctgaagctcaccagttagctagacttttcccccagtaagctccctattcttttgagggatgggggaaggttctgtcccagttgctgggttatatgtacatggccacaccatcatatacacagatgcttgggatctgagcgcaggccctcaggttgccacagaaagcgctttactcactcactgctccatctcttcagtccttgggtttagttttgagtccacttgtaatagtatgaacatggagattgtgtgtgagacatggaggctgtgtgtggtggattatttatgacatttctaacattatttatttacattcttctctgccattatattgctttcaaattcctgtcttccctgacttttatgttcctgatgtttaaatagttacataaactggatttggattgtgcctgtgtgtaatatcagctctcgggaggcaaggcaggaggatcacaccttcaagatcagttcatctgagggaagcctcaacttcatagtgaacaaataaaaacaaacgctgtaattcacttcactgtctttcttggaattagtcgagtgcacttacctgcaggtgctgagcgtataaataatgatgccttactgaaattcctttttcattttggattcagagatgtgtggtggcttgaccagaggaggagtataactctaaggactgcctcctcagagagtttaaccaaggaaggctactggggaaacttttccctaaaaatggagtctgtgagccctctgctggagacatttagtatttgtaccaggtacttggtatatgtggtgtgtaattccaatgtttttagaaaacatgatagcaatatgtttcttctgacgaatagtataatgcataggtgcctagctattttttccaatacttgagattgaacccaggactttgcacatgctagttaaatgcttttccactgagctatatccatagccctcaaatagagtttgtcaaaagatttattttataagtattccatttgagcagattatcactaagaacattcaaatgaaggaattgatttgaatgtggtacattaatttctgaatctttatattctttgtaagtcataagaaccatctcttaatattttgctctcaaatgaaatttattaatttagcaaatacttagtggtgtcttactgtgtgtcgaggattactggatactggggtgggacactgaagggaaaattacattgaatgcttttgaatgagttatcacactgtgattggcattgacagattgatgtatgattgcgtttttaaagaaacgggataggagtggcattttgaattgtgtatggaatataataaaaaaataagggagttcaccccccccaccaccaaaaaaaaaaaaactgtacagaaactgactttctgaggagcctcttctaaggagcagcttctgaggagcctctgtgtcagaattttggtgcagcatgaaccagtccctgacttgagagagaagcagccctgagtcccacttgtagcccatctgaggagtcctgcctgaatccagtggtgaggacttgttgactgttgctgaaggtcactacctcagaccatggtctaaatctagggcggatccacatcctttccaggcagtgctaatctgttctgcctccctccatttattgacaagtttctcacagcttctgtcttttcacactgcctctaccttccctacaacatctacaatgggggaattctcctgtgggaattaggaagagaaggctgcatgtgcctgacatcgtgtccgtagacatccccatgtctatttctgttcagttcgtttccatctttccctgtggaaggtgtgcatccctaattgttgggggttgggggctgatggttcaccctaggctcgcagtctttggctcggtcctcctgcctgtaaactttgtagctgtctctctgttttccatttcttttttctctactgcattatcccaatcccacagtacacaggcacactctattacccaatcattaaaaggaaaacaaaacccttttcatttgcaaaaatgtatcccacaaacccgttttccctcagttttacacatctgttacacatctttccactcctcaagtctgaaggattctatctctagcattctagaaaaactgttctcttttgaaacagggctactctgcatagtagatcagactgaagcttcgaactcagagatctgcttgcctctgcctctagagtgctgggattaaaggtgctcactaccatgccctcagcttaagaaactgttcttagaagacacggatattggcaaatacaaactaaatgttgccccttatggccactcagctccagggactacagccggaccgtctccatggaagtctttctctccgagctttcagaccactcttggctcatcatcccagcctcccctgacccactccacgtgcttttgtaggtcttagttgtctccttctctgccttcatgctggaatccctcatgcgtcataactggcccgcacaggctaactagctcccttgctaatgtcatgcagaccttggtcacttgctgcaatattgtgctacggaccccctgccctcaaactccctctacaacaaatatcagcaaatattttctgtaagagggcagagaatgcacaatttaggcttcatgggccatgccattgctactttaagcctcctgttgtaactgacaagctgcctgagaaagatcaaatctgtaaaactcagttggcattgaaattttaatttcatataattttcatgtgtcacaacatattccccaccattggggtgttttgattattttaaaatattagaattattcttaaaagccagtaacctcaacagtagaataaaggggcattaattcaacaaaaatgtacaagatctccataatgaaaactccaaaactctcgtgaaagaggtcaggaatgtctctgttcagggagtagctattgtccagaaagaagctctttacaacttgattagagtcaatgcatccaaaccaaatttcagaagaatatttataggagctaaacaaactgactgcaatactcagatgaagtagcaaaagaccaagaatagccaaaatagtgttgaaagtgaacacagttggacaactgatagttccccgacatcagtgtgatatggaccagagtccatcaggagatcagtggacagaatgaagagcctggaaacagaccacatcaacaaaattgatggatcatcaataggggaagaaataaagtgcaatagagaaagaaaaaatctctttcactaataatgctggttcaactggacatccaactgcaatcaagtctatgcatggatcttcacaagtaaaacacaaatctagaaaacttctaggacctgttcataatataggagacatttttctataggtaactgaacatatgtcaaaaacatttttagattttgtttgtgtgtgtgtgtgtgtgtgtgtgtgtgtgtgtgtgtgtgtgtgtgtctgtgtgtgcgtaccataagcatgcacatatcagagctaagaggccagggttgttatattagtgctggactcagaattatggaggaagctctcctaaccagtgaggcatctcttcagtccagacaaaatatttttaaagacacaaaaatgtggtctttgataacctgtatttcagtggaattaaaaacttgtgttctacaaaacacagtatcaggagaaataaaatctaagccacagtttggagaaaatatttatgaaagtataaaagaatattatttgaaataagtgaagaactgaaaagtttagtactacaaagaggcatactctgattttaaaaaaaatggccacagatgagtgaccaatgaagataggtggcaaataagcccatgggaagacgttcatgtattccattaggtaaatgcaaactaaagcaagtgctgactgttgtccacctctttaacaccctgtgtcgcacatagaacctgacaaccctaaaagcttatcaggacagagagtacaagaaactcatttgtgtctgctaagaagtcaacatggtagcatccctgaagaagagaagttggcagatcattaaagaaataaagtgctctctcagtctctgtttctgtctctgtgtatgtctctgtctctctgtctctctctgtctctctctttctgtctgtctctctctgtctgtctctctctctctacatatatatatatatatatatatatatatatatgtatggaaatgtgtcattctgtggaagatgttaatatgggaatattatacatctgtacgcacagaatgtatatgagaactctattttttgttaaattttgctacaggcaaaattgctttagagagagagagagatttaggtagatatagatagatttaggtagatgtaggtattcattccttggtgtctatccttaaaaatgaaaaagatctgaacacaaacgtctagatgctttatttgcaactaacgcaacctggaagccaccgaaacgcatctctagagtaaatgaatggataccttaactgtgaatggaacaggaaagactcagtgctggaagaaatgagcggccaaaccatgaaaagacttgcaggggatgcaggtgcgcattgccaagtgaaggaagccggtttaaaaatgctatacactatgggattctaattctatgacattttaaagactgtcaaactataaagagagaaaaagaagggtggatttcaggaattaggatggggaagtgaattaaccaagtagagaggatatttaggacagtgaaactcttatgtatggtcttctaaagtccaatacatgccattatacatttgtcaaaacctatagagtataaaacgcccaaaatgaacactagggaaagacatgggttttgtgagaaaaatgatattttaatatagtcttgtaggttatggcaagtgtgtcattctgtgggagatgttgagatgagaatattgtacatgtgtgggcacagtatgtatatgagaactcttatttttgataaattttgctacaggcaaaactgcttttaatatagcccattaattaaactttaaaaacaagaaatagtaatgctttgcccacccgctatacaaatgcatgtgattggaaagatgtggtctgggggttgtactttaccacctggatgcacgtggttttgtctcctgattgtttatatggatgacacatcacagacctaacagacctcaaaactcaactcttgaccttcctataaacccacatgctctaggttttactcttgtgagtggaggcactagtgggctgacagcgaagctctgagcaccatggtaacaagggtgtatgcttgggtagcgatggttatctttacagagtctagaaagatggctagaattctgggattagaaaagactttctgttgaataggtgtgctcccatgccttcagcatccacattttcatatggtggttatatctacttgcaaagatgagaagtggaaaataaaactatgggaagggcagatggcataaatgaaatggccacatgatatctgtaagatagtaggtagtatgggagcactccatataaaactacatttgcttttcatgaaattaataatagaaatatttgtgctctataaattaggcaaataattttttctgagccctttatgtgggtactccattnnnnnnnnnnnnnnnnnnnnnnnnnnnnnnnnnnnnnnnnnnnnnnnnnnnnnnnnnnnnnnnnnnnnnnnnnntgtgttgatgatcccctttgcacactgggggcttatttctctgacatctttaatgaaattagacagctttcaatccccagctccctcagcaacatgctgtgtgcgtgcattagtcacaccacggacttaataactgcattcagctccatcttctctctccattctgtacccagcaatgacattgttaagtcacccctacacttgaaaattggtgccaagggggctgaagagatgattcagctgccaagaacactggctacttgccagaggacccaggtttggttttcagtgatcagatgggggcaaacaaccatcatagaatgatgccctcttcagttctgcatgcgcatggtcaacagacatgcaggcaaaacacctgtacacatcaaataaaaggaaagtaatccctccaaaataaagggaattggcatcaaccctactcattctttaagaggtcttccatcttcacgtgaccgtagttggaagtcgaggttttctctttggtttcactctcatgtcctggagaatctgcccctgtcttatgaagctggccctgttatagagaatctgcccctgtgttatggagctggctacattatggagaatcccagttccatgataaagctgtgagggatggaatctaccatcttcatcacatttgaaagaatactggttactaagtaggtcttaataattaatctagcttttcttttaacctataatgaccttcatgtttcattatactttaatttgctacaactgcttctttcccttatagttagaaactatcaaaaatgtattctgctttttcaaataattagccacatttgtaaaggtgatgtaagtatgtataatttatctttacattctgttaaataatgcatcttattaatttaaacataatgaagaaagccatgttggaaatgactagctgacaatactattaatctcgaggccttgaaatgccagaataattctaatgaagaaggggctgtaagaaatggagttttctttatgctgtgaaaagaccaagtcttttcatattcatctgcagggatttttcaattaaatctggcatttgtagccaagggctcctccaggacgacgtgtcccctgaaacaccacaccagcagaatcccattgggatcttcgtgcttttcttaaaacactgagctccagtctgtacgctattcattcttctgtcccgacgtagcatgatatacgtacactgtctgttactcctacaaaccttaggaggcagacagtatcgtcagtacacataaagtcaccgagcaatgcttggagagtaaattcttatcctcactgccgctgcattttcttctgaaaatttcagtggcctgatagaggccacaaggaacagagaatcatgtgctttaaccaagggtgccaccttgtggataaacaatctttactaaagtaatattgaagccaaaagtaaattttgttttatgtcccacctatatgacttttcttacatagaaatgcttcatgcgaaagacttcatacgtgttgaatatctgactaataaatttatttgtgctcgctgtgttcagtttacctaatgccttatacgttcagatttgtgttgacagttttctagactatacgaaacaatgaatttcatttgtgtcaggggaaatgtcctcatttatgctgataaatgatatcagaccacatctaacttaaattgcattagtccttgtgctaaaaaggtgattgttttcaaggattcacttgcaaaccttagttgtctgggtttaatgttatcacactcctagcctgctctatacatgaaaccaaaagacagcaaactaagatcctcctaaacaagcaatgagggcataacttccggaactaaagttacaatttttcgaaggcaccaactcagttattcaaagacagaaaagccatactgaagcttcataggcatgcaaagacatttgttaccagaaactaatccaggaggcaaggttgtgcggagcagatgaatgatcgatggtattagagaatgagctaatgaacaaacaggaagttcatggggtttgtatgctggcccctgctcctacttgtcaggcccggctggctttctcagcacttactcggggccccatgcaatgccctatgcagaattataacaagttccatcctcctcctctttcacaactttttagcttcatcttctgcctaaagatgctgtaaggccaggtgcatgagccttctctaagtttgggagggtgttcctcacagatggttcagatcaatcctgtacaaccaactccactcaagtcattgaccaaatgagatgaagcatcccagaatcgcctcctgtcaaggaggcagttgccctttattgcccagttctcgtgtcaaaatgtttccggaatctgtcaccttatatcgaacttgtggatttaaactctagtattttgtcacactactggttcagcaccacagcccatggggctttgtcctggaaactggactgaatctaagaaggaaagaagaaagagtaaaaaagctgggattggaatgaatgcggttgctctggtagagcatagccactatgcaacagaagccaggaacttcagcacttttaccgtggacagtgcaggaggaggggttagctggtctgtaggtgaggaatcaagttgtaaccatctgaccagaggaagctacagtcaccagtttttgcacacactagcgacattcccactcagactagaggaaggttttgccatccctctgaacctcagccctgtagaaaggttttgccactcctgtggtgctgaagcactggggtccttaacaaggccgtgcccacattagtaatgcacactcactcaggactttatcaattcttcccacacttacttggggctcttccagctctccacaatcaagtgtcactgtgctcacagtcattgagtaagtcttatctagtagcaaaactgagagctcagtctcagcatttgggaagagggatcatagagcatctttgttcaagtgaccttgcttatggggacagtccttgagcttgactcaagttacaggattgtcatttaccccagattgcactatctcgttcctcacagtcaaatgtagtttctctgtattctacatggaggtcaagtgtgggtggatagtggaaagagaattataaatcatccatatgacatttggctccgcctatacgcactcttgatggcttcaaacactttttagaaatctgcaggagccttagctctgtcccatccagaacagctgaacatcactgagaagtccacagctcatgttggcgtctttgggatattttttccctctggcataggattccagaacacttggtcttagatttcttccattttctttatcactttgtcttgttcacatctgtatgctttcatctgagccaaactcttctagattactaagcactgtggatatgtccagtcacatagatcaacccccactctaacagtgtgctctcggctttcaggggacttgcctcccttcctgtagattgatctcaaagaacatccagtctgctataatgccagactagatgttgataactataatgtctgaaggatctgaagttggtcttagttagtgttttattgcagcaaaaggggaacaaattagaaagttgtgtactataaagtgagtgtttgaggccccttttgaagagggttgtttgtttgtttgtttttgtttttgttttggccagttgttcaagaaggtcccagattcactatactgtaaaacacaaggagttgcgccttcgcttattcctgcccaagcataaatcctttgggaaaatgcagcagagaagtcagtcacggaatgacatcagggctcaactgcaaagatgctgacgagtaatgcttacacatgctggttgtttctagtaactgaaaaccagttttcctggcagagtnnnnnnnnnnnnnnnnnnnntaactgaaaaaccagttttcctggcagagttctctctggcaaccttctaaagaacttatggacttttctatgctaaagtttcctttagaaaaatcttataatgagaggaggaaaaagagcctacagaacaaaaatcaaaaacaaaggcaaaaacaatcccagtatgggtttctgctatgagggtttctcgccgtgagcccattggacgtgttatacatgctatggaatattcatcttgcctctctgtgatatctgtctttgtgtttggcatttccacactttggaggttatcctgaatgccagttgtgtgaaatgaacacaactgacagggttgaaaggctaaaactaccctttctaatctatctattccccgatctctgccttaggccatgcctcttctgcaagtctgttcgctcttcttgctcctctgatgggagctgtactcatttcctcaatgtcagtcaaagcctcttccttgaggatttgcagaaatttaaatttctcttcttgctagaagagagagctgtaaaattaatgtccagaattagatgagtgttttcaggtttgacccccctgcttaactttttcatgtttacttcaatgatccagaaatataagttgcatctcctttttctctttctctgtatcagattaattgataaaatacatttttgaaagaagcacgtgcgtagaaatcaattagttatcccacgttttaattaaataagcatctcagtccagagtgacagctatgcctagacgttgttccactgtggatgcagaaaggacgaacttcctttctcctggagcgagtattttcatgtgcagagaaacagaaaacaaccgcataaatgtgcaatgtgtcgagagattgcaggtgctgtggaaaataaggaaagataggagatagatattaattttggagtgatgtcctgttttccacaggatggtcaggaaaagaaagcctcttggatagtgtggttctgtactttccaaagaatgagtgacagctgtacttccacttttagtaagtgagtgtgttaagtatatagcaaggcaaagtaaaagaattagtagcaagtaaaagtgagtgtgacctgaacatgttatatacatgtaataaattatcaaagaataagtttatttttttaaaaaaagaatggccattgagttttcacattaaaactgctttatttcttgctgagatggcagggccataaaaggggtgggttggtgagtggtagacaagatagagaatctagtctggggcctgcttagtttgagccgccctctaaagagtactacggtggcagtgagttgccaggatctacccaacttgagtgattgacccaactaaggcatgaagagagtggagaaaaggcaaacacatagatacatgcaaggcaaagctgagatagggtggactgtgctcactttaatggaaggtaccaactttggtaaaccagctgatgtcccaaggaagaataactcaggtagaaaagactgctttgattgataatatggatcaaggaggcagatttctttatataggggtgcctctagctaatctcagctagaggtctttggaggggagtggtcttgggttgtagtcatctcagaagaggaagctgtgtttgatagttattgcacactggccaatcattcataaacacttgtatttagaccaaaggaaggctttgccatgtctccgagccttatctggtgaaagctttgactctgccatggatctgaaacatgccctgtccatgatacacattcacttagaactgcatcctttacctacaggatgtatgaggatgtatgggtatttagagagagccgagtgtcatgagcatataaaggatggtaaaggcacagagtgggcagagagaagagagaaaggtctgagaaccaagttgtgttcatttctaaagcacggagactgggaatgagaatgtttcaggaagtaaaggaaaatcaagaaagaatattgaccgagagccaagatatggatggccccatttggagaaagagtgcacttaccactgtttacaatttccatatggatgtggcagtgaattaccaatgggtttagaaacatagatgtccagtggccagattatgaactactgggctgaagacaaagcactagagcaggactaaaggcctttaggactgaacttcatcctggtgtgtggctttctctggcctttttcagtgggctgatagccgctgtcaaatagttgggtttaaccagaaaaaggtagataattgttatcagcagatgcacgacttgtggtctgttcttgtgatgctgcttatggtttcatgaccgtgatagctgtgttttaaataaagaagactaaagcaacaaaacctccatgaagacaatgaaagtgtgtcattacagggcttgtaagttgaatattcctcacccccctctctcacaatacccacctccctctcataatacccaccccactctcatagtacccacccaatccatgtggccagaggagatacaaatgtcctaccctaaagcacctgctcactacattgtgattgatcggaagagtctgaaatatactttgaaaaactagaactgagttagtttgatctttctatgttacagaaagaatgctaagaggcaactatgttttttgaaaatgttcctaattttctacaaaaacaaaggaactaaacagagtttgggatgtaggaaaactgttggcccacataaaaacaaaagaagttacatgtttaaggggggacctgtcttacaataattaggatacagagttaggaactgactttcatggtgacaattttcattcaaatgaccctgtagagtagcaatctaaatacactatggtgcatctataaatttagcagtaccatgtcaatttttcatgtagctgatcactttctctttattgaaaaacaaaaacagattttgttggagccaggagtgatccaggatgtgttagcagctggcagtcacctacagctgttggaacttctcaatctgtgctcccactatctcatccaggtatgtgtgcttgcatctgctaattgccctgaagttgtaaactgtcccctaccaactaatagaaaaactacactgtggtatgtacatgtatgtacatctgggatgtgtgtgtgtttgtgtgtgtgtgtgtgtgtgtgtgtgtgtgtgtgtacaacctagcaggttcttgaggactcagagaagaggatcctaagaagacagctgcagttcctgtgtccttccatggacagggacatgttgccgttcctccaggtgacctgtccactccaggtgaccattgtgctcaggcagcagactgattcggcatccatgtacaggcctccccacagggtcgcggctgctctgtgcaggcttcaccatggattcctggggaatactagagaagatcctggcttaaaggaatgctggttgtggaaatgaccacaggggcaagaaaagttgatcatcccttgaagacccagtaacaggagctatatcttagagtcaaatataatgaattatcctgggaagctccaaggtggtggagatggggaaatggatatgtgagctgtgcaccctttccctggtttgctgtgtggttcagaacggctctgggagagatgagaagaaaattcatgaacactatgctgttgtgtatttagaaatgcttcacattcattcctcacaacaaatttatgttgtttcgtttgtcaagacagggattctctctataacagagccctgactgccctggacttgacattgtcgactaggctagccttgaactcgcagaaacctgccagcctctgcctcacaagtgcctcacaacaaatttatacattaaaaaaaaaaaaagtcagaagtttacagtgtacccagcttgcttgcggcagtgtgactggtgagcgctggacttttctgatttgtaaaatcattttcctcttagggaaaaacctttccaggaagacgtggatggcggtggaagcctcatgtctctgagagttttattttacagataagatgacatttaattaaagtgacttatttacttactttcaagggagatcaaactgttttattcagaaatttaagggtggggagagactgaagaggtccgtgtgctctggtgtctttggcagaacaagtcttctgggcttttatcattaacagcctttctctctctctctctctctctctctctctctctctctctctctctctctctctctctctctccatatagagatgggggaggaagggagggagggaggaagggaaggacagagagagagagagagagagagagagggagagagagagagagagagagagagagagctccacctttcccttctgccatttgtcccatgatctcactggcccttgtatgcattgattagaatatagtgacagtccaaagtaattaaaatgacaaatctacacacttctattctagcatctctgtgcacatgacatattattagtaataaagaatccttatattcctacccaattactttgtttctgtttagaatcatttccgctaattcaaaatttgtctaaatatgctgtgaataggtcttttatcatccactcttgctaccctacccatcatggagttttcaaagctctctcacatggcatcttttttctgttgttgtttttgtttgctgttgttgttttgtttcctgacaaacaggaaacagctcttgtcaaggtgtcagtgtggggagtctcaaccatggtcacttaaggaagaatttaaacacaaaatatgacatttttattattatctcaatgcattcaacttgacagtactatttaactattttttatctggttttgtttccttttcctctcagtagtttttggtgatatgagagagccatttctaatttctttttgctgattgtcaacatgaaccatcgagaaagcttccaagatgtcagaagtgtgtgtgtgcttggctttgaaatcgaaattgtctttatttgatgtttctacatcaaatactacttcttgagctttaagaaactcaactggattcactttcttgtggcagacaatactcagtgatacatagacaggaacttggttatagtcttataacttttgagaatgatacatagacataccatcatgcctatttgtgtatagttagatgtcttctttataagtgaaaattccagatggagactggacgaccatgctcacgtctcctgccctgtcagatttatccatggagaccttagtagctgtgccctttgcagcttctctcttccatgtgttttacttccgtcaaagtgcagtttgactaaagctacattctgcgaaaagttatgcctcaggcttcttagcagtgtctgaaactcaccagtttcacaaatgtcctctgcttctgttgtgggacatctatcttgttatcagtgattcgtgccagaagctgtgcttatagaaggaaactggacagaaacccaggcctggcggctggagaaacaacagtattttagccttcccaatacatctgctgcttcactcaggataagcttcatattaagtcaacctgcttttagaatatgttattctaatgcagccttacatttctttactcttttggcagtattgtttggctgattgttaatgttatatagaatcatttagctgaaaatatagaagtgttattattgttgttttttttgttgttgctgttattgttgttgttgctgttattataaaagaaaagtccccagatgcttaaaatgcccccagaagttgtgtttgttaccagggctaatgtgtctgccattctgcttgcagcctttgtccaactgggctttttgtgttgtgtgctattattttgttgtccttaaatttctcttgtttctttggatagatgcctcctctaggaggccctgttctttatccagtacgcacttaataaataaataaataaataaataaataaataaataaataagctccctgagcctcctcagccctcagtaacttctgacacagaagaaaagagaaacttccagatcatagtgtgggctctttccctgccttctcaaagagatccccagcccagatccagtctgaaataaaacagaagcgattctttgttctccctagtccactgttttcctttaatagtctctctagaaatgtaaaccaattcattaaagatgaattgctgaggatgggttctgtcaagtgtatgcaagaccttgcctttcagcgttcacatttgcatgcattctgtcccctgttgtaaacatggatgaggaaacccctggagctttcttcctctcttcctgagtgaccagccctactggagggggggcatccagcatgcccactgctgtccagagctctttctcaaactctactttttcccagctaaattctggacttctgttgtttattttgtttttgaaacagggtgtcctgagcttgcctctacctcaccaacacttctgctcagcctagagcgcatcaggcagtatcttcacactcagccttcccagcaatttcatattagccaccatactgttccaactccattttatgtatgtttttattatttagaacaattttcaaatttaaatgtattttgatcatattcttttaatgctaaaagtccttccagactctctccctccccacccaaccaacttcagcgtctttctcaaaataaaaaaacataaaatcccaatacaacaaaagctcccaaaagcaagaaaacaatataaaacattactcaaaagataacaaaacaaaacaatgaaacctcacctaactgtaacaaaataaaagcacacaggcacagacacatgcacacacaccaaaacaaaacaaaacaaaacaaaacaaaacagagaaaagccctgtggagtccattacacattggccaactactcctcatgaagcttgccctggattggataatatagccagtgtcactccattggagaaaattgattttctctcttcagcaggtataaatgacaactcaatcttttctgtagtggctgttttatttcattaattcattcatgaatttttaagataagaatataaaatataatataaaactaaaactaagacatcaaagttggacaagacaaaacaaccgatgaaaaagagcccaagagaaggcacaagaatcagagacccactcatttgtgcactcaggaatcctctgaaagcagtaaaccggaagctataactgaacaggacccggtacagatccgtgcgggccctatgcatgcctcagtttctgtgagctgatatgagcttcttgggtcctttatatattgtgaatactaatgatctatcagatgtagagttggtaaaaacctttccccattctctcggctgcagctttgttggaatgatggtatcctttgccacgtcgaagcttcacagtttcataaggtcccttttgttgtcagtctttgggcttatgatgttttgtcagaaggtctttttctgtgtcagtgagttcaaagctattctctactttctcttctaccaggttcagtgtgtctggttttatgttgaggtctttgatctatttggagttgagtttgtgctgggagatgagtataaatctacttgtattcttctacatgcagccatccagtttgaccagcactatttgatgaagatgctgtcttatttccagtgtgtatttctgtcctctttatcaaaaatcatgtctttataggtgtgtggatttctttttttttttttttccattttttattagattagatcattttgatttgttttggtgccaataccatgctgtttttatatctatagctttgtgacacaacttgaaatcaggggtggtgatacctctagtaatcatcattatcatcatcatcatcaccatcaccatactccatcaccaccaccaccaccatcatcatgattgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccccactttctcctctataagtttcagtgtctctggttttatgtgaagttccttgatccacttagatttgaccttagtacaaggagataagtatggatcgatttgcattcttctacatgataacaaccagttgtgccagcaccaattgttgaaaatgctgtctttcttccactggatggttttggctcccttgtcgaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctaggttttttgttattccaaacaaatttgcaaattgctccttccaattcattgaagaattgagttggaattttgatggggattgcattgaatctgtagattgcttttggcaagatagccatttttacaatgttgatcctgccaatccatgagcatgggagatctttccatcttctgagatcttctttaatttctttcttcagggacttgaagtttttatcatacagatctttcacttccttcgttagagtcacgccgagatattttatattatttgtggctattgagaagggtgttgtttccctaatttctttctcagcctgtttattctttgtgtagagaaaggccattgacttgtttgagttaattttatatccagctacttcaccgaagctgtttatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaaggatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttgggtgatttcacccctgagtttgattatttcctgccgtctactcctcttgggtgaatttgcttcctttttttctagagcttttagatgtgttgtcaagctgctagtatgtgctctctcccgttttttcttgagggcactcatagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacatgggacaatttcaatatttttgaatctgttgaggcctgatttgtgacctattatgtggtcaattttggagaaggtaccatgaggtgctgagaagaaggtatatccttttgttttaggataaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggcgcaatgtgtgctttgagctttactaaagtttctttagtgaatgtggctgctcttgtatttggagcatagatattcagaattgagagttcctcttggaggattttacctttgatgagaatgaagtgtccctccttgtcttttttgatgactttgggttggaagtcaatcttatcagatattaggatggctactcctgcttgtttcttcataccatttgcttggaaagttgttttccagcctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaaggtggcattctgttcttgtggctgtcttcttttaggtggtgtgtggatttctatatgagtcttcagtttgattccattgatcattttgtttgttttggtgccaataccatgctgtttttatatctatagctttgtgacacaacttgaaatcaggggtggtgatacctctagtaatcatcattatcatcatcatcatcaccatcaccatctccatcaccaccaccaccaccatcatcatgattgttttatctagcctggggtttccatatgaagcttaaaattatcctttcaagtcatgtgatgaattatattggaattttgacggagattgcattaaatctgtagattgcttttattaagaaggctgtttttattaatcctattgaaacattagcacaggagattttatggtctgatattttcttaaatgcttttcttcaattacttaaatttttgtttcacttctttggctagagatatccccaagattcttgagattatttgaggctattgtgataggtgttgtttccctgatctctttctcagaacatttgttatttatatatagaatggcttctggtttttgtgaattaattttgtagctagctactttcctgaaagtgtttatcagttacagaagtttctgagcagaatattttcaggtcacttatgcatactatcctatcatctgcaaacaaagatgcgttgacgtcttccttttcattttgcatccctttcatctctttcagttttgtattgcaatagctaaggatttcaaggactgtattaagtatatgtagacagggcaaccttctcttgctcctgatttcaatggaattgcttgagtgtctctttatgtaagctgatgttggctgtgagcttgctgtaaatttccttatgtccttacgttccttggtgttatgttcccctgaccctttatttctaattttgataatttggatccttcttctcccctttttaattaatttggataataaaaataatggacattatttattattgaataagtataagatctgttgttgtttttttttcctcaaagaatcaactctttgtttcattaattctttggtttgtacatttgtttgtttgtttctatttcgtggattccctctccgaatttgattattttttaacatctgctttttgggggtatggttttatttgttgttgttctagagattgcaggtgtgcttttaagttgttagagtgagatcgctctaattttttatgtaggtaggtattacaaagcttgttagaacagccttcattttggccaataatgagtgtgtcagttattcaatttcattgagttctagaaagtctttaatttcttttgtaatttctgtcttgacccattctatattcattagtgagttgttcagtttccatgagtttttaagcttcccattgcttctgttgtgtgaatctccagctttaatctgtggtggtcagataggatgcaaagtattatttcagttttcctgtatctgttgagacttgctctgtgtcccagtgtgtggtcagttttggagaaagtggcatgaagtgctgagaagaaggtatattcccttgtgtttgggtgacttatatttggcctatcgtttcagctagcttaatcatttctctgtttaatttttgtctggttactattggtgagagtgtgttattgacatcttccagcatcatcagtgtgtgaagaacaatatgtgatttaagccatagtagtgtttcttttataaacttggttgtccttgtgcttggggcatagacattaagaattataatgtcctgttggattttttccattgataagtatatattatcctttcttatctcttctagttagttttggcttgaagtttattttgtcagctatcaatatagatagaccagcttgcttcttatgtcaattagcttagaatatctttttacatacttttaccctgaggtgatatctttccttgaagtttaggcatgtcccttggatatagtagaaggttggatcctgttttttacatatattatgtttgtggcttttatctaatattgagagttatcgatgagaagtatttgttagttcctgctttatttttgttattgttgggtggtggtggtggtggtggtggggtatgtgtgtgtgtgtgtgtgtgtgtgtgtgtgtgtgtgtgtgtgtgtgtgagagagagagagagagagagagagagagagagagagattaagaattaatttttgactttgctggtctggaattatttattccctgggttctttgtatgtggggggtgtgtgtgtgtgtgtgtgtgtgtgtgtgtgtgtgtgtgtgtgtttgtgtgattaggaatcaatttttactttgccgatctggaattatttatcccctgtgttttcttatatgtagttaacctccttaggttggacttcaccttttagtgtcttctgtactgctggacatatatgtagacattgcttaaatttgattttattatgtaatgtcttattttccccatccctcataattgaaagttttgctgggtgtagtagtctgggggaaggggcatttgtggtctctttgagtctgcagaagatctgttcagaccctgatatcttttagagtctccagtgagaagttaggcattgttctaataagtctgcctttatatgttagttggtctatacatgttgaagattttaatattctttctttgttctgtgcattgagtgttttgattattatatgctgaggagcctttcttttctagtccagtctatttggtgttctattttgcagtttgatagcatttccttccttatggtagggaatttttcttctacaattttgttgaaaatattttctgtgcctttgacttctgtttcttctcctttctctgttcttattattcttagatttgatttttttttcatggtgctctcgattttctgggtgttttgtgtaagagttttgtagatttttcattttcttccactgaggtatttctttcttctatttttgtctccaatgcctgagcttctctgttccatctcttgtgttctgctgatgaagcttgcctttgagattcctagtcaagttcctaaatttttcacttccagatttctctcagtttgtgttttattgactttatttccactttcagtttttgagttgttttattggtttcattccactgttcatttttcataggttctttaagggacctgtatcatattcataaaggatattttaagggtttttttcttgtgcttcagttatgtttgaatattcaaggcctgctgtggtagggttgctggtctctagttaaaacattttgggattttcctggctgcctttgttgtatttttacaatgtcatctaagcatccagcatcagtagattgtaagtctagtgctcataattgttcctgtctttattgggtgtgtgttttgttccttgagatgtgtttcctcttcagttcttaggagagtttggcagctgtgtgttgcctgtaggaaaatcttacgaggtccttataggtgtgggcactggggtttccaggttagttgtgttcctgggtattgggagctgatactcagggatgggaatgtgctggggctgacggggctggggctccagaagaggaaggagaggctggcgttcttgagaatctgctcagttagtaccttgggagtggaggcaaagatgagataagatgccggagcagaagatctgctacagagctggagataagactggaggtttagacttggaagagtagagggagccgtgaatatctgccattagcctactttgctttcctggactgagtgacctgtgggtttccatggcttgcctgcctagtggggcttaaaggcttggaaaaagcaagcggtgagggggaggaaatttggagggaaagatctgtgtaatagactgaagatgaaggcagggaggaaggaacgctacagcaggtactctgctgcagagctggagatgagattggggaatgatttggaggagcagaaggagaggtgatgacctgtactagcctacctgcctccctggcaggagtggccagtgtggtgggtcccagggcatgccagcaggagttggaggctgggataaagcaaaaagttgcaaaagcggtcagtagggaaagatctgtgcagtccactgtatatggggacaagaggggagaaaggagtggtcttaatgggtggtctgctgcagaactagggttgagactggggactggatttggagcagctgatggaggagtgaagatctggagtttgcctacttgtttggctcactgttttcctgaccacagtggtctgtagaagtagctgctggagtttcccacctaaaacgcacatcgctaattcaaaccttatgtattagaatgtgctataagggtgcttttgttctgttatctataaattgatatgttgtgttagatgtccagctttagagtcagcttcacaaatgtcttatatgtcttcacatgtgtcacgtggttttttatctgtcactgaagctatttcctttcgttagacacccactgttcctgctaaaagaatgactcctaagtgtgtttcttgtttctagcctctgtccatggcaagccacattcccttgagtatcgttatctttccagagaagggagccagcatttacacagggtctgttaatgcttaatggtttataagggctcacatgtccaccctgccgagtagccctttaagtcaggtgacattttccttttcttttttttttttttttttttttttacagatagagattaattgataattgaagattagtgtagatttaatttagaaatggcctctagctacctgttggtgtatctcagtatattagtacgtgtcagtatattagtttacctacaaaagacctgttctttttcaggcttttgccagccagcctgccttttggaagatcctacggcagatgttaaatatggggacttgccaatagagaagtctgggtccccagcagcaggcaaaggctttcagttctcagtaaactgtgccctcttggtccaggtggagaaacacagatgcacacaaacatacacatgcctatactgagaattccataaatcagggatgctgaccgtggatttgtgttgtgttccctgaaatgacccattaggatgccaaggttgccgtctattgaagggagaaacttctgtaggattcgtgcctctcgccaaggtgataaactctcttgtccaattaatagtagtgtcctttgtttcaccaggtatcacagcttttataatgacatgcaactaaagtgtagtaataaaatgagcatcctgtaggctcttccaataaaaccaccaaagcagtgacagaaacaggctgccagtatctgctcgtaggcagcaggtggcagtgtgaatccaccaaaattcagtagttcgtttaaagcaaaaaccgggggaaaatggaaagaaaaattatttattttgctacatattagtcttctgacccaatcagtaaaaaagtcattattcacaccacactgggcaatatgcattgtaatttttaacaaataataggaaactgttaatgtgctcacaggaaatgcagttttgtctcgggcttctatggtcatttatcaccgcactttgtgaaatcactcatttgttctaatttgaatgtaaatgactctaaggttttacaaataaggtgacagactcacataaatgtaattgcagggttcatctccttctttttatatatcactcattaggttatgaattaaatacatcgtattaaaccaggggcatgtccaatgatgatattgtaatggcaaattactctatgctattagaggtgtattttttattcatggacattaatttgtcattaagcggcattagtttagcacttttatgtgaaagacgtgacctgcaagaggagacacgctgctgggttctcagagaagggacctcaaggggcataggtagagcattctatctctgtagggaaacacgcagggtgtttgtttctcgttttgctttgttttcttctgttgcaagcattatactggtcgcttcctcggactgaaggtgttctctgtacttgtacctgggaaatctagtacataaagcctagatgcttgctactcatctttgagtagcggagaactaacctgaggagaatctctagggcggatgacagctccccactccattctccgtcttgacccctgaccatgctaattcgtcatcctacatcctcatttagcggtacactaagtgggccacagagaagattggacattttttctctttggtgaaggtacaaatatttaaagacttttattctctcctgagggtttgggggagatttctgggtaactttgttcctgctttgataaataccagtcttaacggtttccttttttttttccaattttttattagatattttcttcctttacattttttaactgagaaacgatttttctagttgcagcaccaggaagctctgtctctgagacgtcatctccgagcctgacactctcttcaggtagcatttgactcatcctccacagggttcccagtgactagaaaatgcctttccctgcttttgccctaggaggtttcaggcacagggtccaggacctcatcttccaccaatttcagatttcctttcctattctccacattacgtgaactgagtatgtgtggagggaacagaacttaccttcattcactaatctttatctgcttttgaatattagtttattaaataacggtgtggagcttatctaagcagtctctgatacgtttacctactgaatacattctgttccattggaattacttcctacagtgactgaacttgacagttagaagcttatgtattttacagtgttataatgaattattatgtttaagctaaataatgcagcagtgacttattggaggctctttcttctaagcaatgtgttattataatttgaattattaaattagcagtatttctaaatagagggtggatattctgtataaaacaatttatcctcaaggttgaaaagttataagccacactcatttttctctaacactgagccatatttttctattagagaagatagatgattatgcccacatatatatttaatatggctgtaatccagtgtactaaccgcatgccattccaggctttccttgagctgataccctggcatttggagcatattaaagtataacccttgaaaaagatattataaacagtttaatcttttcaattctttctcggtgaaaacgataaggaaggctagaaatgtatcaactcaaagtcagccaccagctagttgtttgatctcatcaagcatgtttgtcacctagcacgggtaagccagaatgtcaggtttgccaaacatcattcatggttggctccaggaatgcatctaagatcttcagtagccatttcaggatcccagttaattttttcttatgctattgtgttggctttcactctgaaagcccacaccaaaggatgccagcaagtgacagccccagggtatgctgtctgctgagcaagtgatttcagcattctaatttgttatgtgggtagtttggggttaattgtatcttctttgtgagtttttaaagaaaggaaagaaatcttgaatgatttttccaacatctatactttccatttaagctaactcttgtgatccaggcaacaaacacaagcaaacccagcctctccatccccatatctgacttttatgaatgcattttttttcttaaaaataaaaattcttctagtatcttgtggatgccggagttcagaatcaacaaatgaagcaacaaaatgtgtatctcactttcttccgttaacactacttgaaattcgggatagttacaaggaaatctctgtttccatagagatagatactcagtctcatacccatcttccaactgctggttttacacacaatgagatatgtgccctggtctctgaagctcaaacccctttagcgtctactgcatgagtatttcttccttcacatgcgtttagtcacccaaactggaaatcctacactgctccatgactttgtgattctggctcaacttttgcgttggcttgtaagatcgttctcaaatgtgctaccctgtcttctgtttggcactgacatcctcaaggtttgcattcttccccttggactctcttgcagtaattcaaccccattccctacttgtgattatcattgcaacattgttgaacatgtttttaatctttgaaataatgtctttccctaaaatcttacatagctttccatcttctagttgccattttaaaaatctcctttgtgtactctgcctgactgtatcccaaggatagcacaccttgttacctccagtcctctgtcccctgtgggttcattcttctggatattctgcagatatttgaacataactcatgccaaaagccagtaggcactctagaatctcccctctgctgtggccagcatgcccacaatgttagctttcctacatgcactgttcggtttctcattatctctccgctcctattcctgtaacaccatcttgtaatccaggcccttgttacttccagaatagagaaactgcttggaaagtaatgaacttcactgtggctccagttcttcctccaatgttctatttgattgatttttaaaagtaattttcaatccattagctttttttttttaaaccaaataacaaactcattatactcttgcttaaaagcatccactgtttgatagttctctatagcctttggtataatgttcattcctcttaatttgacacacaaagaccatgtaggtttgcacagctgaccaggcagtacactcagttcgagttagatgccctctttaattgtgagccttctgctgagaggctagtcacaatgtaccatgtttatttatctattttctgtattgatgtatctcctgtgacataggcttataccccaaattcacctgaacttaagtgacataacttttttgccctttgctcctagtcctcaaagaagatacagcatcctttatgcaaatcactccttagtactgttttttaaaaatatttatttatttaatgtatatgagttcactattgctctctacagacacaccagaagagggcattgaaccccattatagatggttgtgagccaccatgtggttgctgggaattgaactcgggacctctggaagagcagtcagtgctctgaaccactgagccacctctccagccccccttggtactgttgagggatttgataaggtctcctgcaacacagatgctgcaccagtagattctcaagaaacaagagccagcgtggtagcacattgctcctgtgcttccatgctaagtaagcaatggtgacttttgaagcaacattttgaagctcatggtgactgaggccagcaatattagttcctgatgatggctgtatctctttgccactccctactagaattctagcttactaagaaactttcccaaagaacaatataaaattattcatgagcttcagatattatgcatataattgattatgaaaatgtaccagtaacctaattgtagaattcctctgctctatagcacaaaaatatttaaatatgtcttcgaagactgccagaattagaacatgttttttcttatgcattctgaattgcttttaatacttggtttttatttaatcaaaacatataaaatgtatatttttattagcatatggatatatagttacttaaggctattcagaaatgtttaaatatttgtatataaatatgtctctgtatatattttttgtgtataaatatatcaatgtatgtatttatacacacaaaatacctgtgcttacattataaataagtctgatctacatgatcattgaaatgcttattttctttcttaaccatttgactttatcctatcaacccctatgtagtattgggaaaactcatagtccttttacacacatgataaacatgataatttattttcatgcatgattcattccaaggctattaaaagttgggctgtttgtatctgtttgttttaacctgttccagccccttgccatatatccatgctagtaccctttaattttgcttccttgactcctagaatacagtccttccctgctgcattgggtcgggtagtcacgtaatatcttgatttataactaggttgtaatccaaataggaaacaggtggaatcacaactgggtatggtgccttggatattaatggcttggctcagccgtggaatttctaaagcggtatacactttttttgtcttaattatgcattcattaaaagcttttatacccaacagaataaagtaaatattttttgatctccatagtgtgctcccagactgtagatttgcacagcagggtcttgataatctgaataaattgtatttccccaaggactttatctttcaaataaggtcataaagaaatgcagctcccccatcctcgaattgctcaatgtgccttttctgcccgagaagctgagtccattatagtaacagatacatggtctgctatattgtctcagtctgttcttcttgcttatcaccaaagttagtttctctctctctctctctttttttttttttttttttttttttttttttttttttaaaagctcggggaccatcttactagaacttgaatgaaaacccagaggaaaggccagccgtacagctacagggatgagcaacatggaaaacaggaagagagaaagggaagccttttgatattgggtccataaagcaggcaggtaccctgctgaagatctgtatgtagatgctcaagagatggagggtcttcagaaacagcaagaaagcctagagggtcagggcaaccatgattaagattttggatggtttccaaatgaggaatagaaagggaaatgtaaaaatcacccttttagagtcagaaaagcaggcaggcttcacagtgaagccttatgtgcaagcactggcgaagcatttacacaggagtttttacatggcagcggtgatttttgaggatacttacaggcaaaccaagttttgttggacattcaccatttccttccttttaccccgtccaagagtaaagctctagtggaagcacccttggcagcaattttataggaaacaacagttaccatagctgctgtatgttagacacccgtctgtggctagcactggacacggtttcagaacgctcttcatgtttcctcgtatttagatatgaaaatttgactcaagatattgtccacgggcctgggccatctttaaatcatgttcttctgctacgattcgaaactaaagatgacactggtgcctttatttattattattattattattattattattattattatttcgagacagggtttctctgtatagccctggttgtcctggaactcactttgtagaccaggctggcctcaaactcagaaatccgcctgcctctgcctcccgagtgctgggattaaaggcatgtgccaccatgcccggctcactgatgcctttatgacccagtgaagaaaacaggaaatataaatgtatgacccaaacacgtgtccataataaattgaacttattatagttgactcattcagaagaaacagcacagcaggccgcctttgttgatcacaggtgggccttctactgtgtttccttgtaatatggaaactctgttacctagatagcatcataagatcatttcttgagcttagatcaaggacttgacatcatctttctcattattaagttatacctataaccaagctgctacttctttctatgacagtcatgggtatgccttacaacttgctttcttttttaattcacaatgcaacaaatttttttaatttcagttgcaaccaacattgattaggacactgtaggttttgcaaatcttaaaacgggaagagttagtctctgcttcaaatgacttatcatgagttggttttcagttttacaatggtatggcagggatacatgtgcagaataaggcatgctttctttgcacgttgatcttttcctgaggctagccagttgcctgtggtgtgatgctgtatagtgatgctatatagtgatgttgagccacaatctccagttaacctcacaatctctagggtaaacaaaccatactctgcagaacacagagctaagagctttagcaattaaatatatagtgtatattttcagcataacacagattgataaagatgtaacccaatcatgagtatttgaatttagtcagtaacaaagtgccttagctacctactagatcatacttgacactgggtctcaatagacagctgacatattttaattttaccttgagctaccataactaccaaccaagtcatgtgggtttttatatagaatattgtgctatttggaatagttttgagtcattttatactttccttatttccaccaagggtgccctttctttcagcacagaaaaaaaaaaggcgtatgaaatattattcaacttgctcatcttagaggtgaaaattctggaaatcaaaaatgatacttctgtttatttaaccttgagtaatatttaatattaacctcaatctaagccatagttttcaacactgataatatgagttgttggtacttattttctttcacaagtcagtgacattcttagaaataaatgagggaatgagagaaatggctgttattcagtcacagtgtcatgcaggtgccctactattaaataaaaacagatctatcagttttgttaatcttgtcagttaaataggacccctggacttgaggtatcatgttttgggaaagacattggtataaaactcagtagatgtcatcacatgataacaatttatttctctgtcaggagtatgattaaactgcagtgctgggtggataaagagcaattgacaggccagggagccgtcagagtagccaagacacaatagcctatacttctgaaacatgcactattgactgtcagcttgtgttgcagtttgaccacagcccacatcctttcattgtggcacacaggagcttgagccatggctcctgggcagtgcatatcagactctagatataaaatttcatatttttaccatccaagaagttcagtgggatgtaaatgaatctggataccattatctgatgggtaggctcaaactactttgaattatagagcaaagttgttatatagatgtcattatcagcttaactacaatattgaggaaagcattgaaatttggccagttacaccattacatgatacccatgaaaagacatcacaaaggccaagatggtctttctcttgttgtcttccctgttttgggaaggtggcaggaaggcaacaaggtcaatcaaacatctcaggccctcttgcttcctctccccacatcttaaccatatgaccatttgccttaaaataacttactttgactataattcaaagtaaggcagtattcagcattttatgtggattttttttcctcttataacttttccaagttaatcttgagaataactctatcacagcaatgagccatacaaaagaccaaagtggaaaatatataagttttaagaattattgaaattgaaaaggtagtgtttattctatagctggtgcagtgttggggacacactttgtgactgttctgtaatttaacttgtcattcgtagtataagaaacaaatagaaggggaaagagaagccaaatagccctgaaccaaggaaaaataaatattatttaaaaatattccctgaagaacaacagtgtgtgtaccataattctagatataaactaaatttcaaatgggaaacagtgtgacagaaacccaaccttttcagacagaaaagaaaagctttcttttactcaagagactgtcatgttgctgagctgtgatttccattcaatcctcctgcttcaacccatgtgcttggggattttaaagtcacacaatgaaagggaatggaaaccatctcataattaaggtaaatatcacttgaaaagtgtcaaaatattttggttcaagtagtccgttaatggagaaatcattctttcttggattgaatgaaatttggggcagttaaaatatttttttctcaaagaagaatgcttgtgttataatgcccattgtgtgtacttatattgtattgtccaggattgtcaacttgaattattattaccaggttctccacttggaaaaattgagtgagtgctggctttgtctttgtacacgaggctgggtgtggtagctgacagcagcttccccaagcacttgggaggcagaggtaggaagactgtgctcatggctagcatgggctacacagtgatttccaggctagcctaggctatgtcgtgaaaaatatttccaaaaaaaaaaaaaaagagagaggaggaggagaaggagcatgcggatgagggggaagaggaaaaaagagaaaagaaaaaaactttattcttcattagaaattagtacctgctgcttcctaagtcagtaacactgttcctgcagtttcaacacacgcacatgcacacacatgcacgtgtgtgtgtgtgtgtgtgtgtgtgtgtgtgtgtgtgtgtgcacgtgtgcgcgcgcgcgcacacacgcgcgcgcacacgcgagagcgctgcagtctgtgtggagatcagaagacactgggggagttgcttctgtcccagggatggaatgcaaggaatcaggctttgaggcaagtgcagttagtagctgatcccctttcaccagctcaaaccatcttttaactccatacttgttggcctcactgtaactaagtcacaaaacctacacctgagaataagatgggactgaaactgcaggaagagtgttccagacttaggaagcagtgggtgctaatttcatacaaatgaggaatacagatagatagatagataggtagataggtaggtaggtaggtaggtaggtagatagatagatacatagataggtaggtaggtaggtagatagatagatagatagatagatagatagatagatagatagatagatagatagattgataggtagaaagatacaaagatagatgtataagggatgatagagtaaaagctttacacacatacacacacacacacacacacacacacacacacacatgaaatggctttatagaagaattgttagagatcatgggcccaagagatttacagtaataagctttggttctggctattttctgctgaagttggggtgttgtgggggctatagccaaaccctcactttctctgatagtgttcttaatttggttttcattaagttggtaaattagaaagatctgacattgcaaatggtgaatttttatctaagcctaaaagatatatatttgtgtttggttttatatctcatagttctacttacattgacctaattatttgttattaaacatatgcctaagtacttttattgttttcagatgtcatttattcttttaaatttcatacatggctacaatgtatcttcagcctagtcacccccaactctaccctctgactccttccaggccacccctaattcatcttcttctcacttttgtgtacccttccttttattaaaaaattattactgagttctaaacagtttatagtctggtcagatcgatacataaagagagaattgaaaatttgatagcagaggtaggaatggtcatttctgacagttacagaagtccaggcaagagatgataaatgacataaaataaatgtaactaaggaagaatggataggagcaggcaattgactagatctaagaaaatacaggtcaatatggggactcatgataccgaaatctagatgtaactattctccaagagaacatacagaggagctggtccagcacttaagagcacttgttgctcctgcaggggacctaggttcagttataactacagtttcaagagatctgaaatcccaacttctgggaaaactgcatacatatggtatacagactgtcatacacataaaaataaataaactatacaaatagttagaaaaatatacaaatgaagcaggctcacaggaaacagatctgttttggacatattagtacaataggctatagaatggatagcccagagatgcccccttagcagctggtgagaaaatggattctgagctaaggaaaatggcttggggagtaatgtaggttaaagacctattaagttatgaatttgtcactcagttctgtgtttttctttttactttgttcatctttttcctccgctaatgtattggcacacttattcagagtaatggaaatttagagaggccacattcttcattttgaccttgcatcagtgacctgttgcctccagcatagctccaggatgagatctctctggtgaggtgagggagtgtagaaattactaacagagacacacaaacaaatagaaaatctgggatcagctacactaccctgggttatctgatggagaagccattggacactggaagctaccatgcttattacatacaattaagcagagctgaggttattgtgtacactggacaggaagggatgattgctgatggagcaaacaaggagtcagggcatatagtgggatcaaggagacaggttgagctaatgtcagtaggaacattctctacaggggagcagtgttcggggggagaaaatgatggtgaacactttctgtacacactatcagcatcagcacatggctcagaggaatgcctggctgcccctctgaaatcatgtggacattttacggttgccatggctgcctcatgtcaacacacagtcactcaggacttcacacatttagaacttcttctactctcaacagtgatgaactttggtttctgaataccaaaccacagtattttttattttcattgttttgttctaacagggcccaatcttctctactttgcatgagccaagttgtaggaagtgctttttcaaaaagtgtctccataacagccctgtggcttggttgaatttttttttaaattgtaaattatgagtagtgaaaatctggtaatgatctatgactcctatcagtagtaccatatctgcctgactatggggacctgtccatcccttctatcttgagttgcttctatgcctgtggtagtttgccttgaatatgattattcattcagccttccttccttccttccttccttccttccttccttccttccttccttccttccttccttccctccttcctctctctctctctctctctctctctctctctctctctctctttctttctttctttctttcttttctttctctctctttcttccttcctcccttccttctttccttctttttgacacataaacatcttctctcttataaagtctagaatatgtacgcataaataatgtgtgtatatatatatgtagatacacatacacacacacacacacactgatagtgattttcttttcatgatgaacttatacatggttttcctgaatgcttactaatcatgtctttcccaataagaggggtgtggggtatggcatcatggtgtcagggagcagagttctccagtcccttcgatttcccattgcacacagttgaactaacagagatgcatgttatgtacagcaaggtgaatagaggctcctgacatggacaggaagcactgcagatttgtgggcattgtgtttttaaggagcaatgaaaaggtagaactcagagcatcattctcttaaaacatttgtttctctcacacacagacaggtttcagtggcctcgccctttgctgttcagttgttcatggcacaaatctacttagcattcttggctctattaatatagtcctgaaacgatacaaaaactgccttcaaaggaaatacagtggggctgaggagatggctcagttggtagcatgcttgctatgtaagactgagggacctgagtttatatccccaacactcagataaaaatggggcatggcagaccatatctgtaactccagtgttctagggaagacaggtgaatccctagaacgcagaggccagccagcctctctgcatcatgagttccaggtacagtgagaccccggtctcaaaaaataaggggaaggagctcaaaaaagacaaatggcatgaacatctctggcctccacaagcatacacatgtatgcacacacgtgctcacatgcatgaatgtacccacataatcatatacatatcgcacacacaaagatcctcaaagagactggggagatgacttagaggctaaagtgcttttctgagaggcatgagtactggagtttgggtttccagggtgcacgtaatgtcacataaatgtggcagcctgtctgtttttccagccttagaaagtagagatgggatgccagaggaagctgactagggatcctagccatattggtgagttaaggttgagattgagagagactgctttgatgggtaagatggatgtttgctgcaggatcattcccaacatgacctcgagcctctgtatgcatacacattcgtacatatatagacacccacccacaaacacacatgtgcctacacacaggcagtcagtcataaatgtatgaaatatgagcaagtggtgcacacctttaatcccagcactcgggaggcagagccaggcagatttctgagtttgaggccagcctggtctacaaagtgagttccaggacagccaggactatacagagaaaccctgtctcaaaaaacaaacaaacaaacaaacaaacaaacaaacaaaataaataaaaataaataaataaataaataaataaataaaaatttcaaggagaacattgcttttggttctttaaggaggaggaggaagcagagagagagaagcataagttgggtaggtaggacgatgggaaggatctggaaggagtaagggaaaaacatcaaattatattatacaacaattaaaaagaaagagaaaaataacacttatttaagatcactcattaaactaattttagaaattatttgcacttttgaaggggacttttcaagttgcgggctttcaagtaactggaagagacccagaataggtgtaaaaggatagaaaggcccctagcgaagtgtattcagttaccattccatattcaagccgtgctttcttcacttgctccatgcctctcccacctccttagcaccacagttatttctgctcttgcccactcccctctttgtgccatgatgctagccactgaatcagaatcctgctcccctccaagaattgaaaagcagggtttggaagaataccagagtaatgctctgggatgccaaaatatttttaggactccaaattaggtgaacttgcttcagagatgtattccatctcaaagatgtgctgaagtgcacgctagaatctcctgccatcctcgtacttacaaatcctaagaagtaaactctgaagaacaacaattttaaaaagacttgaaaatctggttcagtgacttctgtattcctttggtaaaatgtgaataagaatccggggttaccactgcatacactagcaagcctttgttgcaaggacggtgatatagctgtcccttgtgagactaggccggggcctagcaaacacagaagtggatgctcacagtcaactattggatggatcacagggcccccaatggaggagctagagaaagtacccaaggagctaaagggatctgcaaccctattggaggaacaacattatgaactaaccagtaccccggagctcttgactctagctgcatatgtatcaaaagatggcctagtcggccatcactggaaagagaggtccattggtcaggcaaacattacatgccccagtacaggggaacgccagggccaaaaaatgggaatgggtgggtaggggactgggggtgggtgggtatgggggggcttttgggatagcattggaaatgtaattgaagaaaatacataataaaaaaaagaaaaaaaaactatcatattttaacaatgcctgtcatcaacatttaacagtaatacaaataaatccagaactttgcgagcttctccattggaaaaaaaaaaaaagaatccagggttatttcagtgaaagtgtgactggatctccatcaacttgcatagtagtagacttcaggggtcatcttttttaaaaagcattttaacaaataagcatttagtcctttcagactaacagcaaattctccttccctactctaccagattagtgtatttctctctcagctttcctcagaaaagtttcttactgtagtagactgtgattaatatagagaacgacaactggtcagcatgccaagagtcagggaccatggcgtgctcggctttaaatgggacatctgtatcagacgctcctttaaagccatcatcatggaagaggggaaggagaggctgtaagagtgtgtggctgtggatgtctgcacatgctggacatggcaggactcttacatacaagaactcacagcagtgaggactacatacataagacctagataagatctaactagccagaatcccagtgtgaataggaaagggcccatgaagtcccaccctcaactgaggtacaactgaaaattagtgtctgctagcagaaggaaaatcgatttcctttatgggtgtgttgcccaagaggacacatgtgctccagaggttgtcccatgcccaggcatatacaggcagcactaagtggactctcattttaaccaaagccagaacatatgaacttgtgatatatatgatcctgtaatatttgagaatttaagtaaaaataagattttaaaaatactcatttagaatcaaatattatgtgtatatatgtatatatatttgttataatagaattaaatattgttagttaataatctgagacaactagggaaaggaaatatgtcaagtttagttaaataggtgtacagaatgtctataaagaacctatagcttgtctcgtagcatcctctagaccttctgctcttccaaacactgcccgcatattagtgactataaagtgagaatggggagcatctaaagatactgtcattcttgttatacttaataggcaagctttctatcaacagatgagccactctggctctcccaggggcacagtgacagaaattccttgggaacggggggagctgcagctttatggctgtgggttcccagagtccgggctgtgtgtgatgctgggaatgggtaggagggtatgctattggtgttctgcatgtcaaggctaacagagcaaggtccatgtttaggtgggtttggcatataaatattcaagacacaagtcttttctgtgagattaacccatttgctaagatttgcatataaatttcatctttcggttccattaaagtaggatgagttgtttctctgtacagatgtacttaggttaaagtttcagaaacaatttgaagtcagtctggtttttgttttgtatttcgtccttaatccccacttaactgttcctgtattaccaccagtagacaaaaagcttaactaaattacaggaagggtagaacacataactgagtctgggttcttagaggatagatagaactgatagtgtgtatatctatctttagtattatattatacttagcatatataataaatttcctatatataaatacacaaatttatttatacttattatagtctttatgtataatagcctatattctatttattttattatatatataaatttatgtttatagatataaaggagatttattagaatgccttacagtttgtagtccatctattccaacaatggctaccagtggaaagtccaagattccaatagttgttcagtccacaaggctgggtgcgtcaactggtcttcagtaaataacagaatcccaaagagtaggctctaatgccagtgaaaggagagcgagaggaagcagtgaaagagcaaaaggcttctctatttcctgtccctcagataggttgccatgagaaggtgagacccaggttcaaggtaggtctctgacctcaaacaactgagctaaaagtctctcacagatgtgagatttagttaattccagatgtaatcaagatggccagcaacaataaccatcacattctattggtaagggcttccaaaggttttcaaaagattataaaggagcatttcagcccacaaaacccagaaagttctttctggaaatcctaaatcttaaagatgtttttaagaatatggatttgtgggctggagagatgtcatagtggttaagagcactgtctgcacttccagaggacccaggttcaattccaagtgcctacttggcaactcactactctgtaactccagttccaggggatccctcatacagacatacattcaggcaaaatattaatgcacataaaataacaataattttttaaaaatatataggtttagagaaggagaaaataataaaagcttagagctttataattggtggggcagggggatggtcctaatattaatggccccatcccctgtgcctgttataaaaacagtggtgagtggacttaaattcttgcctgttctttgtgaatttctaagagatttttttttgttgtttatgtttttggcacccaggaactaaatagctttaattacttggatctgtacagacttgctgacctctttcacctcactttgttggagaaggcagtgattgacttcctagtgaagcatctctcggagctcctgaagagccgcccagaggatgtcctcacgctgccctactgcctgcttcaggaggtgctgaagagtgaccgcctgacgtccctgagtgaggagcagatctggcaggtaaggacatggtgcctgacctcaggaaggtgggacatgattagaaagggaaggactctggagcaacaaccattatttgatgaggcatggctatcggttgtgttgaagccctgctccctagttaggcaagtcactgaaggctaccaggtctgcagcccaacttgggatgaggccactactgtggcttcctcaaacctgggtaaattgcagaaggaaaagaattttctcttgaagacaaaaaatatttcttaagctgaatatgagaagaatggattgtaaagcaaatatattgtaaagcaattttatacatacttaagccactgaatctaaaggaattcaggggtttggtgaaaaacaatctagtaatatttctttaaaaaattattttagtgagaaaaacttagaaatatcttctactagttcaaataaactttttcatgtgagttttttactaatgtgtagatagcttagttaatgggttttgaagttggctaattttgatgatttaagtttgggtgaagaaggacttgttcacaagtcaatgaattgaaaatgaacaggtaaattagtacaagagatcaatggtaaacacaagtgttcaaacatggttgtagtttggaatctatgaatagaataaaatacttggcttgaagtccatttcttaaattcctactaagagcatagtgtttatgtgtagggaatttggactttttaaaaatttgtttcttttatttttgagattataatataattacataatttcttctgaggtgtgaaggaagggggtaccttgatgggcccaggctgaggcatcccttccctctgagggaccagccacatgacagtatagtataaagtagaatttattcagggtatggcaagggagggggggggcagggagagagggagagagggagggagagagaggagaagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactatttatgtatatacatagacttacatggactgtaagttttgtttttaaggcagatagttaatagcatgattccttataacagcgttttcagacatccttcctattattgaaaccccttcctcctttgcatatctctctctctctctctctctctctctctctctctctctctctctctctccttcccggatgtcctttcccccttttccattgtaagatcagattccgtgtactctaatctattgctctatcctctactgccctatcccttctctattgctcccctaactgctatactgacaatggtccctttatacttgcagcaccattttcttattgcaatagaaagaagctcagacctcagatgagaggaagttcttcctactttatagtgagaaaaacaaatcttcctgccatggttcattatgcattcactcaagcgctcacaagcccctccttctcccctgactgtagaatcttttcacatcctgtcactgctttgtctaggggacagaggatgctttttgttggagagttgattattcaatttaaatcctcttctgctcatccctagtgactgtccttggataatatgcctgaagactttgggatctagagctcattttatcccttctcccttcgctgcctagctcattctacagcatcatggctacacatccttgacacttggaatttcaggcctgcaggatgatatgaacaggtgctatctgctatactaggagaagttcaaggttctatgggcagatgagagggggtaagcacttatcttaccaaaaatgttcaggaagctttttaccactggtcaaaatgtgtcatctaacacctgattctactgatgtataacttttgtgatatcttccttccttctttgaacttttatcagcaacagtctttctttttattgaatgtagtaagagattagggccagcaaagtcacaggcatgtgaaacttattgatttagtgcacaacaggccaggtgggtgactatctctgtcttctaacaaatagaataaagacatcagaacttggctctagtttacagagcagagccacccttccaatccaaggctgttgatagctaccatatctctcccccagtccacagtcttgattttaaaagaggctacaagagtctgctgcatcctgggcatttctaggaaggtttgccatggttgtaagcgctgttgaggatgtggttctgacagggagttcagaaatctggagctccctcctatcatacaaaccatcagaatttactatggctagctcagagtatgaagtagccaaatcccttcattaagggaaaaataaacacaatggattctgtatgtcggttttttactaacacaactgagatttgaagtcacctcttcttgtgacatctgcctgttattttcccatagttttaggcactgccttagatagggcacagtaaagtgcagatgtctgactatcaggaaaattccattctgtctgtatagaagctatcacaattgcctttctaaaggccactagttttataaagtagaattttagaaactggtttctgcaggcaatatgatagtttgttagacctgatccccaaaaaagaattaaaagacttccataaatattgtcaatttaggcattcaggaggcaataagaaattgtttttgctttatcttagtaaataagtaattccttcatactcaatagagaaaaatcaaatcagaccaactatattgcctcaagtagagttaagttcatcatttttttgctgaggttatactagtaatgtaatataccatggacgaatctaatattcagcccagggtaaagattgggtctgcctgtggattagtgtcagggtgctttatagaagtgaaacttgacagacaggctggagacagatctacagaatctcattaaactgctgaattgttcattacagaacgttctcactgtaataaagtgctcattgactttgacaaatccccatcccatgtcttaaagaacagtgaagaagaggtgctgaggaagagaaaggaaattggcacaaagtagggcaggtaatagaaacgtggaagaaggtagtgctatttgattaatatgtgcacggtagcttaggtgaaacacagccaacacacacaggtttacccaggtggctgtttcactacattgtgataatgtaatctgggacaatctcttcttccgtgaaaggactaattttcattatatatcaggatgactctgaagcctgtcataagaaccattaaattaatcttgtagaacaaacttttctttttttatttacctttttctttttctgtccctctccttgataaagtttgccacaacctgcaatgaccattttgtggtcccatgagccaactaaatctcctcctcattataccttggttttgtttgtttgtttgtttgtttgtttttgtccatttgatttttttttagacaggggttatatattctcagctgacctggaactcagtaatagatgagttttttcttgaactcacagatatccaattgcctctgcctccagagtgcagagattaaaggtgtacaccaccatactcagatagtttgacctgtttgtttgtttgtttgtttgtttgttttcgagacagggtttctctgtgctgtcctagaactcactttgtagatcaggctgacctcgaactcagaaatctgcctgcctctgcctcccgactgctgggattaaaggcttagtttgaccttttaaaaactcttctatttcttagaatttcttagtcttatccagacaggttttccttcgtttagccaattattgcttggtctgttggttaacttcattatgttttcagaggaaacagttttgaaccacagttatatgtcagatgttttatgacctaaaaaactttaaatacatatcatttcaaatttacctcagtatagctcaacaacttggtttatgtcttcaggacaatgatttctcaagttccaaaggaaaggcaccaaattattatcttcaaagaaagaagaaacacaaccagcaaaaaatgtgccagccagcacagaggaactgggggcatgaaatctcactgtgttgtctggcaaatttctaccagtttgattttgctttcaggtcagtgagaactcttagctctaactccagattttgttttagtagggtactattaaatgtatctggctagagtgaaacacagccaacactgtagagtcctacgtaggggtcctgccaaagaagatgtgggacaaagggttcaaatttcacaaattctgaagattagataccttacaagggtggcaacggacatgctaattagactgtggtaacagttatgcaacatttgtatgtgtcagttcatcatgttgtctacttttaatatagtcagtgcttagtcgccagcaaaatggttttaaataaataagcaaacaatcttggaagcctgtttgttttctaatgagagagaagaaaaaatgatgtgaatttgtgtgaatggggagttgggggaagggtaaccatattcataatatattgcattaaaaaatctattttaatagaaaaagaaaaacagctcaaaatgaaataattcaatgcccttcctacagaggggctacttatctctttcttctcaaaaatgtacatttcctgcttgctcagtcacagattctatttttctagatttctctagagtgggaggtggatctcttctattggagaaaagttgataggaaaagctccacatggcccaagttcatagacaagctaacagagaaggcagtctctcttttcagcatggactgagcagctgagaacactgaggtctcttgaggtggaaaacagagcacagttggataactctgtttcttccccaagacccagccaaaatggaagagatttgtattgcttaaactgtaaaaaataagtctgataattgtgactttgcctctaaaatagtagaaacaaatcaaacaaagcaagcagatcaagataacttggtgaaataagttgaatatttttgacacctgttgtgtgtttgccttagttagggttttactaagtaagggttttatgaaaagacactatgaccaaaacaattataaagataacacttaattgggctggcttacaggtctcaaagcccacccccacagtgacacacttcctccaacaagaccacacctactccaaaaaggccacacctcctaatagtgctactctctggaccaagcatattcaaaccaccatagtgttaaacatagtgttagaaattacatcccccccccccaacacaatttaaggtaaatttcaagttatttaatcagatttattccattttaatatttgcatttgtagaatatttatttccctttaataatttactaacacttcctatatattctctaataatgcttttactcctttgttgtccttggcttgtagacactttcttcctattcataagatgtccatgctatctcttttgagctggcataatcctgtttacatctgtctgtgattatggacttccagaggcagaggctgggcctgcaatgttcacattgtataaccatgttgttctcatgtatcccataaataataatgacaataatgtgcagccttaatattaaaattgaatgaatgataagatatactactattcctatataataatgtacttaatttttttttaggaaacacggtatagacaatgcgtttggccttttaaaatccgtattttcttgtatcttactggaaatctgtgtctctagaagggagagctacagactggagagggtagtcaacagcctcttctgtgctgatgattttttgtttttgttttttgaccagatcttctttagcttttgtctgcaccacagaatccatgcatgggggtttcaacttactcattttccttaaaagtaatcccagnnnnnnnnnnnnnnnnnnnnacttctgcaggtttcatcttgtacctcttatagataacctgacccgaatatacttctgatccgccataagccgatcacacactgcaactggtgaaccaatacatccctgcgcttctgatttacacagtgagtcaaagtcttgagaatgcttttatacttaccatttttttcagtccaatgatataagtggaaaattggcagaacaaagctgcaaattcctgtcccttaactttgtacctatccaccctggccaagagcctaaagttattaagaactggtaaacagattgcatcaaacattcctttgcctttaaacaaaattaggaaaggccgggtatatctcagtgcttagagtcttttctgtggtgagtgaggctctgtatccaaccccaaggactaaagaaatggagacgtaagaagacattttaagctcttgcggttctctgtgtagttgtgcagtagcacccacagtagaaagagtatgactgctcttcctgcactgagtctgtcatcttgcttattcttctgtgtgctatggccgtgcttcagtccttcattcatgataactaggtactgaggtcctgctgtggcagccagatgctactgagcactcttgctgcctgcggtaagtaaggcatgggtgctggatgcttggtagtggccctgctttcctgggtgctgtgggtctgctgtggacagttctgcttgtcacttggggtgtattgaaatgactttgtttctacagaaatagaagtgcaattgcttggacattccctcggcatccagggttccttcattgtttctttagtaacttgttcattgatgaatcctggtcatgctcatatagctttgaaaaatctctgctggtctttgtcctaatcaaatgaatcatagggtatgcttatataatcgaaaattttccaaaatagagttcacattttaaatacatagatcttggtaacttaaaatgaagtcagactctgtgttcttagacttttactccgaaagtgtaatctttcattttatccttgtctatttttgtgcataagttgtagtataatagtattgctatatttttccgggctaggcctttgcagggtatatttatgtattaatttccatatgtatttttactcaccaatccctaagctaatcaaatttgtaccagttctcaattttcttcccgaaactgcctactcgttccacccagcggatacagtcttctacattctattaaatgttagtggagaaaataaacaccagctcctttgcatctcaaatggtgcagtcccgaggatgcttcttttacgggcccccagctggaccctgagagatgctgttctgcctgggcttggtacttgaacatgctactgtgtgtgtattcagtcattcctcctgacctccacgctgctaattctccgtgcgggcgcttccccggtagcttgactagtggctttgctgttgtttgtctgggctttatgcctttgtgagacacatgacacaaccatttcatagggactttgctgcagccaattcccagcactagggcagtgtgctgtcgagtagctgtgaggggtagcgattatcagaaattacaagaaaggcaacttgtattcatgtgctgctggtcccgggagttaacagtttctttttctttttccttttttttttttttttttttggaattgaacacaacagaacaagaaggtaatttatgagatatgacatatttatgttttctggttctaattttcattgtgattcatgttgttcccagactgatatttttgttgttgttatgagaagggaaaagatgactggagaatattacttatgcattggtggcctgcagtaatattgctgctacctgggttatcagggatttaaaaataaaacccaaccataagctgtatatgaggtagaaaccctgagggcaggcacagaagtccaccaataataacaacaataataattcttagaagcctagagagctttctattttaatgaattttttacacataatttcatatgaatctttccttagacttattatagtgtaggaggcaagttttatctaaattttaactagtgagaaaagcagagtctaagtgtgagattcattgataactaactcactttacattttgttccaatggtgatcttactttattctctcagaatacaccaagcatctcccccaaccaaataaataaaagtagtccctacatcttccatatctaaatcttactccataatgaataaaatcaactattgatattttcagtaactggccagcattcctttgaacatcttgtacaactctgagggaaacagcaaaaatgactctgataacagcagtagcggaatcagcagtaggatatattgctgagggtcttgccagaaaatttggggttctttagatgggtcaattaagaagaacggatagagcatttcagttgctcagtgaagtacctgatgttcgtcagaatgccaaggggaggctgataaggtggagtcacttgcagaccctgtgaggcgacttcatcagtgtaagagagcgctgagttcctttacttctgctgaggtagctaaggaagactgggcaaatccgcaggctatggtttctacctgggactagaaactgtatggaaggaatggaaacaatgaatcatcatgtcttcattatatgctcattatgttgaaactttagaaatctgttacagaagttgatgcttggataacagcctagatacggagtttaagagatagaatatgtaatttctgaacaaatcggtatgtattgatttggtattagtgtcttccatgttgtccagtaccaggtcactcaagtggctatgcagttcgtgatggttggccatgccagagcatactgattctctggccctggcattctcactgagtacatcagagcatctatgtagagtggcccaagaactcaaagatactcagattgaattgaaatctctgaaaaagacgtggcatctgttatttattactaatatcatatgtactacttccttcaccctgtaacttttgataaaatataaaataaaggccaagatttggattgagctataatgtaatggtgggtacttacctggggtgcatgagccctatagtccatctctatcatataggaagaggacgtttggactcaaaatacctggaaacaagtgattccaaggccatggtctgcatgagaacccatagaaagagatgaatcttaggttctctttgggcccattttgcagagttcccagtgatgacgttctccatcatggttctagcacctcctctctgttacaggagtattataatcaagacagcaaatgaatcccaacaccctggtaggaaaagcagaagcagatgtaatcaattttagggagagttaaaaggaccttgatgttttccaaaggtaggtagtacagttgtctaacattctcctgctttgtttataaaaaaaaaattgcaggtcagtattggtaagagacactcatattttgttcaagtacaagtcaaaagagcctatcacacttgagattgaaaacttctgtcttcctagtgtgtactcttgttgatgtgaaatgtccacacactacctcctctggccacacaagtaagtctgataatgaaaggctcgatggatgctatgcttaagtttaaacgttttaggaaggcccatcttattaacactttaaaacaagtgagtataatatcattaattttgattaatccatttgctcttaatatagcttttaattcgtaattctatgtgaattacaatgtaatttggcattaattatactaaatgggctataagtcagccaatcacaatgggaaattactcacagctgaaaggaaaactaagctgtactctgaaaggttgctgcttagttagagatcagtacatgtaagcatccttctcttctggtgtgagactggcactgtatatgagcactgcaggggactcctggtgctgcccacttgtgtagataccctgggtaagaaagtgcatgcatatccagaaaagttaaacagtatggtaaataaaggcgttcaccaatgctgacaggattcctgaagagcgggctttgctcttctcctcccatgtaagattcggatgctgtaaaggggctacgtgatggaccattccgtgacccttgggttctgggccttagaagtggacctaatcaagttgccctgcctttcttctgcatgtattttgaacccagaaggaagtgctggtttctacctgatgagccatcagtgtcagcacgtcatccagtttatcctgtacacaaagcaccttctgttcagaaggatgccatggcttaagaagccagcctcacactaagagaactagctccttgggagccttggtgacaatcgctatggtgcctgtgtgcccaatggatgggatgtgccatagcagctgagtccctgagaaagtgcaagagtgtaaggctggactcggaaagtatcttttggaactctttcctttgaacttatccttagaataccacggcagggcagagtgctgagtgccccagcttgtcctcagcttgggattttattcttgaagtctatgcacacagaggcagaattttgtactttttgggtacatgtgtatatggcagcaggccttacagtgaattctctctagatctcaggggaattttgttttctaaattactacatggaaaatgggaaagcctgctattctgtccactctctcttttactttgtgaactgcttgcctttatcctgccattgcactgtacagtttggccaagaaaacaacagtctaagttttctgtaaagctacttagttaagatgttaaaagctaacctgaacgctgagccagcggataccctctcgccttacagcagtgctgagcacaatccaaagcagtgcactccagagaggtagaatcctgaatgttcaaatcctaaagaaacgtaaaatccttcagagcctgtaccacacacacgtgcgtgcatatatgcacttgtgcacatgcaaataatacacacggattttatagctaaaccttttccctttgttttgtagctttgacttaaaacctatcagtttcatgatgagtccctagttgattgcaaacttaagaaaatcgaagctagaggcttgtttattcggttccattcatcgctatgttttaaaggatgttaatatctacagtttgttaatgcaagaaggactgtataactaacttcatactgtttcattttctccaaatccatttaatgccccgtttacctggccccgtcttagaacttccattcttctcttgggatactctttttatgtcagctttggattggtggttctgctccgttctctgccacttgtggtacagcaggggagcttcaggtttgtagccacagttgattctagctgatgcgcacccactgatgaatgaagtctttctcagctcttcatgtccttcctgttctcagagaacaaaaaggactgggaccgagggacctgtactgtggagctaatgaaagcgtctccggcgcatgcgtgttctcagcccgatcctctcagcatttgcaaagccagctgagcaaaaaccgctctttatcagactgcgctgagaggttaggccatggaagcctttttagtcattttgtgcttttcaagagtgaatttgttagaattatgctgaatacccacttaaagcctcagctgataaccctacctgtgttttataactctgcactgtcagaactcataataagtcaaacattctttcagtggtgctcataagggaggaaaaaaaaaaacctcacaaatttaagagtaatttcagattgtaaatgaaaaggagaggcacgactgttcatttgcaccaatcatgccttcctttcatctgctctgattaggactggtgcggcttcatcagactcctccatcaccgagctgtcactccagccggctgttgattgaaaacaatcaaggctctgatggcacaattattctgaccctttaactagaggctgctgtgataatgaaaggttgattatgatagtttgtgcctctttcagtttgccaagaaggttaatttgggcatcagacggatgtttaatgggcgcttgctggctacaccgaggtaaatgagaacgtgcagtcttggatattgcacggatatagtttggctgtcaatcattgtcatttggagtttgtgcctcacactctggaaatcacattttattttttccttgggatttaatttattctgtgccctgaggaagttctttcactcagtgaccttcacagcggctttctctgccttttccccccctttttttcaaacggagctcaaaggcacaacacatctaggagagcatttttctttcattttcacttaaaaatggaaactttaaaaatccatccttatcactcccttccaatagagcaaacgtttccgttctgatcgtgcagaggggaagttgcagcgacagggatgctgtagctgatttgtagccgtctgtgcaggtctgcgccttgtacaagaagcaatgaatgctgtgaagtcaaactgtgcagaactggacctgaagtctccagtttcctcacagtcccctcaactgtctctctcgggatgctttgtcaaatccctgcttcgaaggcagcatcttactctgtttccttcttgggaggcatggggaagacaggaagacagaattgtaaatggtattaaaaagcttagtgtgtgtgtgtgtgtgtgtgtgtaaaaacagagagagaaacagagacaagagagacagagagagatagagagagagagagagagagagagagagagagagaccagagaacaaccttaaatgttgttcttcaggttctatacttctttttccagacagtttctcactgacgaggtctgactggccaatgtgtcctgagatccagctgtctatgcctcctcagcactgagattataactttggactctaggaattggactcagggacctcaagtttgtggtccccaaggcccaacagcttacagctttcttttgtgtagatcttgtacctggttgaagctcagtgtagaagtctataccagcatctaataatgctgtttatgattgtagctcacatcacaatgagatttattcaaacctattacagagaaaaacacatgatccaaaaagaaaaagaaaaaaagaaaaaaataagagaggaaggaaggaaggaaggaaggaaggaaggaagagaaccccttacttctatttccagcctatacatggcggtctgggttgggaggagactaagagctaatcttactggtctcctttttgagtggttgcatctcctcaccactcaagatggctgtatttccacttagccctaaacattcattcattctttcattctttctttctttctttctttctttcttctctttcttctctttcttctctttcttccttcctttctttctttctttcttttttttttttttttttttttttgagacagggtttctctgtatagccctggctgtcctggaactcactttgtagaccaggctggcctcgaactcagaaatcttcctgcctctgcctcctgagtgctgggattaaaggtgagattccacctcacaccagtcagaatggctaagatcaaaaattcaggtgacagcagatgctggcgaggatgtggagaaagaggaacactcctccattgttggtgggattgcaggcttgtacaaccactctggaaatcagtctggctgttcctcagaaaattggacatagtactaccggaggatccagcaatacctctcctgggcatatatccagaagatgccccaactggtaagaaggacacatgctccactatgttcatagcagccttatttataatagccagaagctggaaaggacccagatgcccctcaacagaggaatggatacagaaaatgtggtacatctacacaatggagtactactcagctattaaaaagaatgaatttatgaaattcctagccaaatggatggacctggagggcatcatcctgagtgaggtaacacattcacaaaggaactcacacaatatgtactcactgataagtggatattagccccaaacctaggatacccaagatataagatataatttgctaaacacatgaaactcaagaagaatgaagactgaagtgtggacactatgcccctctttagaattgggaacaaaacacccatggaaggagttacagagacaaagtttggagctgagatgaaaggatggaccatgtagagactgccatatccagggatccaccccataatcagcatccaaacgctgacaccattgcataccctagcaagattttatcgaaaggacccagatgtagctatctcttgtgagactatgccggggcctagcaaacacagaagtggatgctcacagtcagctaatggatggatcacaaggctcccaatggaggagctagagaaagaacccaaggagctaaagggatctgcaaccctataggtggaacaacattatgaactaaccagtaccccggagctcttgactctagctgcatatgtatcaaaagatggcctagtcggccatcactggaaagagaggcccattggacacgcaaactttatatgccccagtacaggggaacgccagggccaaaaagggttagtgggtgggtaggggagtgggggtgggtgggtatgggggacttttggtatagcattggaaatgtaaatgagctaaatacctaataaaaaatggaaaaaaaaaggtgtatgccaccacgcctggcctaaacattatttcttaatgtgacagtgataaaacaattatgtctatgggtgttaaaatgtcagcaccataacagttgtaacttcagttcaggtgttttcataatatttgtttctggctgtaaagtatttatgttcttttagtaggtaactattacagaaattaaatctatttttcaattagtgagctttattatgtgtatatatcatatatatatattatttgagaattttatatactatattttgattatattatatactattttctttttaaggaaggtatttgtgcttgagtggtaaaaaaggtccttgggtaataattcattcatatgaggttccaaagtgaaggtagacattgaatcccattatgatgttaatccagcccttacttaagcagtggtgctatttagaatgtgtgtttaaggtgacatgagaaaaggattgttcatgtatgtggttttaccaaattcaccatcacattcaagcacaaagcattacttttcttccattcagtgaactgcatggatgagatggccttcagggattcttcacagagttattgattagttatgtctgcttttttagcaataggaaatacaggataataggagagaaatatgtcaaccacaccaatcaatacttttattgttttcctattttgaaaagtggtatgaggtttaattgtaatattaccttgtggtatctgtgaaaataaatcattttattttgtagactaacttacttacctttctattgctgttacaaagcatggtgaccagggcaacctatagaagaatttatttggggataagactatcacagtcaccatcaccagggtaagctttgcatcaagcatcaggcatgacaacaggaacaactgatcgtgcatatctttactctcaagttacaacagagggagtgcactagaaatggctgggttttcctcaaagcatgcctctaggggcctacttcctccagcaaggccaacttcctaagcctccccaaacagctcccaactggggtctaagcattcaaatgccaggaactatggaggacatttatcatccaaaccgccacatagagtcactgtgtctgctagttaatgagacttaagccataaccaattcctattacaagaagtagaagtcaggttttcatatcggtgtttgtcaaagattgcctgggttccgaatgtccacaaaacattgtcctgtttatgttgaaatgtagaaaacttgtctccaaaatagaaagtgtttcttgccttttcagaagcctacctaccactgtgcccacatgctgacttagcccattgagattatgccctctatgtacaaatgcacttcttcaaaggtcctggccaacattccacacctcactgcctgccttggactgaccgttcctctccttttgggactgggttcagttactgggccatgtttcctttctcccttgattccttccacctcctgtggagatttagcactctccatattgactttgtggagaaggcataggtctgtgaggtcccagagtgactccttttttccccactcagcaaacacctgtgggtttcaacaccggaagctaagtacagtctcatctcacatacccttccaaagagcacttggaacctccgctgtctcatatgcactctgtgagctactgtaaccccctctccatcacacagctccagaaagtatcaagctcgtggttcccctcactaagggtcatcttcttcacatgaacactatagacagagtacctggggccaccacacctaaactgagcccttagccattttccctgaagtaaaattataaccattatgatccttgcacacttgaaacctaatttgagacttgtttgacattcacttgtctgaggatgcattcagcaccttcaagcctttcatgtgactgattatttattgactcaaatctcctctgaaattctatttcggttaaaaaaaaaaaaaccctatggtgattatagtgaaaaattgtatctttttgtgtaacataaatgttacaatatgggaaagagggcttcatgttgccctaggtatttctactatgcagaaatactatagtattttagctatgcagaagatgaattagagaatgacatgtgaaatgatgccctctaagcatcagtagtaagtctcaaactcaagaagggagttactgtgtggctccctaatgcattggcagcttaagccctgtgcctcttcccttggcctatctgatgttctggtacctgctctatgaccaaccatcttcagaatgaatgctgacagacacctcacagtgaatagtcccatgcaacttggacacttcctgtgcaccaattgactgtagcattactacctgagggaagtgacttccctgaggctttgcttaaatacttgagcctatgaggttcatctggtcatgctattatagctttgatcttagttggggagtatgagtgcacaatatatctgcttctgtgtgcctattattcatgaaatattattcaagccacaaaaaaggattcaaggacttgatactctcaggatgctctaaggcaagtttaccaattaacagttttgttagccataaagtatataaatgtgccagcatcataaaaacaccaacgaagcggcagcatagacagtccaaggctgcaaccacatctctgtctccacgcactgtacctgccagatctttaggattctctactttctttcctgcagcatgagtgtactgtgaaagactcaggatatgtgacttgatatggtgctagtagacttggaattgaatggcaagcaagactccatgtgtatgtattaatcagaatccttctcattgtgtgtgttttgggcacatagtgaactctcaagcaactgacgaatggatgaatgaaaagcaaactgaaggaaagatttatggttacatcatttatccacagaaaaccaaccaaccaacaaacaaaactcaaaaagttaagtagtcagctcaagcaattgattcttaatttagaagttaccaagtcttgagctagtctgtatgtgtttttcattacctgtaagttaactgagttgagatttgaagagactcatgtggatgagaattcaaatattttttaaaggtgacatctaagtcaagggggaaaaacaaatattcttcggaaagacctagactcaagtagctttctctcttgggatttttacgtatgtgtacttactcctttatggccaaacaaacaaagccacacaacttaaaccacagggatggaattcctaggtcatttgtaaagacaggaccatcataagggctgtctcaggcctattatgcagtcatgtttgtaatgttactttacaatatgggaaacatttaatactgtgtttcttacaatccacaactatcctacaagtttatgtcaacttcacacaatactggaccttattaaaaagtagctggaaggtgatggctttatcttgaacccaagagaatatttacattgaagaattactccatttcttggtgccatattttcatgacatttcttttctacatattgattttttaattttcttaattttttattaatcattcctgtcgtttacacctcaaatgatatctctacatattgtttaaatgataaaatttaccaagcattttcacatgttattgtattcataatcttcttgagaatcaggtgacttcggaaatatcccagtgtacagatgctgacactgccttggtggttttcttaaatgcacagatacatcgttacagaaatagttgtgagtgcgtgggctgagtgtgtggtgggcgctaaggctctaatcctcacacatatgagataagctccagtttatttgagctacaacctcatcatgaaaataggtttttgttctcatatcctacttcctttctaccttgctgcatttccctcacagggtatgtgccaaatcgtcatccaagaaagcaccaagagtacctgggagttcagctctggtatcgtgacaatgtcctcactaccttcagtgcttggaggagaatgtaaatggtgggccacaaagggtactccattccctgcttaccagcggggcacaggagcattttctctcatatccagggttattccagtagtatatgctatttctgatttgccaaatgcaaagtccgtttagcattcaggatgctatacatcaaatataaactggcatcttagttagatattttatgtcatcagctactatcatatacttgccctgaaagaataccttggtgctcattggctagatggatacctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaatattttacttacatgtaatatttaattccagtattctaaataattagtagcattttgaagtagtcatcttgaagttttaaaacgtttttgtttctttggttaagattaatttgtataagagatctagctattaatatataagatggattgtttatgttgggcccaggaactattagaagttggagtagaagatggagtaggtgtgtccttgttggagaaggtgtgtcactgtatacgtgggctcaataccctggaagccagtagtctgctagcagccttcagatgaagatgtagaactcttcgctcctcctgcaccatgcctgcctggatgctgccatgctcctaccttgaaaataatggactgaacttctgaacctataaaccagctccaaataaatgataacctgttaagagttgccttgatcatggtgtctattcagcagtaaaaccctaagacaatatattaatgcattaatatattagatgatacattctgatcaaagctctttaaagggaatgaaaatcttcataaaaccatgttataaactagttttctgcttgtgggcctctgtgtacagaggccttcacattcagacatgctgtgctggttagcttttattgatttcacacaaactagagtcacctagaaaaatgaaccccagttggagaattgcctctatcaaattggtccacatgtctgtgaagagttttcttgattgctgattgaggtagaaggctctgcccactgtgggtgatcccatccctgggcaggtaggcttggattgtgtaagaaagatagctaaacaagccagagttgcaaacatttaagcagattttctccggtctctgttttcgtttctgccttggcttcctttgatgatagaccataacctgtaagccaacaaaccctttcttctcccaagtttggcaatattgggaaagcagcttaggacacatgcagctctcttgctgagtacaggattatgaatacaaagtctctctttgtttttctgaaaactattcattctatggaaacccgtggcgtggataccaggcagaggcacagcagttcattttttttccaattttttattagatattttcttcatttacatttcaaatgctatcccaagagtcccctataccctcccccaccctgctcccctatccacccactcccacttcctggttctggtgttcccctgtattgaggcatataaagtttgcaaggccaaggggcctctcttcccattgatggccaatcaggccatcttctgctacatatgcagctagagacacgagcactagaccactgggggcactggttagctcatattgttgttccacctatagggttgcagacccctttagttccttgggtgctttctctagctcctccattgggggccctgtgttccatccaacagatgactgtgagcatccacttctgtatttgccaggcactggtatatagcctcacatgagacagctatatcagggtcctttcagcaaaatcttcacagcagttcattttagtttcctatcccacagatgggagttttggggaattttattttaaaatatttttgatacccaggtgataggaacccagagaaaggaaagactgctatcaacttcctcatttataatcgaggagaagtggttggtccagtgtcagcgacagctttcccttttctttcatatgttatatttttaacttggtcacaggataccagtttctatacagcttttcatcacatctttattttagtgttttctctctctctctctctctctctctctctctctctctnnnnnnnnnnnnnnnnnnnnaatgctgggtaaccagctagctctacaacaataaatactgaactttcctcttttctcatttgaaatttctcttcttccctgtatagaaactgctttttttttttaaaaaaaaaaatcatgtgtataaagcagatgtgcagcttggtcttcgtgtggatcctgaacaactggaatgggggctatcccaaaagctgttgcctgtatgtggtataggttcttcgagctgggctgccttgtttggcctcaatgggagaggaagcacctggcctcacagagacttgaagtgccagggtggaagggcacccactcagaggagaaagggaaagggcagtgattgtggagggtgtgactgggagggggcagtgagtgcattacaaagtgaataagtacaactaaaaaatttaaaaggaaaagaaagaagaattcccaaagactaaaccaaaggacaacttcgattgcgtgtggtttaaagtcctgactgtcgggagtgtgggtgtgtggtaaggcttgggaaaggccttgggatggttttcatcacagttcctggagcctgggtctgtattctcctctgtaggtgagactcgtgtttggtgtcaagggctcttgcctttggagccttgatgtctatataaagacatttattagagcacacatttcatgcaaaggggtgaaaataaaagcatttatcaatgtcccaacttcataaaattttaaatgagcaatgaaagaacatgctatcatcacatctgctaagctgaatctttgtttaaaacctgtcatggtttttcttttcctacaacacatgatcctgggacctccctcataagatttgattccattgaaatatgtttctcggaggaaaaatcacctatgcgtcatatgtctgcagtcagctctaatggttaatgtgcaaccttccttgaaaaatctgttttacaagcaaaatgttgacacagttttaattatagcactcgagtgagcactgctgtgatttttaatactcctccatggtaacattgccgctgttctcatagacgaaactctgctctgacattctgtgctttccaatgctttggggttttatgggaactgccttctttcagttgaaattttttattgtgtcttaaagaaaagaatgtgatctcaaggtttggtgtatttatttattaatatacgcattgtctatgacagttattatttaatgtcaccatgtggacctttcatgagccaccttaaggaggggcttctttataagacagtatagcaagtttagatgcctgcttacttgtattgcagaaacttcccacattttttttttctgagacagggtttctctgtgtagccctggctgtcctggaactcactctgtagaccaggctggtctcgaactcagaaatctgcctgcctctgcctcccaagtgctgggattaaaagcatgtatcaccactgcctagctctttccacatttttaacctaaaactatattgatattaaactgatattacactggacattcatgttttccagaaatagagtcatgttaaaatggtatataagacaatgtgctttaacatagcaagaatcaatgaactctcttctgcgctcatgattaaaagagagagactacttgagagttcatctacacattgctgctcattatgtttaaatgtgctgatctgccttcctgctcactgcccacgtctaccctttaacatccctggctttttgggaggttcatggatgtcagctggttgattagttattgtgttcttcctcactgctctctgaagtggcacagaggtggtttatgacgctgttcaggctctgaggtgagagtaccctagtctgtctcaatgggaaggacatatcgtcacacgaacctttacagcatggctcctgatagaaaaaaaaaaggaaaaaggaaaaaggaaaaaggaaaggtcagcctgcatcctccccaaggctgaatacagccaagctaaggccagggcagaagagaagctgaacaccaaagcaacagtcactgcttacttggcactggctgtgagagagtatggttcccaatgaaaagaggatgtgtcatcaggaccaaacagctagcacttgaaaatgggttatatggtttcatcttgctccagggttaagatttgatcaacttgatcactcatcgcatgacaacctgcttttccatgtcttaaataacttttaaaatatgtattaattacattctcctccatacataatatattctgattatattacccttatctctcttcctctccattgatcttcctgctcttcctccaactagttcttctaggttcatgtcttcatgtcaagtgtgatccagtttgtttaattagggttccttgcatgactgtggatgaggagttatttacaggaatgtggcaacttacctacagtggctacactactgaaaacttcctccccaggagccattagaacacccccaccaagaactttctttttttttttttccattttttattaggtatttagctcatttacatttccaatgctataccaaaaagtcccccatacccacccacccccactcccctacacacccactccccctttttggccctggcgttcccctgtactggggcatacaaagtttacgtgtccaatgggcctctctttccagtgatggccgattaggccatcttttgatacatatgcagctagagtcaagagctccggggtactggttagttcataatgttgttccacctatagggttgcagatccctttagctccttgggttctttctctagctcctccattgggagccctgtgatccatccattagctgactgtgagcatccacttctgtgtttgctaggccccggcatagtctcagaagagatagctacatctgggtcctttcaataaaatcttgctagggtatgcaatggtgtcagcatttggatgctgattatggggtggatccctggatatggcagtctctacatggtccatcctttcatctcagctccaaactttgtctctgtaactccttccatgggtgttttgttcccaattctaaggagggggatagtgtccacacttcagtcttcattcttcttgagtttcatgtgtttagcaaattgtaccttatatcttgggaatcctaggtttggggctaatatccccaaagaactttcatttaagggagtgtgttccacatacctgtcctgtgtaaaggttcaactctgtgcaagaacacactgatgtatcttttggagttagagttcataattaatatattttctagatgtctgagactatgaatttgtgttggtttttattgctttggggtcaagttgtatagtgtgtataagtagagttagacttcaaaacatctgcttttttagatttgaaaacagcagttcccaactgtgtccaacatgaacagtaaaggacacagcctgagggcttgatgctacaattatatttgttcatgtgatataactctgagtgagtatgtgagtcaactacatgtgctttttttgttctgttttgtttttgttttgtttttgtttttgttttttgttccaaaacagggtttctctgtgtagccctggctacctggaactcactttgtagaccaggctggcctcgaactcagaaatccgcctgcctctgcctcccaagtgctgggattaaaggtatgcaccaccaccgcctggctacatgtgttattttaaaagaaaacatagagttcaaaattatgtgctactatatttagcactatgtgtatatgtattctatattatactccctaaagtagcactcaacagagaaatagtgaggaaaacagaaaaaagaatacatttccatttgtctttgacccccaattgagtttataaggaataacttggcattcataaattatatatatgtatgtacatatatgtgtgtttatatgtatatatgcatgtgtacatatttacatatatgtgtgtgtatatatatatatacacacacaaaatatatatatatttttttttttattaggtattttcctcatttacattttcaatgctatcccaaaggtcccccatacccacccccccaatcccctacccacccactccacctttttggccctggcgttcccctgtactggggcatataaagtttgcaagtccaatgggcctctctttgcagtgatggccgactaggccatcttttgatacatatgcagctaaagacaagagctcccgggtactggttagttcatattgttgttccacctatagggttgcagttccctttagctccttgggtaatttctctagctcctccattaggggccgtgtgacccatccaatagctgactgtgatcatccacttctgtgtttgctaggccccggcatagtctcacaagagacagctatatctgggtcctttcagcaaaatcttgctagtgtatgcaatggtgtcaacatttggaagctgattatgggatggatccctgcatatggcagtcactagatggtccatcctttcgtcacagctccaaattttgtctctgtaactccttctatgggtgttttctccccatttctaagaaagggtaaagtgtccacactttgatcttcgttcttcttaaatttcatgcgtttggcaagttgtatcttatatcttgggtatcctaagtttctgagctaatatccacttatcagtgagtacatattgtgcgagttcctttgtgattgggttacttcactcaggttgataccctccaggtccatccatttgcctaaattcattttttaaatagctgagtagtattccattgtgtaaatgtaccacattttctgtatccattcctctgttgaggggcatctgggttctttccagcttttggctattataaacaaggctgctatgaacatagtggagcatgtgttcttcttaccggttgggacatcttctggatatatgcccaggagaggtattgcgggatccccccggtagtactatgtccaatttttctgaggaaccgccagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaaagatttatttatttatatacataagtacactgtagctgtcttcagatacaccagaagagggcatcagatctcattacagatggttgtgagccaccatctgtaatggtgggaattgaactcagggtctctggaagagcagtcagtgctcttaaccactgaggcatctctccagcccacacacaaatttttttttcctgtaagaacattgaacaataaagacataaaacatgtcttatccctgagtgtgtgctctttacctgcaagacctttaattgatacctttaaatatatgttgtttattttttttaaagaactaatgatatttgctgaaaaatattgccaacttgttctggaacaaagtatagttattttacaagtatactttatttgtcttgtctggagagtttacagtcatttgaattacatattagagtaaatttgcttgggttctactttacagttattgatgagaaaataatgacaaattggtataatagggtgatacattgtataatttgaagagtgggtttctagttgcagtgattatgctaagtatttagatggcttgcattaaacaccagctaactgatctcaatttaatttatacttgtaaaattaagacactgaaaccagatggattttaaagtttatttttacctgaaagtttcatcatgaatttgaaagcttaaaagactacagtgtctattgctctgtcaagaacctcaaatatgagtgttcattatcaagcatgcaaggggaataacacggctttatacatccaaggtgagagcaacgcatgccacaatgtggagttttgagagcttgtagagaccttatagaaaagccatgaagatgagataatacaataacaatggaagcctgtggttgatggattaaattaataaacatgtaaaggaacaaagaactggtaatgcttaagaaaactaaaagaaacagactaagaacagctataaataaagttctgtccatgtggcaattattcatagcactatagtccaggcgctgtccttatcaaagatacgaggcggagactgactagctgaggtcggacttagcttcttgagacttgggaagggacagttccctgtggagttgtttgagctgaggtaggcagaaggcacacaggagaaagcccctgttgttcctggacataatggtgcacaataccagaagatgttggcaaaatcttgcctatatgtcaatttctaaaaactctttgtagtgagttcccaaactgaatctgtgatttcttttgtatatgttggctttctcaacaaaaagatgggagatacaacgatggtggtggtggtggtggtggtggtggtggtggtggtggtggtggtggtggtggtggtggtggtggtggtggtggtgtgagagagactctttactttcagatactaagatatactggtggttatagtggtaaggatgttggcaggatacaatgaataagagtagtgttctagcctcctatggggtatgcttcctaactgctgtgccatctggaaagccatcagtttccaggataacctttccgacatataatctataaaatatacagcacagctaagtgggttcttaaacactgttgtgcttcagggatgagcctgcttacaatggtctctcagctccctaagcaagggttaaaatacttctgccacagagggagcagtatgctcctgaggctcgcagcatagatgtagctttgtattggcctattgctttcaatcagtggttctcaaccttcctaacgctgcaaccccaaagggatacagttcctcatgttgtggtgaccccccaaccatggaatgattttattgcaactccataatggcaagtttactactgctatgaattgtaatgtaagtatctaatatggaggatatctgacatacaaccctaaaaaaagttgcggggggggcagggggggggaacgacctacaggttgagaatttctgctttaaattgtctttcctaggtctttcattatttggctaaccatgaatcattactggtctcagtggggttttctcctttacatttttgaatagatgataaagacagcagagtcacaattctgttttgaatatacagcagagtcacaattctgttttgaatatgaagcattctctgcagactcatgtttgaacactgtcaccagctggtcactccgatttaggaagctgcggaatctttagaggtggctctgctgacagaggcagttccctggcattagatttttgaagattatagtctttgtggcttctggtctcaatctcagttttctgattggcaatgaccttctgcttagcagcctcttgctcttgtcactattatagactttgtggcttctggtctcaatctcagccttctgattggcaatgaccttctgcctagcagcctcttgctcttgtcactacagaggatactgtttccccgctgagctttcctagtctccatggactgtaatcctctgagactgtgagccagagcacacctttcttcccttaagttgcttctgacaggcattttatgacagtgaaaagaacattacaggcacagtgacattggcctatgcagcatgtaggcagacacagcggcagtggtctgtgtggcacgtagggtttgtcagaaagttaaatgccagatctcaccactctgtgtaggaagacagaatctgtatttgaaccagaaaactggataactcatatgcaactgaggcttcaagttgacagcagaacagttattatatatttccttttgatctagataaacttatctagatcagacttgtatgttctgaaaatgccataaattgtaaaagtgtaaaaatgataactagaaacaaaaatgatctcaaaaccaagctattattcgttcacagactactttatagtattaacatgtagtattggggaaaaccatgcaaagactgcttcagaagatatgtaacatggcgtgggaagcgaaaggcactggccactagttggttcctaaaggcaaagcaaagctgagacttgtgtacctttcatgtcaatagtgacaccatgacctagaaagagaaagagaaactgtttgtagatgatgtggaagactgattatggcttaggaaaactgatttatggagagagaaagaaataacaaaacaggcagcaccaggctaggagagaggctttggggtgtttgcctcgtgccatttctctggagtccagtacaaagagaactggttggatgctcagaaactggttcatggcaaactcccatcaagtgcagctgctcacatggggagcagtggcagaggctgtgtcagaaaacttaacatggtgcctaagaagcaacctttggtgggataacgtttatttctgagaacttcagaaggctttgtgagcaactaccaaaaagccattgattacgttactgagttatcaccatgttggaataattggaggccctgtctctcaaaacttctaaaactgagatggaaaggacataggatgctctgtgtgagagcgctctacatgctggcagagaatgggtattactgccagggttcccatacaaaggtgtgttcactgctcttggctcatgtgttagcaaaataaaagtgcactcttctaaaagagtcatctacagattgtcattcgctggtacctcgtagagttcatttaatttaatttaattactcagtagttaatgaagagaggggctcactgcatagcagaggtagcctctcttcctccacttatttcttccaggtggatgcagaagccttgggcatctggaaccatccactgccttagagaacctagtcgtgatttcttataccagtttaagatcagcttatttcaccatgcagcaatggtctgagggtggcacacctcctcctttgtcttcctagagattaaacaacaacatctaaacagggagaaactgaaccacagttccataagacgaaaagcaataagcagttagttacatccagcattcaaatccattattttcccctgccaagtcctttagttccactttagtactttctaggagacttggtttcatttgaatacttctaggaattattaatgtcagacatgtcaactgatccactccatatactagttgatgtcagtatggagaatggtttaacaaactcaaatatcaagtcatattaattgggaagttaacattgcattctgcataatacaaaataaatgattccatccactgtttgtggatatggttcttaaccaactgctagcatctcaccttgcaactaacaactgtgtgcaaggtcaaaagttggaggaagggaaagattatataagtttcattgctacttgatctattctagcttcctcctggttgctctacctaccacacgtgtagaagggggccttttcttttttgtaaatcactcagctagtggcatattgattttctctcaagagcaccctgtgttctcaggtgatcacatgttttctcacattattcatattgacagagcacctttgttcctggttgacatacattattgagctatgatggcattacccaccatgggctttccccagcggtcaggtgataggccttcagtgcaggagatggaaggggacaggctgtttcacagtatttctgttctttgaaaagcaattattgttcatctgaaaagatgtcataagctctgagagcactgcttagcaggcttcctcactccaacagcaatgccttgaggtcccctgtgtcgctgctggtacagaggaaaaacctgggcaccaaaatattccatgcgctatacaggagaaatgttgttgctatctgaaagaataaaggtggcttgccgtgtgtggttgctgttctcacctcacctccttctgtttcagctagctgtgaggtggctggaacacaattgccattaccagcatctggacgagctcctgcagtacatccgctttggcctaatggatgtggatacactccacacggttgccctatcccaccccctggtgcaggcaagtgagacggcaactgcccttgtcaacgaggccctggaataccaccaaagcatctatgcacagcctgtgtggcagacccgccggacaaaaccgcgattccagtccgatactctctatattattggtgggaagaagcgtgaggtctgcaaagtcaaggaacttcgttacttcaatcctgtggaccaggagaatgccctcatagccgccattgccaactggagtgagctggctcccatgccggtgggaaggagccatcactgtgtggcagtcatgggggacttcctatttgtagcaggaggagaagtggaacatgccagtggccggacatgtgccgtgaggacagcctgtcgctatgacccccgcagtaattcctgggcagagatagcacccatgaaaaactgccgggaacattttgtgctgggtgccatggatgaatacctctatgcagtagggggcagaaatgaactgcgccaagttctacctacagttgaacgatactgccccaagaagaacaaatggacttttgtgcagtcctttgacagatccctctcgtgtcacgctggatatgtggctgatggtcttctttggatatcaggtagagcgcgcctcctatgttggatttactgaaaaatacttttctgtggcttaaatttaaaagtcaccttctggagagtggccctaagtagttgaacagttgagccaaggatgccattttttagctaattaagtatcatttattgagcatctactctatagagagccatgacattggaaataattgaccttcctgtgattttctgagtggtcactgttgtaaaaattcaggatgaaaattactgggccatcacacctgttttcctgccgagccttgtattgctcgctctctgtcagctcttgatgaactgtggggggacatccacgaccactgttttagccaagtcctttgctttcactcttggctgcccagctcagagccatttcttcagaggcaggagaaatggaatcctagtaaatccatttggctgagtataataagagactctcttccagggctcagctgtgctgtctattggagaaagggattaaaagcttttgtgttttctgtgagtggtagttcctggtgccatccattcctgcatactctcccattcttcctgaccatctgtaggaagtttaaaggctgtttccattttctcttttcacttatgtttaaacaaacatcttttgctgatggaaaaactaaggaaactagtgaacaggctatacggtaacatagcttcaagcaggcgttgctcatctttctccaccctggctttctttagcccctcctagctgccatgttgttgtacagaagtctatgaggcatgcgccatcagtctcacaacaccaacctgtgttttcaggggcaaaagctacttcatctctcagttggaggatagccattttgtaacccaaatagaagctgggtttctgcatcaccaggaacacatagataacacaaagatccctcagttagatagtggaaggcaaccctgatgctcagacttagacgaagtaaccacattaggaactgaaggcctctgggatttccccagttgacattccagtgtttaaaatgtcaatttttgacaaaaattatccctagattaaattagttttggctctgttcatttttccttctactatcttcaataacccaggagacagagcctcagcttctctggttgaagttattttcattgatgtaacctaccttatattggaatttaagtagttgatgaattaatcacatgaaggaaagactaagtatgtgatgaggataaatgagaacccaatatttactggtccaatataccaaataaaaacattagaaattagtgtatatgtagaaacacttgaataaaattcttatttattggtagttctttcctctcctttaaatatgtattttaactattatggttggttttgatgaagaagtttccaaatggccgtgactgagacttcattaataacaggaggtctggattttcctgaacacagagcagtgatgagtttatgaaaccaatgaagtttttattttctcacaatttacatttctttgactcatttgggttcacatgttgctaatgcagtatactcttaaaatttgcaatgtgctttctaaattttgcatgaatttcacataaatattttaataagtgtgtctagtttggcacagcgaaatataacttttttcattaatttatttatttattcatgttatatccccatatcatcccccatcctcccagttcttctccatatccttgatttcctccacttagtcataaagctgtgactactctccacccctttcagtgatgcttaaggaggtagacgttcagaaacctggccaggcctaccatcctgggatcaagtgtcttccctttcaataagggtcaatgtttcctctttccaatttcttacatctatcaacttactgtatatattattatcacctcactttgctttcctcctactgtgaaaggaacatgtttcctttgttccttgaactaacgaacactgtctgtgttaaccgtatttaatgaaaacaatcagaactttctcaggcttccttctccctactgtgcacttgagatgagacgctcacttccctgtgtagactatgagacatttaattggcaacaagaggaaatcaccagtgacatttctaatacctgtggtcgtctgcctctttcctcggacctaacttataataaatcaattgcgaatgtagccatgagtggagcaggctggctgtgtttgctcctgggcccctttaaaaggagacaagattccatctttctgtctctgatttggaagtggtagcttggtttactggaacagatgaaagtgcgtgaagctagttgttcttaacgttgaccaaataatcaagtatttccagttgacagaggagggttgagtcattgccatcctcccggtactttgcaagctttatcaggggtaggggtggtgtggattaataagcgtgtggactggagaggcttagttcccttccatagaatgcagaatgaatgtgtcttcagagacttggtatttgtactgtgctcattcctgctttgtgccccatcctgttctgtccttttggggtcaaggcattttgcaaacttcacgacttctcaggatgagaaccagagaattcagaaagctaagttggatggctatgcctgttagcatttaatttaaggtgttagagacagtcaaattttaaaggcttctgtagcatttgacactgtacccggtgcacaagtgctcaatcacattttgggttgaaatccacatttctgaagtgaaagaagcagtaaatctcctgtagctgagtttttaaatacacgctctctgttgtatcggatggcatgtggaccactgaaaaggttcttgtgtgtttgtatgaaggaaaattcatctgagcccatcgtgcagaacttacctgtctctctcagatggcagcaaaagagtgagatgctaaccatgacactggtgcttaaaaccagaaaacaagacaaacggcgcagtagttactcagaagcctcatgtcatatttccttgatttttcttagtaaacgctgaatccctctaaactatggtgctgtgccatagataaatatgattaattcagtaaacacacctcctgccctctagaagctgacaaagttttttacttttatttttattttttttttagatatgtcactaatgaaattacctatgttaacccttctttaatttcctagcaactatgtttattttcatcttagctggatttaggtgaagcttctgttgccccattttagatcactttaacgcactcaatctactgaaagaactttaggttttctactattcttctaaaattaaaactcggtcattttttttttttcatgaaaatacattttcttaaaaaagctttcaggtattacacacaaaagcaaacaagtttacctcaaaaatatcaatgatcacatcaatagcctactcctaattataattacttcttcaggcaacatttgtctttgtttccaaatacagcagcaggtgacaaaacctagtatcttccattgcttacagtataaacatacatgtctcaaaccacacttcaggcagcttaacttaaaatgcatagactgtaaaacacatcaaatttgacattattcaataagtgaaaaaaatcataatctcaaaaaagtattacaaaacctcttacagagaacatataaaaagtagtgtccacttcatgaggtcagtgtcaaccagtggcagctgggcctttacccagacaaacggaaacaatcctgctacactgtacacttgaatagttgcactgataaacactacaatcttggaatgatggttttgtgagacttcatttccatgtataaccctggttgccctgtaattctctgtagaccaagctgtccttgagcttaagagatctgactgcctctgcctcccaagtgctgggatatcaacggcatgcaacaccacatgtggctcatgaaagatattcatttacatatatacacacacacaaccagtttattaagccagccacatgcctttaatctcagaatttgggagacagagacagaaacagaaagttttttgtgagttcttcaactatataaagagcttcaggttagccagagttatgtggcgagaccccacctcaaaaaaaaaaaaaaaaaaaaaccaaaccaaaatgccattttttaaaatgcccaggacagcctgctctcctctctgagagctatcactaatccccttcctctggtggctgcacctgtggccccaccgggaagctccttaagcacagggaccagagctccatcccggatgtgcacacggacagcatcagtcttcagatgggctctgcagatagaagcaagcaggaaatctcagtcccaattgccatcgtccactgtagtttccattggcagaattctgaaagttccatcagtttccccccagagcatccactgttctccagcagctggttcagttaggcgcccgcttcactaaacgctggaaggattcaaaggcccgtgaaacttgcagtttataatcttggcattttgaggaatacgtggcaccagttgataagtgtaggcaaccactgatactgaggcagtatcttaccagaaacagagtggggctatctctaatccacagtttccaaaagctgtctaggggaggccacccgtgaagtgtgtcatgagaaacagactgttaaccaccactgacagcaaaaccaacaaggtcgggagggaggctttgtaaagaacggaacattacaaaaccaaagacttcaacttcacaaaaactatccttgtacacatctcaactatctttattgtacttatttaagaattattgtgaggacatgtcaacaaattctataattgactcctttaagaccaaacacttactgacaatctgtcttttcagtagaccagtcatggcctacactgtttgttctgaaagcaggattattcttgggttaaaacaaaacagaaaatcctttccagataattttcctcatttggctactggttatttattttatttttgcttttcttgattctttcctgaacccagaaacaccctacccttaaggcaacaagagacatattctgaaaacaaataaaaaaacaagaaaacctgctatccctttgatttccactcttatattaaataatgataaacccagtaactcccaattattcagttgtaaagtcctaaaaaaccagggtttaatggaagtaccattgagagcacaccacacagggtgggctgttaagttccactaacaagaacaccaatgaccctacaaagaacaacaaaaccccacactggctgatgaacttggcaactgataattattggcttagagttatgtaggtaggcagggcagtgacaatatgttccagggctccaatactcaggctggcaggtcaggctccatatccaagaagctcccagggggagaaccagcaatctttgtggagtccaaaagaagttgttacttcagcaaagcctaataggatggcatccaatagagaaaccaatggaagaacctcaaacatactctagaggacaaatcctcgggcgtaaaaggagttcctctacctaaggctggggcctctttttatcttttagtgacatacttgtattactaagtttaatttaaccattatacctagttctgccaaaataacaaaatgtttctctcaaaatggcactgagctctgaggacaggtttcttgctgagagctccagaaaaaaaaaagctggcatcgaatgcactcgagccaagttcccggcttaattaggaaggtgtctttataagtctgttttaacccacgtggtgggaaggccagcgatatttttgggtcagcagttactgcccccatagctctgcactcccaaacaagctcaagagtcacgctttgctgtgagggtgaagactctagatctgaccggaagctggaaaccctcaggcccagactggcggggtgagaagggaagatgcaagaagcagactacaccaaaatgccaaactcggtcatttttaagtaatgctgttcaaataccacagctttggttttcctctatctgcacagatattattgtgtctgcatttaaaatattgggacctaagggcaggcatggttgcagttggggcatgactccttaagatgatagagtacagttattcacaactgtgagactccccccacttcttatcagttgagaggtgctgagcagggttcctggcttctcggagtcctgttctggtctcgtgctggagcagcagggttgggtacagtaggcagttgcagtgtgtgatggtgtggtgccgggagtccttctagggtacagaagtaatgtgaacaacaggaaataattttcaaggtgccatgcaaaggggcatcttgggcccaactggcgccacctcctctggctgctttctgtcatccacttgcctccctgactctccacttgagtatcattgtataatcagttcagtaatgtccttatagtttaggaagcagtgttggacatgcctagctttctacttttcttgtgtggttgcccttcaataagcgcgcgcacgcacacacactcacacacacacacacacacacacacacacacacacacacacacacacatgcacacacacacacatgcagttacacggttgctagaaaagccctccagtgggagacgggaaggttgcaggaggaatgggaagggagagatgatttaattatattataacctcaaaaagtaaaagaacaaacgggaggttgacatcccgcacatgctcaagctccttagtgaaaagggcagagaatttgcacagagcttgttgtcctgtatactgcagtgtagatattatgtatactgaaaagacaacaatgacacagaaatctgtatgggtttggttccagcaggtttttgtttgtttgttgtcaattatttttcaagccgtgttgaatctgcagatgcaaaaaaccctgcaccctgcacacaacagactgacagtttccaggcagctgagactattggacagttaccaggaagacctggtggggcatcttctcagttttccaggcacatgacagttctcagtattctgttccctactgacagtctttcctactctgcttcactgttgttaaactgcctccgttccttaagacccctccctctgacttagaggaccttgccttctgttttccatggttaatgcagagggaaggagaaatactgcgagcagacagatgggccgatgagcaaggcatggtctgggtagggaccaaaggcatcatctaggaaacactagcaaggaggatgctgggccagccgtctggaagaagcctctggagttgcacagggtccgtgatggagaggagttttcgatgagtgagatttgtctggtactacagtccaaaatatttgccctccatttttcaactacaaacatttcagtggaaaggatttctgatgaatggaatatggagagaaggagagagctatagttaaggtgtaatgagaaagtaagggtctagaactacaggtacaaactacaccggccgctcgactgggattcccatggaatcacatcattgaaatttcatccctgagtcagagctcatcagataatgttccagttattgtctgccttcccccgtacacctacctatgggaagagattgtgcagttgctggggcatacataattcagtccttgtgacagcaacatttttttttcttttattataaattgcttttgactttaagaagggaaaaggagattaaaagaataaaaaagaaagcaaagagaaatttacctgagaaaagagagtgtagttagcgaagaaaacccagatcaatagagggaattttctctttaaaaggatgcaagtgcgttgagtaacttgtaaggagagatgcaggaaatagagacttctatttggttagtaaactctgagagcaattccagtaccagggatgagagttaattctgggcactgatgacagatcatagagtcctgaacaggtaggagggacgagactgtgaagaaagagattctcgaacactaaacccaaaaagggaaatgtgggtatgggtgtgggtaccagtgcacatgatagctatggatctaggtaccgcttcagagaggaggggtgtaggtctgggtaccagtggtgaggagcagaagccaggagtttccttgttgatagattcaggtgagatcttgatgagtttctgctgggatgatattttctccaagatgaggcagtgggcctgaggaaagggtggtaggaaaagcctcggagagaacagggaactgataggttttttaaaagtacgttttcagaacctataccaagttggaaagctttttgtcatcttttggtagtgtgaacagagaactggaaaaggcatactttggattaatagatgataaaaggtttctacattagaaatagcccagaggctctggcaggaagatatttagcagccagtactgcagctagtctagtcagggccagggattattgccctggaggcatctctcactagggagccacacaggttggagcttcataacttgaatgtcagcttcaaagtttccagtgaactggaatagccaaaacatatgaaatctgtgttgtcttagaannnnnnnnnnnnnnnnnnnnttcctcttttgcttctactcaaacccccaccttaaacctcaccccccctccccacacacagaggcacacacctcaaatctgcaccatctgaaacaaatcaaaacaaactttgctactgagctgagagggaagccacgcggaaatgagttatccacgatgcttttaagagaactaagtggtttgaaggaagaaaaacattcagacctacgccctgaaaaccagtgaaagctttaatccccacctcacttagctgggccctgaagatcattttgtttatcttcctgttgctgtccaagaaattaagcataaagaggtccattaacttccaggtccaagggctaatatttgacaggatttgaattctatttctggtctaaaaaaatagggcttttccactaaaccatacagccactagtttttgttgtagtggttggtttgtttgttttgatcacttttagcaaaggtctgagaagcacacacttaaattgtgactagaacgtattcatgacataactctcaaagtaaatgatacacggaaaaaagatcaggccctggtattggttgttgttcattgagaatgaacaatacttgattatcttcgggtgctcaagtgtctcctttttccagagcacagaattaaaacagagagttcttctgtggtcctgtcattcacttttgagaacataaacaacatcctgatgttaaagtgtgaaacataatttagcgacacacagcactacatggcaaaatacggtagcctgggtaagagacttgctcttcattttttactatagcagtctaactgcctttaatatcagttgtctaaaattatccttgtaagttgaaaacgccagactttttctcctagaaagaatagcttttgacttgaaaaactcttgcatctctaccacagaggaagctgagcagcatcactcatctatgaacaagagagatgtaggatgcttaaagctacatcatagcaagtgctgaagaagctggctgatgggcagggggcaattaaaggtccagtaagaagccagcaaaagcactggagattgctgcacagaggctgggacttgagaatggaccctccacccccaccccctaccccgaccgtgagcagaggttttggaggcaggattctgactctcaacagagtgagtgctgccagttacagtggatatttgatgagattttaaacggcaggtccccctagtttacagagcactttgttagatttcacttatttaaaacaacatatggtacactctttacctctttctgggttgtaaatgtgtgcttattcattctagatagcataaacatcatttacatgttcaacagcagtgctcttttatagatactttgacactccttttttacaagttttagtttattaattacacgtccatttgtgggagcctcctaagtgtgaccgaaatcatagggatactagttttaatttaatacactgttaactattcaacatgttaatttagcataaagattcctggttataattgtttatatagccttataagcatcataaaatatggagcattttatcacttataaaaatagataataaaatatattgtttgggctgagtatggtgtctatagtcccaacacttgcacaaagcaggatggtcttgaaggagttcaaggccaatcacagctccatagtatgctctaggctagccttggctacagaataaaaccttgtttcaaactaaaagtatagatgtgaacacagtgtatctattctcattgtgccacttgtctcagaggataatagggagcttaattctattaaaatgattaataggcgctcatacttaatgttgccactttaggggtaattaaagtatgagtatgaaattggaattcgtttaaataagaggaaaccgaaagcattaaagaagaaaaaaggccaagtacagtggccaagtattctacttgtaaaaaaacaaaaaaacaaaaaacaagaaacaaaaaacaatcgagcctcagtgggtaaaatacttgagagaattccattcttagaatccaagtaaaaataaaccaggtctgggttcagatactctgtcgtcccagtgttgggaagtgacaggaaggcaagcagatcctggtgtttgctagcaagtcagccccttgtctacttgtgctccaagtcattaagagaatctgtcacaaaaagaaaagaaaaggaagagaagggaagggaggggaagggaagggaagggaagggaagggaagggaagggaagggaagggaagggaagggaagggaaaaaaaagaaagaaagaaagaaagaaagaaagaaagaaagaagaaaggaaaaagaaagaagagaacagaaagaagaaagagtaaaaaccagtggatcatgttctctgccttctctcttccacactcacatgcaaccataccttcacgcacaaacatacacttatggacctggagggcatcatcctgagtgaggtagcccaatcacaaaggaactcgcacaatatgtactcactgataagtggatattagcccagaaacttaggatacccaagatataagatacaatttgctaaacgaatgaaattcaagaagaacgaagaccaaagtgtgaacactttgccccttcttagaaatgggaacaaaacacccatggaaggagttacagagacaaaatttggagctgtgacgaaaggatggaccatctagtgattgccatatgcagggatccatcccataatcagcttccaaacgctgacaccactgcatacactagcaagattttgctgaaaggacccagatatagctgtctcttgtgagactgtgccggggcctagcaaacacagaagtagatgatcacagtcagctaatggatggatcacagggctcccaatggaggaggagctagagaaagtacccaaggagctaaagggaactgcaaccctataggtggaacaacaatatgaactaaccagtacaccggagctcttgtctctagctgcatatgtatcaaaagatggcctagtcggccatcactgcaaagagaggcccattggacttgcaaactttatatgccccagtacaggggaacgccagggccaaaaagggggagtgggtgggtaggggattggaagaataaacaagcaagcaggcaggcaggcaggcaggcagacagctgtccttttaatgtaaacattgctttcctaaggaaggatgcagtnnnnnnnnnnnnnnnnnnnnattgaaaatgtaaacgaggaaaatacctaattaaaaaaaaaaaagaaagaagacaaagatgctacaggaaatcaaattcaactggcaaaatgtatttaataattcaatgtcctttgcaggaaaatggtaagaagtcttgataaaatgactacagaattgtagcaaatggccgcttctgaactgcttgtatactctgagtatgagtcatctaagcctctgagggagaccagaatcttcattttgctcatgaggatcttgaggctggctgtggtacccaactccccaaagacagaatcacgctcctgttcttgttacccttcccctcaacagagtctcggggagcgttgtgagcacgtaagagggtcagaaacctcacgctagctcccctcagtcctcaatttgcaggcagaattttccatctttggaggacagagaggctcagctctttgcatattgtcctcagttgtgcccttgctttgtctgtggcagaaatcccaggcctctccttctagaatgaaagcgtaggactctctagtgaccgaagagctacttcttggtttggcggagttgcagagtggtggagtgcggaaacgacaaaaaaaatagcaaggcctgtcagatgactcattcagttggtaagggtgcctgacaatgcctagaggcagaagtgtggtcagtggacccttatatggtggaaacaaagaacctactacagcagactgtcccctgacctccaaatgcacactctagcatgcatgcaatcctcaccaatcaaccaataagtaaatgtcgttttaaaaagagaaagatagcatcagactaggaccgaagcacgagcccagcttttctaacccactgcttcgtagatgccccgcacacggtgtgagcgcttagcatttcttggtagcggacacaaaggctgtttggcagtcacttgtcatccatcctttctggtatgcattcatccatttgacacaagttttgcggcgagctgtacagggaagcttaagaaaaatgcttttgccttgtcttgatgataaaatgggtttctcactcatggtagcatggtggtaacttctaatccctcctggcagtttttaaagacttatttgacattgggcagggggagcgcggaggacctgcagtatatctttaaggtgcagttcaaaagtaaaagacaaggttgctcattttcaattttggctgagaagccttaactttgactgtgacacttcaaagttagagaaaacttggtcttgaaaaaatggaggctgatatgagatggcatatttaatgacatctgtatctatagaaagctgttaagatgcagattatcccgcctggggtgggggggggagatcaaactgccaatctataaaatatactcgataggagaaggaaaggaatctatctgtgcgagtgctttgattgcaggggacagaacagcagcatgtggcatcataacctagagcagacaaatcagcttgatgactgtcaaagccaggaatactgctgcaggcaagggtactccagagtaggagaaattaaaacatatagagactgttattaatttcatatctatttttgtatagtcaaatctgtatgcaaatcctagcatctcatttcagcagattaatctaaagtgaagagtggtatgtgaagcgaatgtaatgatgaagctctttggaataaatgtgggttgaaaacttggatgcttcctgtaaaatttatttattttttttatactgtgaagaaatggatttgtttatatgctcatttgtaaattacttcaaaaggaaaagcaatagaggcaattccccagtttccctttgcaatcccgacttggcaaaagctacagccctgggtttggcaggcgcctcctgtgtcttcccattctcgaggtaatcatgccgataactaactgggactttcatttttattcccaactagtgatccaatatctcatttctgaacagtatcatatgagggaaaatttttgtgcaatgctaaggaatctaattattgagtgcagattaataaaaatcatattatggatgcatctgtggtagtgaataaataacatctgaacaataattctgaagagcacggtgatcagttgtataccccatgtagcagagggggtgtgggagccacactgtaattcactgactgtatatttagtacacagtgcaataaatatgctccatattgccatagagtagtttaccgcaatagaccttattcctaaattaggtagagatgcttttagagtttcacagtaagaactgggagcctggcctctgttttctttcagttggggaaatgatcagaggtgacctggacatcaatctggtgattatggccccgaatacaagggctggcattctttctaacctgcagcacatgtgtggtctcaatagattcatgtattcttacgtggttatgccaagagagagttcttcaaccttctgtttttaatcagacaggaagcaagtatcaggggtaaaggaaatacagctcttcttttgattctatgttgggatttcaacttcaggtttcttaaatgtgatttcttttccttttcctcctttttagaaatgagacaatacatccaaagaatgctttctttaaaaaaaaacagcaatcttcttcctttctgctctctgtagatgaagcttttgttaattgtaagagtggcatcttactttgtataaataatacatactttaaagggtgattgaaagctatagaattacatttaacaaaaggaatctgcagttaatactagcaaccgttaattacttggcggattcagtctctttaccagagtttaggaaaatgattggcctggacacgtacccatctctttatgtatctaatagtattggtagtcattgcttaatctaagttagcttaaaattacatattcatcttctggattccgattcgcttaactcttgatgctggagttgatggtaaagacctaggcagggtttagtactgtccgagcaaccaaagtgctgggtgacggaagacagtcaaggaaaacagagatggaaaatgagtttgtaatcaactctatggaaacatgaggttttcttcggcaccagagcgaggaaaagaactttggaggaaggctgctcagtcgttcctcagactgcaacctttgcctctgtaattaggtcatgtgaacttgctggtgggtgcttatcaaaggtagactcatcccctcttctaaaaactgggggaaaggaccttttccttgatgatgatatttcaaagagatttaggtccttcaaaaagatattcttgtttcctaaaagtggcaagtgtcttaaactaattgacatttcaaagagacagagaaagacattgcagttatgcctaatctaaagtaaatgaattttaacaagcaaggtcagggtcttagcatcagaaagcagcctaggctaagggaatgctaaagccttgtggtcagtcttatagctatatatcttcaaaattagcagggaagccctatagaaacattttttacactttatcaaattttgaatccatatataagaatcaactttcttatacttgttaagaatattctcttatactatctgcagctacttatgggtggtatttgtaaagatggatattgtatctccacattttcactgttaagagtaaaagttatactagaattgaaaatgtcttgatcatacagagcttagtgtatatcacaaacatgaaaagaagcatgtctgaattaaataccctttatcccaaatgctcggcactagaagttttcaggcatattcagatttccagatagttgtatattatgatcagatgtcttagggagggcaaccatttctaaacacgaaattcatttactttgatacacaaaatctgaagataattttatatacaatttttagtgtttctgtgtatttactgtggcacctcacttgaggccagatgtgagatcatctacttgtgctatcatgtctgcgttcaaaaagtttcagattttgaactgtgttctacttatgcaggaaaagaaaataggaaaaagtcagtttaaagtattgacttttgtggtttctacttaaatagaaagtctgaagtctcttaggaattagccctgtaaaagaggatgtgtaacacattttgaagtcattgcactggaaacctttagagcatgctgtcccatttggtaaccgacagtcttcaggttcgcttgtcacagtaaaggcttggaatgtggcttatctgtcctgtatcaaatgtaccctggactttggagattttttaggaaatgaaatgctcagcaaattttatatggatttcatattaagataatattttcatcaagtagaagtaagtaaaatgcattattaaatatcatttctctgtttttactttctaatgtgtcacattcatggatattgttattctctcctagataccatttaccccatcttttgatagataatgacttttgctgtatgtatttttccaaagaaatagcaaactgtcaccttgctaatgcacagagcttagagctctagcactgccaccttagctaaggacagggacgtgttgtctgtgtgtgctgtgttcaccccagagcctatcctttatccagccatgcagaacaccttgctagaattcgaggcctctggcaccctcagtatacccattgcttactcccaagtggcttgctatggaagtgcttgggacgaagaatcagcttaaacaatacatttcttaattgtgtcatgggttcgccttgagagcagacgctcagctgtctctcactgtccttttaattgtagcttactcttcttttggaggatcctgtttcttgttcgtggaaagctctaaaatgtgctcctctgttacaggtggggtgacaaacaccgcacagtatcagaacagactgatggtatatgaacctaaccaggtaaggcgttcctaagaattcattaccgtaattaaaatgcgttttaaagatctccacaggaactgttcatcagagtgccactgtatgcaccttcagctacctgggggaaagaaagcattttgcggggaaagccttcagttcctcattggtattgcacagcttcggcccctctagtttcatgctacatgtaatgccacagagctttgcatatggtagagaggattttgattgtagcgatgaccttctgtaagggatgccatttggggtgggagacatccctatgaccttgttagtctcaaatcaaataatgccatttgacttaatacagccaatggtgtcctatgtctaggacaaacacaaatggtatgtgtatgaaagtctgggaatggtgtgcctctaacagctgggtcctttctgtgtccttttgatgaagatttaatttcccttttcccctcgaagaagaaatgcttttattttcttttccttctgtccaaatatctacaaacaatgcaaatgtctgctgtatgttgtcaccctttccatgacttggattgtgacagtattccaccatggcgtgacctgtttgattgtgacagtattccaccatggcgtgacctgcaggtttactgtccattagtgcaatattaggatttgaaacaacaggttgcctttggcaggttgcatctgggctgggtaccacaagtatgtgcacagtgtttccagtgtttctgctgtgtgtgtgtgtgtgtgtgtgtgtgtgtgtgtgtgtgtgtgtgtgtgtgtgtgtgtgtgtgttttaacaatgacttaactgaggaaggcatttctccttttataagtgtgtctcctgatattattaggagccatagattgcagagattggatgttcatgggtcagctgtctcatgagagatcactaattgcagaagcctgagttcggtgcacacatggttaaggaggaagactgcattaacactggtgaaatgagttctgtttcatgtttgtacacacatgctctttttaaagaattctgctggcatattgtttacggtggatactggcaaacatcacatctgcttgcatcttgctcagaatctcaataactctatcattcagccctgatgcttatttctcttctaggcctttgtggagagtcgataatgcctgccatctgccacagagcacatcgctacctgccaacaggcaggctggggtgacctctgcttccccactgctgattagtattcacacgctagcttattaggaatgaccccaccaggcctctcgccttctttgcctttgcagcgggtggcggctcacctggcaggcactgcagtgaaggaagctaaagatataatcaggggatgtaggcaggctttgcaaaccagatggcatctacagtcttgtggcaggagactggactgctaatgcaaacactgactcctaagactgttataggttagtgcaaccaagataagcatcgtcactcaagcataatgcattaaagatatttctgagcaaaatgtttgaaatctagctttgactatttattaaagactgtattttattgaggaaattctatgttcagaggaaccagacagtagaagcctctcaaactaacaacttctttttgtctgcagtttactctgagaaattagaaatgagctaaaaatatatgcctatagcaaataaatgccacagtatgtgtgcctatagtgaataagggacacactatatgtgccaatagagaataaatggcacacgtctatagtgtaaaagtgcttaagtgtttgtgcctagagagaataaatgccacactatgtgtgtccatagtaaataaatgccacactgtgtggttatagtgaataaatgccatagtatgtgtggctatagtgaataaatgccacattacatgtgcccacagggaataaatgtcacactctatatccctatcgtgataagctcctgtactcctgtactcattgtatgccaatgtttatacaagcatgtctgtgctcatagcctgctttttctttgcagctttgtgaactggtgaaattctatgcatacaaaacatcgtatgatttttctggttcaagtccaattttgtcttggcaaaaagcaaatgaggttctccctatatgctgagtgtttatgagaaaggaagtggttaagtttacttactgatctattgcttggtttacttgtctgtcaattagtgagttgggatttaaatttcaagccatggttgactttcatataattttaaaagttgcatggcattttaaattggaatcttatgttaaaaggggctgatcatagctttcttattattaaggatgatctagagtcaaatattaaatatttctccattctttggcattatcatataaagcttggccttctaccaatataaataaatatgtctaacctaattgccttatttggcaaaaggcataattgtaaatatgttaagatatgagaggattcagatgcagaggaatcagtaagtttgttactgagccaagttttagcttgtcctctgacctcaggtcaattttcaaaagaatgggggtgtagtcttcaccttaactcctgtgggaccttcatacttgatgtttatatgcctccccccaaatcctgcagggcctcactatgtagccctgtctaaccagaaattcagtacatagatgagattgctttgaactcacagagatctggtagcctctgcttcctgagtgctagactttttgcaccaccactcctggccctaattcctgtatttttaagacagaggccatgcactggacacttattacatgtgaggcattttctaagtcaggacgggctctcatgtaagttttattatttcaattgtaaagccaaggggataagcatggggaggggggtgtcagtaaattgcttaaaattgcccatgaattatggcttagtagtcaccatctagatggttttaattattacactctcttctatactgtcctgaccatgtgcttaagcctaagtcatctcaatgagctaagcatcatgaaattttataatcgcattataagatgtaaaatgccttataaaatgcaaacctaccaaaaaattttaatgtaagctccaagctaggattatatcagcttttttttcttgtttttacatacagaacccatacattttaacacataaataatatgcaaacaagatgcggttgattctagggttcatactgctagcgaggcaccgctgcccttggtatttgtgaggtctctttaacacaatgcactcgattttttttttttttcagaataagtggataagtcgcagccccatgctacagagaagagtctaccactccatggctgctgtccaaaggaagctttatgtgcttggaggcaatgacctggattacaataatgaccggattctcgtgcgtcatatagattcttacaacattgacactgatcagtggacgcgctgtaatttcaacttgttgactggcaagtatctctgataagcaaattcaaaacaaaaggaggagctggagagatggctaagtagttcagagtactagctagtcttctacagggagcacatttgacacccaccaccctgttaacatcctacaactatctgtaattccagatccaggggagctttaggcccccttttgtcccccataagtaccaggaacacatatagcaagcatacaggtatacacacagataaaacacacatacagataaaacacaaaatgtttttgaaatgtctaaagataaaaacaaaagcataaatagagatttaatagagaatcaagattcaagacatccccaaacttgtttcatggacagccaaagtacaaccctaaatattatgtgaacaatgcatagcacaaattgttttctttaccctggaagacatgcgtgatttttagctaaaggcagggcttgttcaggtggctgggagtctagtttctaccttgcctctgtgtaggttctcaaaggaccaagagaagcatagcatctcactttcccttagtggatactcaaacgagaactttgacacctgtacaaagaaaacagcccctaacgagctaatggtgtattttctgttttaaaaagtcagggtctcatatacatcagaatggcttgaaacaccttctgaccctcctcccacttgccttcttctaggattacagttgagcgtcactacatccaattgtatatcgtcctggcatctgatcatgctaagcaatcactctaccaactgagccacatgcccagagacaggaagaaacatttgttccacttctcattgcttaattcttgttgttttgttttttttttttaatttcttgggatttcaggagaatggtggtcttccttatttctcacccctgtatgttgtttccttgtgtagtctagaaattaaactttacagctgctctgtgcataagagctgcgtttctggccactcatccagacccatgtacttctgcagagcaatcacagatgtgtccctgacaaatgacagaagggagtggagtgactgtagtaataatgtacttatcctgacactctagatggagctgaaaactgtctctcttatcagctcctatggctaacatccaccaatggtaggatcccttgccaggctgttttaagtcagtggaaaaatcacaaactgtacatggtgggctagagtagttctggaagacatttaacacacagagtgagcattcagtccctcactgtggtctgtgctgctggacagccacacgaggaacacaaccaggggtctggatgctttgtagcaagctcctccttttttgcaaaatgatgttcggcctactgtacgtactgaactttcaggttataatggtacctcagatcctagatccccggagctgtgattctgcctccaattattcctccagtcaatcctgtgtcagctcatcaataaacagagactttcactctctggttgcctccagggaagaatgtgtggttgtgagttattctgtcttctcttttgacacgggaggagagtcctttcatcatcttggtgtgtcagtatctagggacagtgcagactagtctcagcttgggaactttaatataatcttaaaactgttgactatgtaaaggaagaagggcagcgactatctgttttgtctgctatttgtcttcatttgaagaggggcggtgtgtgtgtgggggaggtggctctgttttattgccccgggctgctgttgttgctttatgaaggcaagcacttgtctatatttttgggcccaaatattatatggagcacaagggatgctttacatatctagaatatcccttattttcaccacataaattaatggcattcagaataatatggaattgttggttctatatagcttactattgctctatgtagtgctacatttattaaggtgttgactaatatatttcgccctggtcctaacgaaacatagattcactctttaagcaggagtggccaattcattttagttctggagacagtgattaattgctgcgaaattcctgtggagtatacaaatatgccataggggaaaactgtatccctcggtggcaaaggggttaattaaaacatgcaagaaatagaatttttctttttatataattctctttactttaggccagaatgaatctggagtcgctgtccataatgggagaatatatttagttggtggatattcaatttggacaaatgagcctctggcttgtatccaggtgagtggttgaagttccttttgaagtttctgctgatggttcagcgaggttatgtttcgcaattcagctgcagaaggagatatttatgtgtagagaggagctcaaggtccctttgtttgtgcagttagttcagcctatctcctatctcctagataggatgcctactaaatgattgattccttttacaattaagctgggcacaagctttaaaacatctacaaaatatcccccaaatggagaactttggataacttactccttttaatacatatttttttttttacatttggcaatagtcactttgcactcccacagtttaaaaagataccccatcctcatgaatttagtatattatagtttgttcattttcagaattgttgcctgcagaggtgtgcttcctttttgccagaggatcccagcattcgtggtttctgggtggtctgataggatagccttagcactgcacaagagagccgggcaggtttgccttggcagtgagccagctgggccaccaaggtcaaaaccgcatacttcgttgctgtatatagtggaggtctgattcctagtgctctgtctaattcttactgcttttctgtcctctggtaaactcttgaggtatcttagccccaacttctctaacataccctttgaatgactcatatttttgctaacttaatctttgtgggaaaactttagaaaaatgttttttaatgttgcgaaatgtttctagcatcatcatcatcttcaccaccaccaccatcatcaccattgtcatcattagcaggtctcactctgcagcgctgccttgcctggagctcattgcatagactagagtggcctcagactctcgagatctgcctgtctgcctccagagtgccgggataaaaggtgtgcaccaccacacccggcagttgagctttctagtttttgattgtgtctcataatcacgggatatatgcccgtgtattatatgcccgtgtactccgtcaggtggcatgtgcttgtctgctttcaagacggcgttcaagggtctacttggtgcattatgttagtaatatttctcctttatcttccagctattatttgttcatcctttctcctctcgctttctctcaccgcaagttttcctgaggatcttacatcgctctcttattcacagagatgaaacagatatgaaaactcgattgccctttttggctgaatagacccgaggtttacagtgaatggctagaattaattgttgttagcccacaggggaatgctcataaaactctgtcatgctttacagttgaagttaaggaagaaaacatctaaaacaattagttttatatactgccaatacaatataggtagatttgaacttaacacaaagaaaaactaaacctatctctacctggaaatgataaaacacactgccatgtaactgaattgaatgtcacaaggaaataaacaaccttaagactttgtagtaataagagcagtatgcagcaaaacataggacagatgtagcttacgaagccagaaaatgaatttaaaaataaattcaaagtagacgatgagaaagagcaaggcaatgcttaggaaacagtaatacaggaaaaacatatgcccataagaagtgcatggatacgctaaccagcaggtgcctgtccccccatcatcccccccccccccaggagtggcttgtcttcacccatgtgtgtttttggcagttttcagccctaagagttttctttaccactcttcagaactgagaagatgtttgattggcaggagtgtcccacagtaccaggaggctatgctggagtgtcccacagtgccaggaggctatgctggagtatcccacagtgccaggaggctatgctggagtgtctcacagtgccaggaggccatgctggagtgtcccacagtgccaggaggccatgctggagtgtcccacagtgccaggatgctatgcaggagtgtcccacagtgccaggaggctatgctggagtgtcccacagtgccaggaggccatgctggagtgtcccacagtgccaggaggccatgctggagtgtcccacagtgccaggatgctatgcaggagtgtcccacagtgccaggaggctatgctggagtgtcccacagtgccaggaggctatgctggagtgtcccacagtgccaggaggctatgctggagtgtcccacagtgccaggaggctatgctggagtgtcccacagttccaggaggctatgctggagtgtcccacagttccaggaggctatgctggagtgtcccacagtgccaggaggctatgctggagtatcccacagtgccaggatgctatgttggaagtggcctaggaggcttcattggattaactttacagcagaattaagtttgtgctttcattaagttgtataagtcagacacgattatgggtatatttctactaacattagcgttagattagctatgaataagagactaaactataagagaaaaataagaaactcttctaatgtgttagttttaagacagcagaatgattgatggtcacactgcaaaactttttcaagtctatttttggcaacttaatgtgtaagacagaacagttttaaaacagaacaaacacaaccacttcaaacttgttctatccccagtttttccttagaaggttgagtaaccttgtacgctaaccttttcaatatttttgaaatgctttacctgcatatatgtctgggtaccacaggcatccagtgcccacagaggccaaaagacagcatcagatgcccctgggattccaacccgggtctcctccaagaccagcaagtgctcttaaccactgagtcatctctccagcctgcttgcccactgattcagtattaataattcctggttattcccatacaaactttattcaaaaaatgaatgtgtgcatattttaaaccactatggacacgacattcaagagtttcccctggattaaggtaacactaaaagaacagattttaaattttaacaagttcttgtgttagtggaataaagtttatctttaatatcacataataaaataaatcggtgcattatcttaaaaaaatgcagataattctgtgtttccttagcctcctgggaattccatctattcctgtgactagcacactcctacaaagcatagaaaaacttgagaaaaaagtcttctctttctttaatatttctgtgtgtatgttggggcacaaccacttgccagccacggtatacatgtggaagtcatatgactacgtgcagagttgactctttctaccctgagtaaacttattccatgtgacctcatagcacacgcacttgtaccactaaaccatctctctggacatgtttcattttccacatggttatgtatctgtgtggtgtgtctgtgtatgagtacatatgttaacatgtttatagctgtgtgtgtgtgtggcatgtggagacctgtagttgcccgcaagtatattcctccattgtacttgaccttactcatcaagacaggatctctcactgatcttggactaggtccggtattcctactttaactagcaagccagcctgtgggtggatcttgccaccgcctcccacgagctggcattacaattggtcacaggtctatctgtattttacgtggattctgaggatcggaactttgttcttcatgcttgcagggcaagctctttatcccctgagccatctctgtagcccaacaaacatgtatgcatacgaggtcttatgattaataggcgtgagcatattagcatatggtttatcatttagagagacatttggaaacagaatcttcagggataatagcgttttagtggtttaacttttaaattatgtgtatgcatgttcatgtgtgctgtggtaaatatcatttggggctttcttccccaccttagatcatttagtttccaaataaaagacacaaaacttttatagttataataagtcttaaggcactagagttgggcagatatcaacgctttatgctattttctatttccctatcattaaccctgagatatcacttgccgtgttctgcctgggccactcctactccatcaggtcggcccttctggccatgagctcacagtaacccatggcaacttcttcctttattccctctctacatcatagtctctcctctgaccccaaaccctgggaaccttcactccggaacctatcttctgcacagcccagactgtaggcatctttattaaccaatca

SEQ ID NO: 1946 - DNA, 1083 bp, Mus musculus
tattcaagaaatgctgacgggccagaggctgtgccactcggaaactcacaatgacacggtcctggcggcgctgaatcagcaaagaagtgatggcattctctgcgacgtgaccctgatcgccgaggaacagaaattccacgctcacaaggcggtcctagcagcctgcagtgactacttccgggcaatgttcagtctttgtatggtggaaagtggagccgatgaagtaaatttacgtggtgtgaccagcctgggcttaaagcaggctctggagttcgcatatacaggacagctagctgtgaggtggctggaacacaattgccattaccagcatctggacgagctcctgcagtacatccgctttggcctaatggatgtggatacactccacacggttgccctatcccaccccctggtgcaggcaagtgagacggcaactgcccttgtcaacgaggccctggaataccaccaaagcatctatgcacagcctgtgtggcagacccgccggacaaaaccgcgattccagtccgatactctctatattattggtgggaagaagcgtgaggtctgcaaagtcaaggaacttcgttacttcaatcctgtggaccaggagaatgccctcatagccgccattgccaactggagtgagctggctcccatgccggtgggaaggagccatcactgtgtggcagtcatgggggacttcctatttgtagcaggaggagaagtggaacatgccagtggccggacatgtgccgtgaggacagcctgtcgctatgacccccgcagtaattcctgggcagagatagcacccatgaaaaactgccgggaacattttgtgctgggtgccatggatgaatacctctatgcagtagggggcagaaatgaactgcgccaagttctacctacagttgaacgatactgccccaagaagaacaaatggacttttgtgcagtcctttgacagatccctctcgtgtcacgctggatatgtggctgatggtcttctttggatatcaggtggggtgacaaacaccgcacagtatcagaacagactgatggtatatgaacctaaccaggtaaggcg

SEQ ID NO: 1947 - protein, 361 aa, Mus musculus
  VARIANT (1)...(361): Xaa = Any Amino Acid
IQEMLTGQRLCHSETHNDTVLAALNQQRSDGILCDVTLIAEEQKFHAHKAVLAACSDYFRAMFSLCMVESGADEVNLRGVTSLGLKQALEFAYTGQLAVRWLEHNCHYQHLDELLQYIRFGLMDVDTLHTVALSHPLVQASETATALVNEALEYHQSIYAQPVWQTRRTKPRFQSDTLYIIGGKKREVCKVKELRYFNPVDQENALIAAIANWSELAPMPVGRSHHCVAVMGDFLFVAGGEVEHASGRTCAVRTACRYDPRSNSWAEIAPMKNCREHFVLGAMDEYLYAVGGRNELRQVLPTVERYCPKKNKWTFVQSFDRSLSCHAGYVADGLLWISGGVTNTAQYQNRLMVYEPNQVRX
